United States Patent 11,752,178 (METHODS FOR THE ISOLATION OF MICROBES WITH ENHANCED PERSISTANCE AND COMPOSITIONS WITH SUCH MICROBES) - sequence listing, part 3

SEQ ID NO: 16 - DNA, 247799 bp, Bifidobacterium longum
aagagaagatttgcggcggccatggcccaggtgagacgcccggtcccattccgaacccggaagctaaggcctggcacggcgatggtactgcacccgacagggtgtgggagagtagcacgccgccgcaccacacgtacaggaagcccctcggagcacacgccccaaggggctttcgcatacccgaaaccaacaagacaagacaccgacaagacataggctctcgcacctagggtgtggccgaatcgaaagcatatagaagagggaaccctccaatgacggagagttccctctttgcgtatctggaccgataaaggtctagaaattgaaattgtccggatcagcaccgttgcgcttgccggtgttgatggcggagatggcggtcatatcatcgaccgataggttgaagtcgaagacctcgaagttctgcttgatgcgctcggcatgagtggacttgggaagcacgacgatgccgcgctggatgtgccaacgaatcactacctgtgcagcagacttgccgtacttggcaccgattccggccagtactgggttgctgagtaggttaccgccggtgccgccgagcggactccaagcttcagtgtgaatgcccttggcacgcagctggtcaataagctcttgattggtgaattgtggggaagactcaacttggtctacagcaggcaccacatcgctatgggtcagtagctcatcgatatgatgcttttggaagttgctgacgccaatggccttggcgcggccagaggcataaatctcctgcaagtcgtcccatgcctgctgccagccgtctgctggccagtgaatcagatacagatccacataatccacgcccaagcggtcgaggctttcttggaatgcatccttgccgcagcgtgcgcgaatatcgtcattccacagcttggtggtcaagaagaaatcgctgcgcggcacaccagcacggcgaataccttcacccactgaagcctcgttgtggtaaatcattgcggtatcgatatggcggtagccattctccagagccgtctgcaccgcgttcactgtagtatcaccatccggtgtctggaatacgcccaagcccacctgcgggatgacagtgccgttgttcagcatgattgtcgattgaattgccataatgcctcactagtcgtagtattcgttcaatttcccattctagaaacaagacgatgcaataagccgcgttttgctggcaaagaatgattcttttttcagcgctacgatgaacgatatgactacggaatatgtggctgcatttgatgcggggaccacggcgttgaagggtgccttagttaatgggcagggttgcattgtagctagtgcgagtagcgaacttgaccttattatcaacggcgactatcgggagcagagccccgatcaatggtggcaagctttctgctcggcctccaggcacatgattgagcaggcgcggcaatccgagtcagaattcaatgtgactcgcattcgtggcatcattttcagcggtcagatgcaggatgttattgttttgaacggcgagctcaatcccgtccgcaatgccattctgtattcggatggccgagccgaggaacaggccaagcaactcgccgagacatatcagggcggtgcagaacgtttcctgaacaccgttggtaaccggctcgaaggctgcttgccgttgcccaagttgatgtggctgcgtgaacacgagccggaaacgtacgcgcgcattcgtcatgtattgatcagttccaaggactacttgatcgcccaattaactggcgaatgcgtgggcgatgtggcggcgtgttccacagctggggccatgaatatccgtaatggccagtgggatgccgaattatgcgaggtcgcagaaatcgacatgaccatattgccacacctgcacaatccgcaagacaacattggcacagtgacggaatccgctgcacaacgcaccggtttttccgccggaactgcggtatacgcgggcattggagacgcgggtgccaccacacttgccagcggtgtcagccaccctggtcaatacaacatcaatatcggcacctcaggctggatcgccaccgtttcgcccgagccgttcaccgacaagccaggtgctgcgaatctggcatttggcgtggaagaaggcttcgtgaatgccgtgccattcctcaacgccggcgacgtgcataaatgggttaccggcgtattctccgatggcgattacgcagaggcgcatcagcttatcgaaacatccaaacccggctccaacggtgtgctatgcctgccatatctggtgggggagcggttccctgttatgaatccgaatattcgcggtgcctatgtgggcctcgatccagacaccgccaaggcagacatgatgcgtgccgcgcttgagggtgtggccttctccattcgtcaaggtatggaaagttttgacgccaaacccaccgagatttccctgattggcggcggagccagagaaaatgcgtggtgccagattctggccgatgagttggagcatcctattgaagtgttcgccaatgccgatattctgccagcagtggcaatggcctcgttggtattcaatgtaccagacctgctgcaatcagtatgcgaatgcactgtataccagccgaatcctgacaccgcacgcacatatgccgacgcataccggcgattcctgagcctctacccaatgctgcgaacgatggattaggaactgagcatcatgaggcaatcggcgaatttggtccgcaaacatatagtggtcaacggactggtgcaaggcgtgggattccgttattttacggtgactcaggcacgtcggcttggtgtacggggttgggtgcgtaattgtcgcgatggctcggttgagctggaagcacaaggcagcagcgacgcagtgcaagccttggttgagcaattagccattggcccgcgatggtccgaagtgagtcacgtcgccgtgcatgacatgccgattatcgatgagaccgctcgggcatttggcgtgcgtcaataacctgtatcacgaacccacatcacgcacgataatctcacgatacgggtgaacatgggcgttcctcgccgcttaggcctcgcacattgctacgatggggcgttatgagtgagaacatcatgcgaatcattgacctgcgtggtcagaacctgtcccgtgccgaactgcttgccgcgatgccgcgtgctgcaatgggtacttccgaagccaccgatttggtgcgtccgattctggacgatgtcaaagaacgcggcgccgctgccctgcgcgacttcgaggagaagttcgatcacgtgcgtcccaagaacctgcgcgtgccggtcgaggcgatcaaggacgccctgaccacgctcgaccccgaagtgcgcgccgccatcgaggaatcggtgcgccgcgcccgcgccgtggccgccaaccaggtgccgaaggacttctacaccgacctcgccgaaggcgcccgcgtggccgaacgctggattccgattcagcgcgtcggcctgtatgtgcccggcggcaaggccgtctacccgagctccgtcatcatgaacgctgtgccggcccaggccgccggcgtcgaatcgctggccatcgccaccccgcccgcccgcgacaatgaggaaggcctgccgaacaagaccatcctcgccacctgcgccatcctcggtgttgacgaggtatacgcggtcggcggcgctcaggccattgccatgttcgcatacggcgccaagggcagcgagccgcaggacggcgacatcctgtgcgatccggttgacaagatcaccggcccgggcaacatcttcgttgccaccgccaagtcgctggtctccgcattcgtgggcattgacgcggttgccggccccaccgaaatcggcatcatcgccgacgaaaccgccaacccgagcctgctggccgccgacctcatcggccaggccgagcacgatgagctcgccggttccgtgctgttcaccgactccaccgagattgccgacaaggtgcaggagagcctcaagtaccgcgtgccgcgtaccgagcacgccgagcgtgtccacacgtcgctgtccggcacccagtctgccatcgtgctgaccgacggtctcgaccagtccatcgacgcggccaacgcctacgccgccgaacaccttgagattcagaccaaggatgccgatgcggtcgtcaagcgcatcaagaacgccggtgccatcttccgcggtccgtactccccggtgccgctgggcgactacatgtccggctccaaccacgtgctgcccaccggcggcaccgcccgcttcgccgcaggcctcggcgtgcacaccttcatgaagccggtcgaagtcatcgaatacgacgaggaaggcctcaaggccctcgccgcccgcatcaacgccttcgcggtatccgaggacctgcccgcccacggcgagtgcgtgctctcccgcttcgtcaaggatccgtatgacaaggccaccctgcgcgagcaggagaaggaagccggtctgcgatgagctcgattcctgcaaacctgccgctgcgcaacgacctgatcggtgaggagccgtacggcgctccccagctggacgtgccggtgtgcctgaacgtcaacgagaacccgtatgcgccggacccggccgtatgcgacaccatcgccaagcgtgtgcgtgaaatcgcccccacactcaaccgatacccggaccgtgagcacatcgaattgcgtcaggcattctccgattacctggcccgcgaatccggtacccgtctggacgtggacgagctgtggggtgccaacggctccaacgagatcatgctccagctgttccaggctttcggtggcccgggccgcaccgcactcggtgccgacccgacgtactccatgtacccggagtacgcccgcgacaccttcaccggttggaagctcgcccaccgcaacgccgacttcacgctgaacgtcgacaaggtgcttgaggccatcgccgaggtcaagccctcgatggtgctgctcactagcccaaacaacccgaccggcaccccgttgccgatggaggatatcgaacgtattctcgccgcctgcgaaaccgctgaagtggtcggcgcgggcgagggcgtgcatccgattctcgtcatcgacgaagcgtacgtggaattccgcaagcccggcaccccgagcgccgtgagcctgatcaaggaccacccgaacttggccgtcagccgcaccatgagcaaggccttcgccttcgccggtgcgcgagtcggctacctggccgcgtccaagggcatcatcgactgcgtgcgtatcgtacgtatgccgtaccacctgtccgccgtgactcaggccgccgcactggccgccttcgaacacaccgacgagcagctgagccgtgtcgagcacctgcgcgaaacccgcgaggccaccgccgcatggctcaaggaacagacctacaaggaccagccgcttgaagtggccgaatccggctcgaacttcctgctgttcggcgggcacttcgacaagcgtgaagccatcttcgacgagctcctgaagcgcgacgtactcatccgcgtggtcggaccggacggttggctgcgcgtgtgcatgggcaccgacgaggagatggaaaccttccgtaacgcccttgttgaagtgcttcgtatagtggaagcagcataagggacgtttctttccgattgcggcgagacccgaagcgattcgagtcccgccgcaatccaatatgacgaatcacacaggagacatgatggcaagaaccgcgcacatcgtccgcgaaaccaccgaatcacacatcgacctcgaactgaacctcgacggcacaggcaaaaccgatatcgatacatccgtgccgttctacaaccatatgatgaccgcgctcggcaagcattcgctgatcgacctgaccatccacgcccacggcgacaccgacatcgacgtgcaccacactgtggaagatacggccatcgtgttcggcgaagctctgaagcaggctctcggcgacaagaaaggcatccgccgctttgccgacgccaccgtgccgctcgacgaggcgctggccaaggccgtggtcgacatttccggccgcccgtactgcgtgtgcagcggcgagcccgaaggctacgaattctgcatgatcggcggccattttaccggctcgctggtccgccacgtcatggaatccatcgccttccacgccggcatctgtctgcacatgcaggtgctcgccggccgcgacccgcaccacatcgctgaagccgaattcaaggcgctggcccgtgcgctgcgcttcgccgtggaaatcgacccgcgtgtagacggcgtgcccagcaccaagggagccctgtgatgaccgacgacaagttcgatccggacgaatcgcacttctccgacgaggagcttgaggctgcgctcgccggattcgagaaagaactcgcggacgattcggtatccggcgatgccagtgataccagtgatgccgataaaacagcggacgctgcttcagcgaagtccgattccgacgcgaatgatgatacggctgataaggcttccgctgattccggccggcctatgaccgacgacgtcaccgggtccgttgcggatgcggtgaacgaggccatggccgatgtggtcgacccctcgctcggcttcgacaacgaactcgctggactgttgggtaacaaggcgaaggtggcgctgatcgttacccgtcttgcctccgccgaactgttggccgcgttctgccagctgtcggacatctccgccgcatgcatcggtgccaatcagggggccgtcgcggtgctgaagaatctggacggcgacggcccggaagccgcagccaaggacctgaccaccgtggtatccggcatggccgtgattcttgcagtcaatcgtgccgacaagctcgaagtggccatgtacgtgcagggagaggccggccagagtttcgcgccgcccgtgctgttcacctccacaccgcgcttcgtcgaggacctgatgctcggcatcgtaaccctgaaccaactcaagacccaagggttcgaagtggtggattccgctggactcgaccatgatcaggcgatgcagattctcgccaaccacactaggcgcggacgtggcgggcgcggctcccgcatcgaatagacgccaaccaaaccagtaggggataggagagcagatgaccacagcggttgttttcgattacggtttcggcaatgtacgttccatggtgcgtgcgctcgccaatcttggcgtcgacaccaccctcacctccgactaccggcagtcgttggaggccgacggcctagtcgtgccgggcgtgggtgcgttcgccgcatgtatggaaggactgaagaaggtcgacggcgaccgtgtgatctatgatcgcatccgcgctggccgcccggtgctcggcgtgtgcgtgggcgagcagatcatgttcgaacacggtctggagcacggtgcccatgccgcaggcatcggactgatcggcggttcggtgaacctgctggacgccgacgtggtgcctcacatgggatgggacacgatcgaggccgcccccgattcggtgctgctcaacggcgtggagaacgaacggttctacttcgtgcactcctacgccgcgatggaagtgaagccggcggatacgtcccgcttcgacatcgatctgagcgattcgcccgaacgcgtgagctggtgctcgtacggccgatcgcgctttgtggccgcctacgaacacggcccgctgtccgccacgcaattccacccggaaaagtccggggacgctggctcccagctcctcaagaactggatcgccacgctgtaaaaaagcatgaagctccctctgacgagggagctcaaattgtgtataagtaactgaagaaaggctcttcttatgtcgttgactctgctgcccgccgtcgatgtacgcgatggcaaggccgtgcgcctgcgccaaggcgaatccggttccgaaaccgattacggttcgccgttcgaggccgcccgtacttgggttgaggccggtgccgaatggattcacctggtcgaccttgatgccgctttcggtacgggcaacaatcgcgatcagctgcgagaaatcgttcatgagctcggcgaccgcgtgaacatcgaactgtccggcggcgtgcgcgatgacgcttcgttggacgcggcccttgaggccggtgccgcccgagtgaacatcggcaccgccgctttggagaatccggattggaccgcctcggtcatcaagaagtacggcgaccgcgtggctgttggtctggatgtgcgcggtcacacactggcggcgcgcggctggacgcgcgaaggcggcgacctgtttgagaccatgaagttccttgactccgtgggctgctcgcgttacgtggtaaccgacgtggctaaggacggcatgatgtccggcccgaacattcaattgctgagtgaagtcgctgaacgcaccgacgccaaggtcacggcttccggtggtatctccaagctggacgatttgcgcgccatcaaggaactggctgaaattggtgttgattctgccatcctcggcaagtccctctatgcacgtgcgttcacgctccaggaagcgcttgaagtagcgaagtaggcaaaggactcgccttagcgagactgttaatctaccttcgctcagctatcgcttcactcagacccctcctacggacagcccattgggctgtccgcttaacggctcagcaagggaggtcgccggatttgaggagctttttgaagacggcgtagtcttcatcattctgttcggcgtagctgacggcgaatgaggcgatggcctgatcgaattcgtcggtgccacccatgtaattggcgatcgcaatcgaatcgccggtgcgggcgtgggcgtgcgccaacgaccatgcgcacatgcgtgacagatcgctcaatcccgaagcgttgagattgtcgatatcaatcgaccccttgccattccacaactggcgcacgtaatagtcgcgcggtcggccatcctcggccataaagctcgaccaacccaacagcacatcggccgtattctgaatcagcttctgcccctgaaccacgcgctcaccgtgcgtggcgtacggcgacgcgccgcagtaatgctcgagcacggaatacgtggcctccttcatctgaatcatcatcggatcgtcgatatcacgcgcgatccacaccgacgtccacgcgcgctggcccaccgagcccacgcccaccaccttgcgggccgcatcctgatagcgcaaatgatcgaacacccaacggcgatcgtcgtacagggaatgccggtagctctcgaacagcgtgtctatacgtgcctgcaacgcatccaagtcggcgtaatcatccagctgattgatcggcaccagctcgggcggattggatttgaacctgagcttgccgctctcataacggcacagtttggccgccgccgcgtcgttatccttcagcagcgccttcatggccgcctcacgcagcacacggctgcgtttggaaccggtggtctcgaagcggtcgagcgtctcctccacgtccaggtgctcataccacgcgtcaaggtaatccatttcggagaaccacttcatgcgtgtgcggtacgtgtgtacgcactggaccacggcggcgcgacggtccttctccttgattttgttggcgcgtccgcagatctccaccgaggcggcgagacgtttcagatcccattcccacgggccgatagcggtttcgtcgaaatcattgatatcgaacaccagacgggcggaaggggagcggaaaatgccgaaattgccgatatgcgcgtcgcccacgcactgcaccggaatgccagtgaccggcgtggaggccaggtcattggtcatgatgagcacggtgccccggtagaaggtgaaggggctggcgctcatacgcttgtaacgcagcggaatcagatccggtacgcgaatcgcggactgctcctccaaaaggctgatcgcctcacgccggccctccttgaccttccagatggcatgtgcgtccagcggcgccttggtacgagtggcgatgccggcgcgcgaacggtcgcgcgggtcggtggcctgcgtccagctggtcacgtcgacgggcggattggcggatggggtgagatgatcttcgctcatagtcactaccatagtgccgtgccggcatgggcctgaaccatgcctgacatgcggaccggggcatgttgatgaaatctcgcgactcgcaggtgacgaacagtgagatgttaacgcccttcgtaacacggttatggaacgataggcgactatggataaacagcaggagtttgcgctgcgcacggtcgaagaacgcgacgtgcgctttattcgtctgtggttcacggacgtgttgggaacactgaagtccgtggcgattgctccggccgaactggaagccgcgtttgaggagggtctcggcttcgacggttccgccatcgagggcatgacccgcgtgtccgaagacgatatgatcgttcaacccgatccctcgacgttccagatcctgccgtggcgcggtggcccgcaaggtaccgcccgcatgttctgcgacattctgaccccggacggcgagccttcgctcggcgatccacgtcacgtgttgaagcgcacgctcgccaaagccaaggacaagggcttcacgttctacgtgcatccggaaatcgagttctacctgttcgaaagccaggacgactggtccaaggccccgaccccgatcgacgagggcggctacttcgaccacgtgccgcgcagcccaggcatggacttccgccgtgccaccgtgaacatgctcgagcaaatgggcatctcggtggaatactcgcaccatgaggcggggccaggccagaacgagatcgatctgcgatacgcggacgcgctcaccatggccgacaacatcatgacattccgtacggtggtcaaggagatttccttggagcgtggcattcacgccagcttcatgcccaagcccctggccgacgcgcccggttccggcatgcacacgcacctgagcctgttcgaaggcgattccaacgccttctacgaggccggtcaggagttcaacatgtccctgaccgcccgccagttcgccgccggcatcctgtaccatgcggccgaaatctgcgcggtcaccgaccagtacgtcaactcgtacaagcgcctgtggggcggtaacgaggcaccaagctacatctgctggggccacaacaaccgttccgcgctgctgcgtatcccgcagtacaagccgggcaagggcaactccgcgcgcatggagttccgtgcgctcgacccggtggccaacccataccttgcctactcggtgctgctggccgccggtctcgacggtatcgataagcagatgcagttgggcgagcctaccagtgatgacgtgtgggagctcaccgacggcgaacgtcaggctatgggcattcagccgctgccgcgctcgctggacgaggcgctgaagatcatggagaaatccgacttcgtggccgacgtgctcggcgaacacgccttcggctacttcctggacaacaagcaccaggaatgggaggagtacaaccagcaggtcacgccttacgagctgaagaagtatctgccgaagctgtaatcgcaagcgttgcacatgtgccaaaccccgtcgatgattggtcatcggcggggttttctatggcgtgtcgtggtggtgggtagtgggcagaggtgggaataacgttgtcgctgagttgatacgaaaaaacgattgacataaccgacgaatcagcttgtagtacgagcgagagcactcaagagagcacccatgacgaacgcacctgcgaacaccgcgcgtaccggccggcacttgggtggccgatacctttggttggcgtgtcacctttgccttggtctcggtgctcaccgccgtgctgatggcatcgatggcagtgtctctgccacgcaactcgcatccggcgaagatcggtttcctgaggcaattccgcctgttcttcgaccgccgcatccagctcggcgtggcggatgtggtcttcggcgcagccgcctcctatgtcttctacacgtatctttcgccgatcatgcgcgacgaaatcggcgtgcccgaacgctatatcagcatcggcttggtgatttacggctgcgcctgcctgtggagcaacctgtacggcggcaagctggccgacaaaggtcatggcgtggaaccattgacccacattcgaccgatctactgcgtgcaggccgtctgcctgtgtctgctggctttcgcctcgctgctggcggttggcgccacgaccctgctgcgtccatacgtcgaacgctgacagtgttggccgagtccaatcggacaagaccggtcagctgccgttatcagcttcgcggcgaaccgaaccagctggtgtagataagcgcgaagttgcggttgccataactggagcaggaatcgccggtaccgttgccagcggccagtgcggcgatgttcggctggtagggcgtatagatgtagagcagggcggtcgccttgttctcgatatacacttgtgcgccgccgcatgccgcgttcggatgatattggatgtagttgagattgtgcgccgtatacccgtactgttcctcgtgctcgagatagtaacggtaccgcttggccgcgccatacacctgccgaaagaatccggcataggcgggatcgcagtcggcggtatccggacagttcaaccccatcgccgccataagctgatagtcgctgggatcgacggcagtgaccagatgctgctccttctgcatcacggtgagcagcactttctggctcaccttgcaggcgcgggccgactggtcgatgattgtcgccgccgactcgcctttggtgcctgtatagtccgcgcacaggccttcgcctgactcgttcgatgtgtcgaaggtcatcgcggccagcgagccaccttgtgtgtccaaaaacgattggacttcggcctgactcatcgccgaaccgttgaagaactgaccatccgaaataatattgcccggattgaaatcgtatgttcgcgtcagttccagctgtgccgcctcggctgcgcgaacctgtgcccgccagtttgtgaaacgaaccagcccggccaccagcgctacgacaacgaccaccgccaccgtgggaatcagcaccatcttgatacgggtcggccagttcgccttacgccaggaacgcttcagagcattgatcggaccgtgcctacgattgcgtttcctgttccgattgccgaggcgtccgcgcacttgcccacgctgtgatgacggcttgcgcgtgcgctggcgcgtggcctggcgacttgtttgccgtccggtcacgccagcgctttcttgatacggttgagcgaagccggccccttggtgccaagctcctgcgcccatagggacacgtagaactcttcaagcatccaacgggcctgttcggcctgcttcatcaatgcctcatgcttcgggccggccggctccgccttggcacgggccaacgccttatcgaccacctgacgggcctcgtcggcctgccaagcccacttgacatcacggttcttatcggttttcgccttattgagtcggctcagatcggctctcaaatatcggctcaacgacttcagcgcatccgggggagtgcgcccgatgaatccggggtagacgagcgtggcgatatggtcgcgaatcgactgcaacaccgaaagcatcggcagatcagccttgccgccagtggccttgtcgacctcggcataagccttgagcacggcgatcacgtcatgcgccacctgatagacggtgtcctcgtacacttcgcgcacatcgagcaccgcattggctaacgcctcatcgtccgagagcctgtcgacattcggcatcagccgtttgaccgtggccagctgcaggtcttcgaccagatccttggtggacttgtacggagcagaagccagcatcaacgcctcggtacccagccagcgcgacgaaatgcgttcggccggcaaccgcagcgcatccaatgcgccacgccagagcatcgtggcccgggactcggtggtggcacccgccttatgtaacaggttcgcctgactgaccagcttgccctgttctccagcctgatcggcctgcttcttgaccatttgacgggccgacgcctccgcctgcgcggcgaacttgcgttgcagcgccttcagatccttggacacacccagcaccttgatggggccgcgcgcatgccggcgtccacgagggtgcttgccggccggcagttgctgctccaccgagaacgtgaccctgagatacggggaaagacgctcgaccagttccggccccaacacttcgggatgaatctgcgcacccttggtggcgatggccgccttggtgaacacatgtgccagatcgggccagccaacggtcgtgccatcctcatccaccggcggcagattcggcttctgctgcgagcccgagcccggcagatccgggtaatgctcgtcgatccagtcacgaatcgcacgcgcggcatccggggccggcacgaactggacgcgcagctgcttgggcagcgccttgatcatcgacaggatcagctcatccaacagacccggcacattccatgtgaactggtcgggcgtgatacgcgagagcgccttcaacggcacatgcacggtgacgccgtcggccgggtcggccggatcgtacacgtagctcagacgcaggtcgatgggttggccgtccgatccggtcgtatgccaatggtcggggtaatcgtccaggctcaccgaatcgctggatgccagacgctccaccttggccgggtcgaaatcaagcagattcggctggcggtcatgctcggacttccaccatttcgccagatcggccacgctggtcacatcgttgggaatgaccgcgttgtagaagtcgaacagatcctcgtcggacacggtatccgccagctggcgggtgcggctcgcatcatcggcggcatcctcgagaatgtcgcggtttttgcccacgaagtcgtcgtaactgaaacgctgctgaatatcgccctcgaccagaccctggcgaatcaggaagtcgcgcgcctcaagtggattgatgcgtccccactgcacggcacggtcctgtacgatcggcagaccatacagcagcacgcgcgcggtggccacagccgagccacgcgaacccgaccagtgcggctccgcatacgtggtgcgggtcaattggccggccaacggttcggcccacgcggggtcgatggccgccgaatagcgggcccacaggcgagaggtttccaccagttcggtgctcatcacccatgacggggtcttcttggccacggcggaagcggggaacagggcgaaacgggtgccgcgtgcgccctgataatcgttcttcgactgcttctgggcgcgtttcatcgcacgggcgcgcgccgaaccggtcagccccgcgaaatcggaggccttgggctcgcgcaccacctgcatgcccatcatcgacagcaatccggcgagcatcgacttgtggatgccatccgcatcccacgcgcagcacagcgaatgcgcggcctgctgattcaacggcagctggcggatttccaagcctgggcgggaggtgggcagcgggtcgccgaccttgaacttcagctccttgcacatctggcgtagctgggagacgagatctttccactggcgcatcctcagccagctgaaatactcggttttgcagatacggcgcagcgcgttgttgctcggatcgccgtctgcttggaacacgcggtcccagatattcagggccgtcaggaagtcggaggtctcatccgcataccggttgtggatgcggtcggcatcctcacgcttgtcgtccgggcgttcacgtgggtcctgcaagctcaggaacgccacgaccacgagcacctgggccagaagattcggcgaaccggttttcgcggcctcgataaccatacgtcccagacgcacgtcgatggggatgcgcgccagctgacgaccggtatgggtgagcgtcacctcgccgcgcttgcggccgatggccttgagctcggtgagctcattgaaaccgtccgacacggccttcatatccggcggatcgatgaacccgaagttcgtgacgtcctcggccgtgcgggccacgcccaccgacagcatgtggagtaccacggcacccagcgaggtacgcaggatttccggctcggtgaagcgcggacgggtctcgtaatcctcacgcgaatacaggcggatcgcgatgccgtcggccacacggccgcatcggccggacctctggtcggcactggcctggctgatcggctcgatcggcagacgctgaacctttgcggtcttcgaataccgggagatacgggcggaaccggggtccaccacataccggataccgggcacggtcagcgaggtctcagccacattggtggcaatgacgatgcgctggtgaaggtgcgattcaaacaccttatgctggtcggcggcggacagtcgcgcgaacagcggcatgatctcgatggcatccggccggcgcatgtcgtcggcgcgcgggccgtaatgatgccgcagtgcggcctcgaactcgtggatgtcgcgctcgccggaggcgaagaccagaatatcgcggggaccgcgctcgtgggaggagtgaatcaccagctcggcgcaggctcgagccacggcggtaggcatatcggtgatgccgtcatcggcataggaggcaccggaccggccgcggggccggtcggaatcggattccgcgatggcgctggccagctcgtcgtaatcggcgtcgccggggcgggcgcccaccgcgaatcccggcacttcgcgcatcaacgcgggcgcggtgccaagcggctcgtagaccacctgcacggggaaggtgcggccggaaacctcgattaccggcaccttctcatgcaaggcgtgctcgaaatgctcctggaacttgaccgaatcgatggtcgcggaggtaatgatgagcttcagatcgcggcgctgaggcagcagtgccgtcagatagccgagcagaaagtcgatgttaagactgcgctcatgcgcctcgtcgatgatgatcgtatcgtatcgggtgagtttcggatcgcgctggatctgggcgagcagaataccgtcggtcacgaccctcaatcgtgtgccgggcgagctttcgtcggtgaaacgcacctgatagccgacctcgtcaccgagcttcacgcccatctccgaggcgatacgttcggccaccgtgcgtgcggcgatacggcgaggctgggtgtgcacgatctgcttgccgtgcgtgccacggccaagctcaagcaggattttcggcagctgtgtggttttgcccgaaccggtctggccggacacaataacgacttgggaacgtttgaccgcgctggctatctcatcacgcgcggcagatacgggaagttctgcgggatactcatatttcatgacgaacttcaatgatacggaagcccttggagctcgcgtatttgctcgcagtgaacccctcgccgagcgcatcgtccagccaggggatcagcgaatcggaaccgagattcttctgcactacgagataggcggcaccgcccaccttgagcttcggcagccaagccataagcaatgtatgcagcgcttccttgccgactcggatcggtgggttcgaccaaatcacatcaaacgtgaggtcgctcggcaccgtctcgcagaacgccggctggttctcggcaggcaggggagtgctggactcgtccacctgagccgtatgaatgttcgtgtggccgttcgcctgtgcgttggcatgggtcaggtccaccgcgcgctcgttgacatccaccgcccacacgttcgcttcgggcgactcaaacgccaatgtcagggcgatagggccccagccgcagcccaaatccagaaaatcgccggtaagcggcggctcgggcgcatgcttcagcaataccgacgtaccgaggtccacgcgcgagccggagaacacgccgttcgacacctgagcggtcgcctcatggccgcgcaacgttacgttcaatgtgcggcgcacatccttcgatgcgggttccgcagagaaatactgttctgccatggtcgctccatttctgcgggattcgccgctctcgtatgccgacctgtatcagccggcctatgccggtacgtgccgatctatgccagcatgtcacctcatgtgatgataataaaggaccatagaagaatcgtgaaccattccaaccaaacgaggcgcacttgaccgacaacacccagtacaccgacatcaaccgcggcaacaacgacgttacccctgaaggtgtgctggccgagcagtccgaagtgttgctcgacgacagccagcgcgcgaccggctggcatgaggacgccaaccaggaatgggaggagcgcgaggcccgcaacgagctcaagcatgtcgccggtctcggcgagctgcaggacgtcaccgaagtcgaataccgcaaggtgcgtctggaacgtgtggtgctcgtcggcgtctggtcgtccgccgtcaccacgcaagccaaggccgaggaatcattgagagagttggcggcgctcgccgaaaccgccggtgcggtggtatgcgatggtttgctgcagcatcgctccaagccggatgcagccacgtacgttggttccggcaaagccaaggagattgccggcatcgtggcgcgtgaggaagccgatacgattatcgtggacgacgacctgccgccgtcacagcgccgtgcattggaggacgccgccaaagtcaaggtggtggatcgcaccgcggtgattctggacatcttcgcccagcacgccacctcgcgtgaaggtaaggcgcaggtggagttggcgcagctcgaatacatgctgccccgactgcgtggttggggtggttcgctgtcccgtcaggccggcggtcgcgcggccggcgcggatgcgggcatcggatcgcgaggcccgggcgagaccaaaatcgaaatggaccgtcgtgtaattcgcacgcgtatcgccagactgcgccgtcagattcgtgagatggccccggcacgtgaggtcaagcgcggttcacgccgtcgcttcggcctgcccacagtggccgtggtcggctacacgaacgccggcaaatcctcgttgaccaaccgtctgaccggttcggccgaactggtggaaaacgcgctgttcgccacattggacacggccgtgcgccgcgccaaaacccgcgacggacgcgcttacgcttacgtggacacggtcggcttcgtgcgccgcctgcccacccagctggtcgaggcgttcaaatccaccctggaagaggtggccgaggccgacgtgatcctgcatgtggtcgatggctcccaccctgacccgttctctcaggtcgacgcggtcaatgacgtgttggcggacatcgaaggcacggcctcgattccgcgtattctcgtattcaacaaggccgatcaggcggacgaggcgactcgtgaacgactcgccgcgctgcagccagacgcgttcatcgtctccgcctataccggtgagggattggacgagctgcgtaccgcggtcgaaagtctgctgccggtcccgcatgtgcatgtcaacgctctgctgccgtataccgctggctccctgatctctcgtgtacgcgaatacggcaaggtagacaaggtggagtaccgcgatgatggcatacagcttgaagcggacgttgacgcccatcttgccgctcaggtggtcgaacagtccattgactaacgtgataaacatcacagtatattcgtgagcgctaacaaccgttgaaaacattaccatacggttatcaaacagggtggtgtgctggtagcaaaacgtcttagcgggtttatagagtgaagacgttagttacaaggcctgccattcatcagcagaccgcctttgaagagaggttcatccatcatggcggaaactaccgttaagcccacgaagcttgctgttattggtgccggtgccgttggctccaccctcgccttcgccgctgcccagcgtggcatcgctcgcgagatcgtgcttgaagacatcgccaaggagcgcgtggaagccgaagtgctcgacatgcagcatggctccagcttctacccgaccgtgtccatcgacggttccgacgatcctgagatctgccgcgacgccgacatggtcgtcatcaccgctggtccgcgtcagaagccgggtcagtctcgtcttgagctcgttggcgctaccgtcaacatcctcaaggccatcatgccgaacctggtcaaggtggctccgaacgccatctacatgctcatcaccaacccggtcgacatcgctacccacgtggctcagaagctcaccggtctgcccgagaaccagatcttcggttccggcaccaacctggactccgctcgtctgcgcttcctgattgcccagcagaccggcgtcaacgtcaagaacgtgcacgcttacatcgccggtgagcacggcgactccgaagtcccgctgtgggagtccgccaccatcggtggcgtccccatgtgcgactggaccccgctgcccggccacgatccgctcgacgccgacaagcgcgaggagatccaccaggaagtcaagaacgccgcttacaagatcatcaacggtaagggtgccaccaactacgccatcggcatgtccggcgtcgacatcatcgaagccgtcctgcacgacaccaaccgcatcctgcccgtgagctccatgctcaaggacttccacggcatctccgacatctgcatgtccgtgccgaccctcctcaaccgtcagggcgtcaacaacaccatcaacaccccggtctccgacaaggagctcgccgctctgaagcgctctgccgagacgctgaaggaaaccgccgcccagttcggcttctgataaaaaatcgctgtacggagcgcctttcgcaccgcacaagactcgacctacctttgtaggccttcaacttgtgcggcacgaaaatcgcacacatacagcgattttttataccctgccgaatgctcccattgggagcattttttattcgtggagttcgttggaggagggggagctatagccctcgggctcgagctggaaggtggtgtgggggaccgagaccgggaagtgctcgcgcaggcaatcctgcagttgggtgaggattgtggcggcatcttccatggtgaggtctttgtcaactaccacgtgggccatcagaatcggcatgccggtggacaccgtgctggcgtggaggtcatgcacggcaagcacatgcggcacgtcttccagatgttcgcgtaccttatcgaggtcaagtccatccggtgtttcctccagcagcaccttgaccgcgttgtgcagcaacttgatggcgcgcggaatcatcatcagtgcgatgacggcaccggccacggcgtcgaagccattccatccggtggagatcattaccagggcagaggccaccacggccaccgagccaagtgcgtcattcatcacctcgaggaacgcggccttcatattcatgttgtcttcgcgctgcgaggcaaggatgaaaatcgagatgatatttgcggcaagacccagaatgcccacgaacagcagcaagccgatatcgtcgatttccgctttggaaccgccgaacagacgcatgccggcctccatcaacgcatagatgccaacgacgagcagcaccacggcacctgcggcagcggtgagcacctcaagcctggcccagccccaagtacgagtgttgctgggcttgcggcgcatcagtatggcggtgattgtggatgccgccagcacggacatgtcggtgagcatatgaccggcatccaccagcagggccaatgagccggttaagacagccgacaccatttcgatgaggaagaccgaaccggttacggtcaacgtggcaatcagcctacgctggtgcgcggcagggtttatggatgtggatggtgcgggtgcatgggtatgagccatatgtactccttcgctctatcgagttgaaaccgcttctcaataccatttgcgatatggtctgaatacgacgaaaccccggcgcgaggccggggttccgtaagctgtgcgtgactatagcacgaccggcgcgattcggtgcacgctgatcagctggtggcgaacaggctacaatttgcgcagcacggtgaccaccttgcccataatcgtggcatgtgtgccgtcgatgggcgagtatgcggggttgtgcggcatcagccagacatggccgttttccttgcggaaggtcttcaccgtggcctcgtcatccagcagagcggcgacgatatctccgttgacggcggaattctgttcgcgcaccaccacatagtcgccatcgcagatagcggcatccaccatggaatcgccgtggacttccagcatgaacagggtgccggagccggtcagccgttccggcagacgcatgacgtcgtccacatgctgttcggcggtaattggcacgccggcggcaatacggccaacgagcggcacatcgtgtgattcggcaatggcttcggcggggaattggtatatctccgccacattactggtgctggttgcctcttcgctggcttgggagggcttttcggcattcggggcggatcctgccaccacctcgatggctcgacccttgttcgcgttcatgcggatgaagcccttgtcttccaaaacttgtagctgatgcttgaccgaagacggacttttgagcccggcggcatttccgatttcccggaaagagggagcgaagccttgttcgtcgatatgcgtgcgaatggcgtccaacactttgcgctggcggtcggtcagggtggactcgtccggcttctgcttgggggagaagggaatggtgctcacgtcagggctcctttcgttatgtcaccagcataacgtgttgttcgtgtgaaatcaaacatctgttcgagtttcgacttgaccgtgtcgaacgtttgtgccattataagaacagttgttcgatagaacatctgttcgagagaggtggtcgtgatgactggttcaatggtgatggccccggcccgtagcgcacgtgtagctatgcagcatgctggaacgtcccgccggaatgcgcgtgggaagattatcgcagtgatggtcgccttggcgctggcctggtgtggtttcggcgcgcttaccgttcagcgggcccaatcggatacgggggccacgcaggtgaccggttatatcgtgcggccgggggatacgctctggtcatatgcttcggctatcacgcctgctggtcatgatgtatcggaaacggtggatgagctgattgcgttgaacaatcttgagtccggatcattgcaggccgggcagcgcattattgttccggttgagtaaatgaaacccgagcggcatggtttttccgcccgtacacgttattctggggagcatgcattgtcctttttgccagaaccccgacaccaaagtcattgatacgcgcattagcgatgacggtcattccatccgtcggcgtcgcgtatgcccgaaatgcagcaagcgttttaccacggtggaaaccagtatgctgctggtcactaaacgttcgggtggcgtggagccattcagtagagacaaagtgatttccggcgtacgcaaagcttgtcaggggcggccggtcagagaagaggatctgaagctgctgggacagaaagtcgaagaggatcttcgctcccgaggccttgccgaagtcacctcagatgaagtgggcaaagccatcctgaaaccgttgcgtgacttggatgtggtggcgtaccttcgattcgcgagtgtgtaccagaactttgcaggtctggaggatttccaaagcgccattgatggtttgcgtgaataatatgcgaatgccatgcaccgtgatatgcgagtgattcgcaaaccatggtgcgagccaatcatgaagcccagcacttatgaaaaagacccgtcatgatgacgggtctctttcatatcaatcgaggatgagctgcgtcagctgatgacacgcatgcgaatggtgccttcgatgttgcgcagtgcttcaagcgtggcggcgctgggcttctgagccacgtcggtgaccacatagccaagttcgccttcggttgccagcgactggaaggaaacgttgatgttctcctcgccgagcacatgattgacatgagccagcacaccaggaagattgtcgtgcagatgggcgatacggcacacacccttgcactcaccgaggttgatctgcggtaggttcacggacaaggaggtagaacccttgaaccagtaatcctcaagacgctgagagacgaaatggccgatggattcctgagcttccaaggtggagccgccaatatgaggagtcagaatcatattgtcttcattggccagtgaggtctcgaacggatctccgctcttcttcggttcaacggggaacacgtcgaccgccgcgccagacagatggccggaatcgaggtgctgcttcagagctcccagatcggcgacgaaaccgcgcgaaaggttaatgaaaatcgcgtcctgcttcatgtgggcgaattggtcttcgccgaagaatccggtgttcgacttgcggccatccacgtgcagggtcacggcatcggactgttccagcagttcgttgagggtgtcgcaacggtaggcgttgcccagtgccagtttctcctcaatgtcgtagaacaccacgcgcatgccgagggcctcggccagtaccgacagctgggagccgatgttgccgtagccgatgatgccgagggtcttgcctcgcacttcatgcgagccggaagcggacttgtcccacaggccatgcttgatgtgatgcgtgtgtgcgggaatgcggcgcatcaagcagatgatgtcgcagatcaccaattccaccacggaacgggtgttggagtagggagcgttgaacacggcgatgccacgcttgccggcatgtgccagatcgacctgattggtgccgatgcagaagcagccgatggcgcttagcgtaggacgcgcatccagcacgcgggctgtaacgttggtcttggagcgtacgcccaccaagtccacgccatccagcgcatcgatgagttcgtcctcgctcagggctcctttcatggtctcgacttcgaaaccgtgatcacgcagcgatttggccgcatcggggtgaatgttttccaataacagtgctttgggcatgcttcataccttagatgttcagggacttttcgtccgcttttgtccgaactataaccagtttctgggtcggcctggtcattgccacgtacaggtccgaggcggcgaccaggcggctcggcgcgtcatcctcgatgagaccgggctcgaccaccacgacggcatcgaactccagacccttgaccgtttcagtgccgcagacgctgatttgctcatcccattcgggctgctcgatgagccttgcgtattcggccgggtcaagaatgacagccagtttgcggcgcacggcatcgcgcaccggggcgatgagattatccggacagatgacggcgatgcggccggtgccgtctgccgaaacgaattgttcggcaagctgcgccgcctgctcggccgtcgtttccagcaaggacgacatgtcgggcaccacattgcgggacaccgaatcggggatggtgcgcaccgcattgaccgtggagatgtagaggccttcctcctcggcaaatcgtgaggcaagttcggaaacttcctgcggattacggtagttgatggtcaactcgttcaaatcccagtggctttcgccgaacaggcggttcatcgatttgctccagcgtcgggtgccacccagcgccgaagtctgcgccacatcgcccacgatggtgaacgagcgggaggggcaacggcggatcaacatacgccagtccatgtcggtcaattcctgcgcttcatcgaccacgatgtgcccgtaggtccattcacggtcggccgcggcccgctgcgcggtcagctcagcgtcgtccccgttcatctggtcgagcagcatctgactggagacgatgcctccacccagaccggtcgcggccagagtgtctttggcatactgctcttcggcggcacgacgtgcgtcggcggcggactggcgggccaccgccttgggatcggggcccagcatatccattgcttcgtcgagcagcggaatatcggagcgggtcaacggggagcctttggggcgggcaagtgccgcgatgtcgttgtcggtcagccaaccagccagagacttcagacgttcgggatgggcgaacagctgatcgatgagccatggggcggtcatcggcagccagcacaggttcagggtcttgcgaacctgctcgttcatacgtagcagcgacatcgcgcggttcagctccgcctgatccggcgtgtaatcaagctgttcggcataacggttctgcatgctggtcagcatcgaacggataaaggtctcgcgggccttgttatgaggttgtcgggtgcgcttcgcgtccgcctgcgcctgctcgatatcagtggccagcattggtacctgaatgccgctaatggttactgtcggcagagcagcgggaacacgcacgcgtgcggcgatggcattggccactacggaggtcatgcgtcgatcgcccttgagcttggctgcataaggggagtcgaccgccgtggcggtgatgccgggaatcagatcgctgatggtgcgtgagaccacgccggtctcgcccaaggaaggtagcacctgatcgatgtagtgcaggaacgccgagctggggccaacaaccagcacgccggaacgttccagcgtgcgccggtgcgtgtacagcaggtaggcggcgcgatggagcgccacggccgtcttgccggtgccggggccgccctgcaccaccacggcgcgattcatgtcggagcggatgatgcggtcctgctcggcctgaatggtggccacgatatcggtcatcttgccggtgcggcgtgagctcaacgaagccagcagcgcaccctcgccggtcaatgtgccggcggaagacgcctggccgacctggtctgaatgcacgtcgagcacctcatcctcaacgcccacgacttcgcggaaactcaaggtgatatgcctgcgcatcacgatgtcgccgtgattggaaggggtcgcctcatagaaaggacgtgcggcttcggcacgccagtcggtcagaatcggctcatggtccgggctcgacaggccgatgcggccgatgtagtgacggtcgccgttcttggcatcgagacggccaaacaccagccgatcctcaacgctgcgcaattgcgtgaggcggttttcgtacattgtggcaaaggagtctcgttcgctgcgttgcgtgggggatccgtgggagccggcggcgcgtacggtgtccaggcgttgccacatttcggctcgcagatcatccaatcgtccataggcgcgatcgacggcctgctgctcttcatgcagctgggaggcgtaactcgacatgctgttctcttcgttccatttccgtggggcagaaaaacttaaggcattcaaatttaccgcacaccccctacgtcagtgatgcggacaactcggaataggtgaattcagcgtgaattcaccatgctgctcggtcggtggggtgcgcgacgtggattggatgtgcggagcgtccattcgtgcgacagtcgtggccgacacgcgcaatccatcggtaattgccctaaaagggtgagcaaatcgtgcatgagtggggagaaatggggaatcgtggggtagagtggtgagccagttggccgaagtgtatcccacgtaacgatgaaggaggtggagccatggttgccgatcagacgattcgcgacgctgatgccaacgcacaaggctccaccactatggccgatctcatggctggtctgccgccattgcttctcggcacatatacgccgaagatcgatgccaagggccgtatggcgcttccggccaaattccgctcccagctggggcagggcctggtcatggcccgaggccaggaacggtgcgtgtacctgctgccgttcgacgaatttcgacgtatcgcctcgcagattcagcgtgtgtcggtgggaaacaaagccgcccgcgaatacctgcgtgtgttcctttccggtgccgtcgaccagcagccggacaagcagggccgcgtgctggtgccgcagatgctgcgcgattacgccaatctgggttccgacgtcgtggtgatcggcgttggcacccgtgccgaactgtggaataaggacacgtgggagtcctacctcgccgagaaggaagagggatattccgatattgctgacgatgtgttgccggaggtggaattctgatggttgatgtggcgaatattcatctgccggtattgcttgacgattgcgtgaacctgatggcacctgccctggaacatgagaacgccatcgcagtggattgcaccctgggccttgccggccattccatcgccttcctcaaggccgcgcctcaggctcggctcatcggcattgaccgtgacagtgaagcgctggggctggccaccgaacgtatggaacgggaggggctcgccgatcgattcattccggtgcatgccgccttcgatcagctcgatcaggtgttggcggaccaagacatcgaacgcgtggacgccgtattcatggatctgggattatccagcctgcagatcgacgaaaccgatcgtggcttctcctattcgcatgatgcgccgctggatatgcgcatggacgtcagccagccgttgacggccgaacggattcttgccacctatgatgcggcggaactggtccgcatattcaaggaatacggtgaagagcgtttctcgcgtcagatcgcccgcgccatcgtggcgcgtcgagacaaggagccgtttaccaccaccgcacagctcaaccgtctggtcgatgaagtggtgccgcaagcccaccgcccggcgggcaatcccgccaaacgcgtcttccaggcgttgcgcattgaagtcaacggcgaattggacaagctcgcctccacattgccgcaggccgcgaaccgactgcatgtcgggggacgactggtggtggagtcctatcattcgctcgaagacaaaaccgtcaaatcgttcatggcacaagggctgcgagtggatgttccggctggcctgcctgtcataccgccggatgcccaaccgtttttcacggatctcacgcgaggtgccatcaaggccgacgaacatgaaatcgcagccaacccgagatcggcttcggtgcggttgcgggcggtggaagtcagccgtgagattccgtcacgatggaggaaacgctttacgcaaaccgcgcagggcctgaatgacgtcaagatacaaggctccgcgtctccgggcagagccaaaaacacggcacgaattcgtacaaggaggggataacagcatatggcaactgcacgtagcattcgatcgaacgcggctccagcctcgaaccgaccgcacaccaagcatcagtcctcctcccgacctgagctgcgggtggtctccaacccgcgtggaaacgagcagggcaatgtcgtcggacgggtcatcgaatggaccagaacaagaagcgcaccgctggtgcacgtggccattgcagtgatcttcctcgtcggcaccttgttcggcgcgctgatgctgcgtacccagatggtgcagaactcgtttgaggcggcacagatcgaaaccaacatcaacagacttacccaagatatcgaagacgatcaggccaaactcgatcaattggtcgcgaacctgcccgacaaggccagcgacatgggcatggtcccgcagcagggatcagtgtccatcgacttaagcggataccagtccaacaaaggcggaacccagtgaacaccattcgtcgcatcgtagagttcgccaaggtcaagaccttcgcgttcaaatgcatcgccatcggcgccgcattggcgttggtggcgtcggcatgcgtgattcagctggcctccacccagctcatcggcggccgtcaaaccgcacaagcggccacggctaaccgcaccctgaccgtgacgttgagcgccaaacgtgggcgtatcctcgacgccaacggctccgtgctcgctcaaagcgtggagcgttatactatcgtcgccaatccggaggctgcacaggagttcgagccgattacttgcaatgacaacacccgtgattactgccacgaaattgacggcaaacccgtgggcgctaccggagcggcggccgtgggccgactgctggccaaagtcctggatatgaacgccatggaactgggcgctgatctgtccggtaccgggcagtatgtgattctgaagaaagatgtgactccgcaggtcaagcgcagcatcgagtcgttgcacctgggcggtattgtctggggtgagctgagcagtgaacgactgtatgcggatggcgatctcatgggcgcgctgcttggcggcgtgaacgacaacggcgatggcgtcgccggcatcgagcaggtcgagaacaagacgcttaccggaaccgatggccatgaaacctaccagcgtggtaatggcggcgaagagattcccggcaccatgaccgaatcggtggcggccaaaaatggcgacgatgtcaccctgaccattgaccgtgatgtgcaatggtatgtcaaaaaggtcttgaaggaggccgaatccaagtatggtgcagcgtgggcgatcgccgtggtgcaggatgtccagagcggggagattcgcgcactggccgatagcgatgaagtacaggctggtaccgatgcggcgaagatgagcccgtctcgggccgtgtccgaaaccttcgagcctggttcggtgggcaaggtcatctccatgtccggctatctgcagatgggactgcataagatgagcgatcaattgtcggtcccggaccacatcacacaggagggccagacctacaaggactcattcgaccatggcactgagcgctggacgctcgccggcattctgcagaactcatcgaacgtcggcatgattatggccggggagaactatccggatgagcaacgctacgagtacctgaccaaattcggcatcggacaaccgaccggactgaacctgcccggtgaatcgagcggtctgctcaccaacccttcggcgtgggatctgcgtacgcgcaacaccatcctgtttggtcagggctacaccgtcaacgccctgcagctcaacaacgtggtggccaccatcgcgaacaagggtgtcaagcagcagcagtcgatcatcaaatcaaccaccgatgccaatggcaagaccactgagaccaagaagggcgaagccacccgcgtggtggatgaaaaggtcgcatcggacatgatgaatgcgatggaatcagtggcggaaggctacaacaagttcgtcaaggtcgatggttaccgcatggccgccaagtccggtaccgcagaggtgcagggctcggatggcacgctctcgtccattatctccgattattccgtggtgattcccgcggacaacccgcgctatgcggtcaccgtggtgatgaaggatccgaatggtgtgttcggcggtctgacggccggccctgtttccgcacagatttgtgagttccttatgcagaaatacgaggtgcctgtctccagtccacgcaaaaatgctattccagtcacgtggtaaggatcaggggagaaaggcgatagcccatgagtgcagtgagcgaatccatcgcccagcgggtgaccctgggaatgctggtcgaacggtacggttttgaagtcgatccacccttcgccaccaatgtcaccattacctcactcagcgatgccgtggacaccgtgattcccggctcgctgttcatctgcacgcatgagcaggaacccgatgtactgcatgccgcacaggccggtgcctatgcggcgttgctgccacgcgcgtccaaagggcagatcgccaatgccgatataccgttgctctacggcgatttcgacgatcgcgtactcggcgatctggccagcggtctggccggcggaccgtccaatgccatggcggtgttcgcggtgaccggtgcggatgagcaggccgtcgacgcaggcgtgtcccagctctccgaattcctgcacatgctgggcaatccggtggcggtaatcaccgcatccgggtccacgtcgatgacacgtaccatgaacctgaactatcctctgggcatcctcgatatgcagcgcgcgctgtccgtgtgcgccgaagacggtgtggcggccgtgatcatcgccatggatgaccgcacgttggccgagcatgcgttggaatcggtgaacgtggatgtactgggcacggaggatgtcaacgcaagcgcaagcttgaacgaattgaagacacgctacgcattcgttgcggaacatgacatgtccatgacctcgtcgacacccgaatcggatgaaatggctgcggattcaccggcaatgtatgaccgcgtccgactcgggcacatgtccttggccatcgccatggtgctggccgccggcgtgaggaaaaacaacatacgcagtgccctgcacgtggccaataatctcaattaagtccgtggatacgggacgaagcgtaatcgtaaaggagtttgaaacaccatggttccgatgagcgtggaggagatcgccaaggccgtcgatggtcgattgatcggagacgccggttccgagtctcgagccaccaatacggtcagcgactcgcggcaggccggccccggatcggtgtttgtggccatccgaggcgagcgtgtcgatgggcatgactttgtggcgaaaaccgctggacagggagccacggtggccatcgtcgaccatgaggtgaagtccgatggccttccgcagatcgtagtgaaagacacggtcgacgcccttggcgaactcgcccgatacaacatcgttcgccgccgcgagctggacggcgacttcgacatcatcggattgaccggttcggtgggcaagaccaccaccaaggatctgctctcctccctgcttgccaccgtaggtccgaccgtggctccggtgggatcgttcaacaatgagatcggcctgccgctcactgcgttgcgggtcgatgagcacacccggttcttcgtggctgagatgggtgccagccatatcggcgaaatcgcgcgactgacccgtatcgcaccgccgaacacggcaatcgtattgaaggtcggcgtcgctcaccttggagaattcggctcccgcgaacgcatcgcacaggcgaaaagcgaaatcgtgcagggattgcttcccggaggcaccgcggtactgaacgccgatgacgaacacgtggttcccatggccggcctggccaacggcgacgtgctgtggttcggcttgggatcgtcgcaggagcccgaggtgcgggccattgatgtcactgccgaccggtccgatcatgctgaattcacgttggtcgatgcggacggcaaccatacgccggtgcatctgggcattcctggacgtcacaatgtgatgaacgcgttggccgccgcaaccgtggcgatgcgttacggtatggcacccgaaacggtggcacggattctggcctcgcagcacaccatcagccctcatcgcatggcattgtccacggtgaatcgcgaggggacttccttcacgctgatcgatgattccttcaacgccaatcccgactccatgaaagccggcctgaacgggttgaaggcctggaactcaaatgacggcaaggagccgttccgcgtggcgctgctgggtgccatgctggaactcggcgccgatgaaacggcattgcacacctcgatcggcacgtatgcggacgaattgggcatcgacgcgatcatcgcggtcggttccgcccaagaccaacatctcgatgcactggcacaggctctggcggacggtgcccgtcagagccaatccgcgtcggtggattgcgtacacgacatcgatgcggccgaacagctggtcatcgacttggctcgcaaccatcccgacgctgtggtgctgctcaagggatcgcacgcgtcaggcctgagcgctttggctgaacgctgggcaaagaactgacctgataaccaccccaagaaaccgacaagaaagagaagctgcacgtgattgctctgatcattggaatgctggtgtcgctcatcgtcaccttagtcggcaccccgctgctgattcggctggtccacaagctgcactatggccagtacatccgccaggatgggccgcagtcgcatctggtcaagcgcggcacccccacgttgggcggcgtggtcatcaacttcgcgattctgctcggttgggcatcctccgcactgtaccgatacctgcgttcgggcgacgtgccctcctggtccgcggcgctcgtactgttcgccatgctgtcgatgggtctgctgggctttatcgacgacttcgccaaggtgcgtaagaagcagaacgaaggcctatcggtgggcggcaagttcatcggccagttcatcttcgccaccatctacgcggtacttgcgctgctgattcccaccaaatcgggattccccagtgcgcaggcaggcatcagcttcatcgaacagccgttcttcaacttcgacttcgccggccgtgccgtagccatcatcctgttcgtcatctgggtgaacttcctgatgaccgcatggaccaacgcagtgaatctgacggatggacttgacggtctggcggcaggttcgtcgatgatcgccttcactggttttggcatcatcgcattctgggaaagctaccacatcaagggcggcagccatggcggatattcctatgccgtgtccgatcctctcgatctgaccgtcatcgccgtatgcgcggccgtcgcctgcttcggcttcctgtggtacaactcgaaccccgcatcgattttcatgggtgataccggttccctggccttgggtggtctgttcgcagccctgtccatcgccacgcacaccgaattcctggcggtggttctgggcggactgtacgtcatggaagccatgagcgacgtcatccaggtcgggtacttcaagatgacccacaaacgtgtattcaaaatggcgccgattcaccatcatttcgaactggagggttggaccgaaaccaaggtggtggtgcggttctggatgatcgaactcatcttcgtgctgctcgccctgacgattttctacggcgactgggtcacccgctccggcctgctgttcagctagcggaaatctgggtggattatgctcacccacggaattcctatatcaggaggaacaatgcaagtagcggataagacagtggtgatcgccggactgggggtgtccggcacctcgttggcggaggtattgagggaacgcggcacccacgtgattggcgtcgacgagaggaagcccgaggccgatctccactcctttgatgacgtggactgggaccacgtggactacgtcatgtcgtccccggtgttcaacccccgcaccccgttcgtgctggaagcccaacgccgtggcatccccgtgatgagcgaggtggaattcgcatggcagctgcgtgtgaataacgagcgcaccggtactccggctccatggatcggcatcaccggcaccaacggcaaaacctccaccaccgagatgacctcggaaatgctcaccgcctgcggactcgacgcgccgaccgccggcaatatcgcctccggagacatgagcatgagcctgtctcgttgcgccaccaatccgcagcacgacgtactgtgcgtggaactgagctccttccaattgcacttcaccgattcgctggcacttgactgcgcggcgatcaccaatatcgccgacgatcacctcgactggcatggcgggcgcgagaattacgccgccgacaaatccaaggtgttccacaacgccaaacgcgccatcgtctacaatgcgcaggacgccaaagtcagcgaactggcggccgaggctcagactgccgaaggatgccgcaaggtgggattcacgctcgaggcccctcaagccggccagatcggcattgaagatggctggatcgtggacaggagcggcgtggccggcggcgcagtaggagagtcggtcagactggccgccatcaccgatttcacgcatctggcagagccggacggctcactgtacccgcatctggtggccgatgcattgacggcattggcgttggtgctgggacttggcgctgatcgcgataccgcgttgaaggcgcttacctcgttcaagccgggcggccatcgcatcgaaaccgtggctgaggccgcagtcgagggcggctctgttcgttttgtggacgattccaaagccaccaacggccatgcggcacgcgcctcgctgtccagcttcccggccaagtctgtgatctggattgccggaggtctggccaagggcagtcgattcgaggacctggtcaaggaccaggcacacaccatcaaagcggccgtcatcatcggcaaagaccagcagccgatgatcgaagcgtttgccagccaagctccggacatcccggtgactatcatcgatcccgaagacaacgataccgtcatggatcgtgccgtcgaagcctgcggcacgtataccgccgccggcgacatcgtgcttatggctccggcctgcgcctccatggaccagttcaagtcctacgcggatcgaggcaatcgattcgccgccgcagccaagacgtggagcgaggtgcatggcctccactgatacccataagcgtaaggcatacagagtccctgacaagcccgcactcgaaatcactgactacacgggttggcgaagcttgctcaacccgctatggtgctaccacggcttccgcatggccgtggtggggctgacatgcttcggcctgatcatggtgttctccagctccacggtcaccatggccgcactgggcaagtcgccgttccttcagcttctgaaccagggcgcgttttgcctgatcggcttggtgctgggcttcgtggcattgatgatgccggtgacgttctggaaacggaccggcgtgctctttgtggtgggtgcctgcctgttgcaggcgctgacctttactcctttgggtatcgacgtctatggcaacaaaggttggctgaacctcggcttcaccactatccagccggctgaattcatgaagttcgcgatgtgcatatggctgccctcgtcgttgcatgcctgcagcaagatgtaccacaagaagggaatcaaagcatatgccgcgccgttggtgttgtatgcgataggcgtggcgctggtgatgggcggcagggacctcggcacggccatgattctggtcttcatcggaggcgtggcctttctgatcgtcgggttccccggcaaatggatgggagtcggcgtattgggcgcggtggttatggtcggtgcattggcggtttccagcccgaaccgcttgcgtcgtattctggccacatatggcgattgctcggccgctgacgcgcagagcgtatgctaccagtccattcacgccaagtacgccatcgcctccggaggttttctgggattgggcatcggcaattcgcgggagaaatggaactacctgccggccgcccataacgatttcattttcgcgatcatcggcgaggagaccggattcgtcggttgcgccatcgtattgctgttcttcgcgattctcgcctggtgcatgatcgtcatcgcattgcaggtcaccgatcgttatgttgccatggtgctgatgtgcgtcgccatttggatcgtgggccaggccatggtcaacatcggcgtggtcgtgggtgtgttcccggtattgggcgtgcctatgccgttcgtctccgcaggtggctcatccatgattatgtgcttgacggcggccggactggttgtgggacttatgcgctctcaaccgcagataaaacagtcgcgtcagagcgcgtaagtagactcggtaatcatgaatcaaggcacaccacatatcgttcttgctggcggcggtaccgccggacatgtcaatccgctgctcgcggtcgccggggcgattcgcgacatcgaacccacggcacaggtcaccgtcatcggcactgcggtgggtttggagaaggatttggtgccggaggccggctacgagctcgacaccatcgaaaaagtgccgttcccgcgtcgccctaacctgtacatgctgcgcttcccggcaaaatggaagcgagaaaccgccaaggtgcgctccattcttgaaacgcggcatgcggatgtcgtggccggattcggcgggtatgcttccgcccccgtctacgccaccgcacacaagatgggcattccgattgccatccatgagcagaatgcgcgtgccggcatggccaataaactgggcgctcgttgggccgatttcatcggtaccgtgtacgagggcaccggtctcaaaccgcgtgccggagccgacgtcgagcgcgtcggtctgccgttgcgcccggccatcgcctccctgaccaaacgcatcggtgacgaccgtgccgccgtacgccgtgaatcggccgcgcagcttggcgtcgatccgaaccgtccgctggtgctggtcactggcggatcgctgggagcgcaaagcctgaaccgcgccatcgcctcctccgccgcagacctgttggcccacgcacaaatcatccacttgaccgggcgaggcaaaatcagcgaagtacgcgaactggtcacggcctcggccggcgcggacgtgcttaccggcatcggccccgaatcggccggacaaggtgactaccataccgccgaatatctggaacgaatcgatctggcctttgcctgtgccgacttggtgatttgccgtgccggagccggatcggtatccgagctggctgcactgggcctgccggccatttacgtgccgctgcccatcggcaacggcgagcagcgtttcaacgccgagccagtggtgaacgccggcggcggccttctggtcgcagacaaggacctgaccccgcagtgggtgcatgagcatgtgcccgatctgctcgccgatcacgaacgacttgccgaattcggccgcaaggcatgggaatacggcatcagaaacgctgccgaaatcatggcccggcacgttctgcaattagccgaaccatccaagtagtattcagatatcattccgtgcgcgatactgaccaattccgttccgcagcacgagatacggtcataatatagggtgctggaatccctaaaggagttttgaattgtctcaagatcagcccatagtgcttgaccctacgtatgcctcattcgatgctgcggcccgccctgcggatctcggcgccacccatttcatcggtatcggcggtgccggtatgagcgttctggccgaaatgctgcacgccgaaggagtcgcggtggacggctccgatcgcgcacacagcgccaaaaccgaccgacttgaaacgctgggcatcaccgttgaattcgggcagcgagccgaaaatgtcgcccaggccgagaccgtggtctactccagcgccatcaaaccggacaatccggaaatcgtcgcagcacacgcggcgggcaagcgcattgtgcatcgcagtgacatcctcgccctgctcatgaacggcaaacgagccgtcaccgtggccggagcgcacggcaaaaccaccaccagctccatgctgtcccacattctggtgaacgccggtgccgatccaagctacgccatcggcggctttatccaaggcccggacggcaccacgctggacggcggacacgcgggcaaaggcgacatcctggtggccgaagccgacgaatcggacggcagcttcgccaaataccatccgaccatcgccattatcaccaactgtgaagccgatcatctcgaccattacggcgacgaagcccactaccgtgccgcgttcgttgcccacgccggccgggccaccggtcacgtgatcatcagtatcgacgaccccgacggacttgccgtgctggaggccctgcccgccgacgtgaaatcccataccgttgcctacggcactaccgcgcgtgaatccctgcccgatttgggcggtgccgcgtatgtctggatcgcttcggaaagcgagaccgctggcagcggcgtcgaacagctcaccctgcatctgccggccgcggtgacggcgggggagccggtgtctcagagcgttgccctgaaggttcctggcgtgcacaatgcgcgcaatgcggccgccgccatcagcgctgccgtgctgctgggcgtgagccccgcagacgcggccaaggcggccggcacattcctcggtgcggcacgccgcttccaggtgcgcggcacggtcaagcaggtcactgtagtggacgattacgcccatcatcccaccgaaatcgcggccctgctggatgcggcccgacgccggtaccccgattcgaccattcgtgtgatcttccagccacacctgttctcccgcaccaagttcttcgcgcaccagttcgccaaatccttagccaaagccgatgacgtcattatcaccggcatcttcccggcccgtgaaaagcaggccgatttcccggacatcagcccctccaccatcgtggacgcggctgcgggactcaaagatgcttccgcaggcacgtggattcagccggttgaggatatgtgcctggccgccaagatgatggccatgcgcgcccaccacggcgacgtgatcttcaccgtgggcgcgggcgacatcaccgacatggatcaggtgctgctcaccgcacttgaggcccatcgggaaagctgcgagtgatgtccgggcgcacggtcagatccgggggcaatgacaacggctcacgtcgttcgtctgggagctcccgcaagccgcgcaccatcggttcacgcggaaacacgggtcgctcgtcgaagtctcgcgctccccggtccgtgtcttccggtcatgagatcgacgagccggagatcatcgacgatgtgacggtagccaagggccaggccggtgccttcgtcgatgcacggcggttgcacagcgaggattacgttgccgaaacgctgcatcagaccaccggctccctaggagtcgcatcacgcccgaaagtggtgaatttcaccgaacgcgccaaagaacgcaagcgtgcaaacgtgcgcgtcgttgcgttacgcgtgttgattgcggtcgtcagtgtggctgtagtggcggggctggcatggctgctgcttttctcgtcggtgtttcgtctggaaaccagcgagatcggcgtatccggtgccaacgaatgggtgagtgcgcagaccatccatgtcatcgccgataagcaggctggaaagtcgttgttcctggtctccgcccatgaggtcacagagcaactcaagtccattcccggcgtcagcgaggccaaggtctccaaacagttccccaagtcgatgagcgtggaagtcaaggcgcaacggcccgcggccatgctgaaaagaggcgataccctgaccgcggtggattcccaggcgcgtgtgttgaactcggtgaagaacgccaacgtggatggcatcccggtgatcgaggtcaaggatatagacgccagtctcaagaaccgttcggtgaaggagacgctgacgattctgggcgcgttgccggaatcgatgcgtaagtccattaccaaggtcaccgctgagacgcaggattcggtgactaccacgcttaacgacggtgaccgcgtaatcatttggggcgattcttcgcaactgaagctgaagttggcggaagtcgaggaaatcgacaagaacatcaccgctggcacggctggctttgccgggaaacatcagattgatgtttcctcatcccagaagcccatcatcaagtgacggcgatttcgttggcttcgttggttccggggcgatgttcgctgctggcgatttgcgcgagtagcgccatagggtgtatgctgaaaagtccggccgaaaagccggaagcttgataactcaagattgggggcgatcggtttcgacggtgacctgttcgctgcagggaagcgtgccgagaacgccgggtccgctcgtggatgaccccggcaaaagaataagtgctaaatctaaccgcactgagttcgctctcgctgcctgatttttagtcaggattaaccagtgagcagccgctccgttcactcctcctcgtctttgggaggatgctgagcgtcgtttagaagacttgctgatgcagttgagcctcagggctgcatcgggactttaactgcggatatgctcgccatcagttgtctgcgacatcgatgggggcagaaagatcgccaacttggccagcagactacgcacgtagaagactgtgggctcggtcatcggaccggggttcaattccccgcgcctccaccaatccgcttcggcggaaacaagccgcttggctttacgaaagtaaggctgagcggctttctgttattgctccgttgattccttgttttcccgctattctctcgtgtcggatatgtcagttggacgaacttgcggggaagaaacgatttagacttagttcagggctgccgattgcacgatgtgtagaggctattatgctacgccgtaatcagggaggatatatgccgctggaattggtccgacaggatattacgaagatgaaggtggacgccatagtcaatgcggcaaacacgcagctcgccatgggtgggggagtgtgcggcgcgatattccgcgctgcgggagtctcgcgcatggctgctgcctgcgatcggtttgctcccattcataccggtgaggcggttatcactccgggattcaatttgccatcacgctatgtgattcataccgcaggcccgatatggcgagacggcaagcatgatgaagaacgtctgctgcgttcgtgctatcgcaattcgatggaactcgcggcacggcaggggtgtgccagcatcgccttccccttgatttccagcggtatctatggatatccgaaagccgaggcccttcatgtggccctcgatgagattcgccgattcctgggcgacgcagccgactccggacacgatctcgacgtatacctatgcgtattcgacaaaaccgctttcgaaataagcagcagtattgacaaacgtcttcgcgcatatattgatgattattatgtagcggagcatgaagatacgctaggaagcagaacgtatgagctgcttgctctccaacggttttcggataataagccgaaggcggatagggccgtaccttccggcgtcttggacatgccggatttcctgggcgatatgcgtgaaacgcctgtctactcggcgccgtcggcagctccatcgccgaaatccgccgggcatgtggatgatgcggtgctctccaatctggatgaaccttttaacatcattctcttgaggcttatcgacgccaaaggatattccgacgtggaggtatataaacgagcgaatatcaatcgtaaactgttctctaaaattcgctgtggcgatggctatatgcccagcaagaaaacggttttggcactggccattgccttacggctgaatattgacgagacgcaagatatattggcgtgcgccgggtatgcgctgtcgcacagcgtgaaattcgatgtgatcgtggaattcttcatcgtccatgagatgtttgatgtattcactattaacgagatgttgttccgatacgatcagccgttgcttgggcaatgatgcggagcggtacgctcgtctcctgacctgctgccgatacgcggcatattgtcgcttgccaagcgacctaggactggtcccatgatgcgaagctcattgatatcgccgacaatccggctggcgaatgagcgaaaggattcatcatgggcaagaacgacaatggcaataacggccgtacggaactggtgttcgtcgtcgacagaagcggatcgatgggaggtctggaatcagacaccatcggtggcttcaacagcatgctgtccaagcagcgaacaattgccggcgagtgcagggtaacgaccctactgttcgatcatcgaatcgaaaccttgcataatcacctcgacatccgcgaagtgaacgatttgacgagccgggattactgggtgcgcggtagcactgcgttgttggatgcgattgggctggccattgaccgcatgatcgtgacgcaacgacatactgcggcagcgtaccgtgctcaacatgtgctgtttgtcatcattactgacgggtatgagaacgcgagtcgtcgatattcgttgcatcagatcaagcagatgattacctatgagcgtgaacgctatcattgggagtttgtgtttctgggcgcgaacatcgacgccgaacagacggctggtgattttggtatctcaccgcgatgcgccactgattttcatgccgatggacagggaatcaaagcctcgtttgaggccgttgcctgtgccgcgaccgccgtgcgcggaggtgctgaccttgatgacctcagcgcgccggactttcttggtggtgttcgtgatgactatcggtctcgtcgtcgaatgaagcggtaaacgatgaactgcagtgcagatattaccggtcaccagtcggtcgtgtacgttaccggctggtgactgcacacgttgtactgtagggaaccatgaaagtcgtattgcaacgagtatccgaagcgtccgtggacgtggtcaatgaattgggcacgctggatcccacgttcgagccgcagcagattggcccgggattcatgattctggtgggcgtcaccgatgaggacggcgacaagcagatcgcctggttggcccataagattctgaatctcagggtgttcgaggatgcgcagggcaagatgaaccgttcgattcaggacatcggcggcgagattctctccatctcgcagttcacgctgttcgccgacgtgcacaagggcaatcgcccgagcttcatcaaggccggcaagcccgagcatgccgatctcatgtggatcaagttcaacgaggcgttgcgctccgggggagtgccggtgaaggaaggtcgtttcggcgcgcatatgcgggtcggactggtcaatgacgggccggtgaccatcgtcatcgacaccgagcatgacatgcctgacggaacacgctgaattgcgatagtaatttgacatcatatcccgttccctccaatatgttactaaagcgctttagtcttctgcgggcgagggcgcatgtcgatatgtttcccatgaacgggcagcacaatgatgtggccgcacaagcggcagagataaggggagtgaacagcagatgttcctgaaacctgaacagcaactggagcggtgcaggcgcatagtgcgccagcgcgtggaccctcatatccacccatcgatcgcacagcttgcggtggagtcctttgacattcccggagagccgatgcccactgacgagttcttcgagaagctcaatcgaggtgacatcgacttcaagccgtttacgctcggtggtgaatggggcaccacatggggcacagtctggttccgcctgaccggtaccgtgccggccggctacccgaaaggcaagccgctggagctcatcctcgacctcggctggtacccgcactcctgcggcggccatatcgagggcctcgtctaccgtgccgacggcaccgccatcaaagccgtacacccgctcaactattgggtgccgttcatggatgctgagggcaacgcgcaagtgccggtcgccgaagacggcagcttcaccctgtacctcgaagccgccagcaacccgctgctgctcggcgtgcctccgttcattgagaccgaactgggcgaccatgccaccggcaagccggacgagccgtacgtattcaagtccgccgatctggccgaattcgatgaacgctacgagaactactccgtcgatctcgacgtggtgagctccctgatggaattcgccgacaaacagtcgccgcgctactggcaactcgccaaagcattgcagcgttcgctgaacgcctacgacgagcgcaaccccgaatccgtggaagccgcgcgcgcagcactcgccggcgtactggccaagccggccaatgcctcggccatgaacgtcagcgccatcggccacgcgcatatcgactccgcatggctgtggccggtgcgcgagacccgccgcaaggtggcccgcaccgtatccaacgcattggcgctgatggacgccgaccccgacttcaaatacgcgatgagctccgcccagcagtacgcctggctggaagaggatcatccggacatcttcaagcgcatgaagcggcgcattgaagaaggccggttcatcccggtcggcggcatgtgggtggaagccgatggcatgttgcccgccggtgagtcactgatccgccagattgcatatggccgcaaatacttcaaggaacatctcggtgtggagcccaagggcgtatggctgccggacagcttcggatacaccggcgcatggccgcagatcgcccgccgtgccgggtacgaatggttcctcacgcagaagatctcgtggaacgataccaccaagttcccgcaccactcgttcatgtgggagggcatcgacggctcgcgcatcttcacccacttcccgccggcggatacctatgctgcttggtgcaaggttcaggaactcgactacgccgagaagaactttcaggacaaggatctctccgaccgctcgcttctgctcttcggtttcggtgatggcggtggcggccccacgcgcaacatgatggagcacctgcaccgctacgagaacctcgaaggcgtctccaaggtaactattgagagcccgaacgatttcttcgacaaagcccaccgacagatcgaaaagaacgccggagaggaaatgcccgtctggaagggcgagctgtatctcgaactgcaccgtggcaccttgacctcgcaacaggacatgaaacgcggctgccgccaagaggaatcgctgttgcgcacggtcgaatacctgggcgcagccgccgtgttgtccgatccggagtacgtctacccgcgcgaggagctggaccgcatatggaagacgctgctgctgaaccagttccacgacatcctgcccggctcggccatcgcatgggtgcaccgcgaagcccgtgaggactatcgccgcgacctgaagcgtctcgctgaaatcgcccaagacatgtgcgccgtgctgcgcaaggccaacccgcaggccgacctgctcgccgaagcccgcatcagccagttccgcaatgacggtgcgtcttggcgtgccaaccgcatcaacgaaccgaccgacgcgctttccgtgctgacccagacattggacaacggccgtgtactgctggccaacggcgtactgtccgtcaccatcgaggccgacggtacgatctcgtcgctgcttgacgaggagcatggccgtgaactggttccggccggcacccgactgggccgatacgagctgttgaaggacgaacccgccgtttgggatgcctgggagatcgaacgcgaatccctgctcatggcgaatgccatgaccggatcaatcgaatcggtcgataccgaaaacggtgcggcacgagttcgcgtgcgcaccgccgacgatgacaccgtcatcaccaccaccatcacgctgcgccccggttcacacacgctcgatttccacgccgacatcgactggcatgagcgcgaacgcttcctcaaagtcgccttgccgctgggcattgtggccgatcaggcgacctacgactgccagtatggtctggtccgtcgcccaatcgtcaaaaacaccgcatccgacgaagccaagtatgagagcagcacgaaccgcttcgcccttatcggcgacgccggttacgccgcggccgtcatcaacggatcggtatacgggtccgatgcctcaccgatcgccgggaacgccgccgaaggtcgtgactcgggcactatgttccgactgtcattgctctccgcgccgaccttccccgacccgcgcaccgatatcggctcgcacgagttcgactggtccgtggtggccgacgccacggtggaccgtgcgcttggcgccgccggtgtgctcaacgcaccggtactccatgatgtgcccgatatcacgccgctcgcctcgatcgagtccgtcaatggtaccgtggtgctggactggatgaagctggccgatgatggttccggcgacctgatcgtacgtgcctatgaggcggccggcggccaggccgatgccatgctgcacgtctgcccggcgctcgcaggcgcttcggtgcatgagaccaatgtgctggaaggcgacgatttggccgccgaccttccagtcgcgctgcaagacggtaggcagaacgccgaaggtgccacgctgcactttggcccgttccagctcgccaccctgcgcgtcacgcgctgaattcccatctgatgcttctgcctcctcgaaccatgaggaggcagaaacatgtcgtattacggttttccaaattaccaccacacccatcatttccatcattcccaccagacacagcaaaggagaactctccatgtttcttctgcccaatcagcagttggagcgctgcgaccgcgtcatgcagcagcgcgtcaaaccgcatatccacaccacgctcgccgcatgcaccttgcgttcgttccacaatcccggcgaaccggtgccctccagcgaatttctagccaaagtgcgcaacggccaagtgcccttcgaacctttccgcgttcccggcgtttggggcaccacatggggcaccacatggttcgaggtgaacggccacatcgacatggcggcggtcaaaggacgaaaagtcgaactcatggtagacctcggctggctcgatcaccgcggtcccggattccaatccgagggacttgtctatcgtgccgacggcaccgccatcaaatctgcgaacccacgcaaccactggattccactcgtctacgcggacggcagcagcactgtagaactcgatgaacatggcgacttcaccgtctatatcgaagccgccgccaacccattcgtcgaaggccccaccccgttctcacccaccgaactcggcgaagaggccaccggcgcctgtgacttcccatacacactgagtcgcatggatatcaccatcttcaacgaagacgtgtttgcctatgacatggacttggaaaccgtatcttccctgattcgcgaactcaaagacgacgacccgcgctactggcagctcgccaaagcgctgcaacgctccttgaacatctacgatgaacgcgacttggaaaccgtgccggcagcccgtgcggcgctcgccggcgtgctcgccgaaccggctgcatccagcgcaatcaaccacattgccatcggccacgcgcatatcgactccgcatggctatggccggtgcgcgagacacgccgcaaagtggcccgtaccgtatccaacgtgctggctttgatggacgaagacccggacttcacgtatgcgatgagttccgcccaacagtacgcatggctggaagaagaacatcccgacctgttcgcacgaatgaagcggcgcatcgaagaaggccggttcatcccggtcggcggcatgtgggtggaatctgacaacatgattccttccggcgaatcattggtgcggcagatcacgttcggccgccgatatttcaaggagcatctcggcgtcacgccgcgtggcatctggctaccggacagtttcggctacaccggctcctggccgcagatcgcccgccgtgcaggattcgactggttcctcacgcagaagatctcgtggaacgacaccaccaagttcccgcaccactccttcatgtgggagggcatcgatggtacgcgtatcctcacgcacttcccaccctctgacacctactgctcgtcgatgagcatgcgcgagctcatgtattcgcagcgcaatttcctggacaaggatctttcccgcaacgcaatcctgctctacggtttcggcgatggcggcggcggtcccacgcgtgagatgaccgcgcgcatccgccgcgaccatgatctcgccggtgcgccgaaaatcgatttcggtactcctgatcagctgttcgaccgcgtgcgcaaggatatcgtggacgatgcccgcggcgagacaccggtcttccatggcgagctgtatttggaactgcatcgaggcacactcaccgcacagcaggatatgaagcgtggttgccgccaagaggagtcaatgctgcgtgtcgtcgaatacctgtgtgccgtggccagtatcaagaacccaggttacgtctatcctcgtgaggaactggaccgtatctggaagaccctgctgctcaaccagttccacgacattctgcccggttccgccatcgcatgggtgcaccgtcaggcacgcgaggaatacgcgcgtgacatcgcacgtctgcgtgacatcgctgcggctgccggccaggccgttaaagaggccgatccaggcatagcgacggtgaagcatgccgtgattgcgccatatgcaagcaatccgcagtattcatgggctgtgcgtgacggtggtggaacggctgtggaagagtctgtcattccggtttccgtcgagcgtgacggaaacgccatcatacttgacaacggacgtcttcgtgtgcgtattgaggcggatggcaccgtctcatccctgatcgatctcgctttgcgtcgtgaacttgtgccatccggtgtccgcatggggcgctatgagctgttgaaggatgagccattccattgggatgcatgggatatccagcgtgatgcgttcctcgccgccgatacgctcaccgacgccatggtcgagcatgtggaagatatgcccgacggctcggctgcgattcacgtcgtcacccgtgcgcgcggtgttgagatccataccgtcatcacgttgcgcccggggtccggcagtcttgattttaccgccgacgtggattggcatgccgtggagaagttcctcaaggtggatatgccggtcacggtgcaggcggtgaacgcgcagtacgaatgccagtacgggttggtcgaacgtccgatcaacaagaacacgcgcagcgatgatgccaaattcgaaagctgcacacaccgcttcgtacgtatcgccgacgccggctatgccgccgctgtggtcaacgcctccacgtacggatccgacgtcagtccgatccacgccgccgcggcgcacggcgccggccgcggcaccatggtgcgactgtcgctcctgtccgcaccgctgtaccccgatccacgcaccgaccagggagagcatttcttcgcctggtcgttggttgccggtgccggtatggaatcggtgctggccgaagcatctcgtctcaacgcgccgattatggatgagctgccggccgtgagaccgctggctacgctcaccgatgttgccggcacgccggtactggattgggtaaagctggccgacgatggttccggcgatcttatagtgcgtctatatgaggccgccgggggcgacgccaaggcaacgctgcgccttgatgatacgttcgcaggatgcacggtggaggaggtgaatctcatggaggagccggtgctggccgatgatctgccccgtgcactggtcgccggagggccggtgcccgctgagggtgcatccgtctcgttcacgccgttccagatcgtcacattgcgtattcggcgatagggacagatggtcttaaccccgatattgcaatcgcgctcgatcatgcgggaatcggattcctccgagatgctgcatggtcgcgcgcgattgcgcgttatggcggggatgggagacggggtaacgatatgcgacacggtgatgttgcgttcgtgcacacatcatgttattctctaactaaatcgctttagtaaccggcgaatgaccatggtggtcagctaagtcgctttagtctcagcgaaaagtacacgacaaaaggagagctatgctgctcaaagtcaatcgcgagattgatcgttgcaagcgcgttatgcgggagcgtgtttggccgcatatccatcaggtgcttgcacagtgcacggtcggcgcggtcaagaacccgggagaaccggagatgcccgctgcgttcatcacgcgcgcagtgtccgggcaggtcaattttcagccgctcgctgtaggcgaaccctggggaacctcatggggcacgacctggatgcgtgtcgagggacagttgcccgaaaccctgcccgaggggcgagccatcgagctggtgttcaaccttggttggctcgaatggcccgtcggcggtcacattgaggccatggcataccgtgccgatggcaccgtcatcaaggcactgcacccgcgcaatcactggatgccgcttgtctccgctgacggtgtcaaggatcgtgtggtcaatcctgacggctctttcgtggtttatgtcgaaggcgcttacaaccctaatgtcccgtcgtttaccgttaccgagctgggcaccaagcccaccggcaaagcagacgaacgctatgagttcagttccatcgatatcgccgctctggatcaggacatgttcgactactgggccgaccttgacgtcgtcaccggatctctcgaaaacatgaacgacgctgacccgcgctattggaagctcgccaaggccatgcagcgatccatcaacctgtgggacgagaaagactacaacacgctcgccttggctcgaaaggcgctcgacaaggtgatgcacaaccccgccaatgcctcggccatgaccctgaccgcaatgggtcactcgcatatcgactccgcatggctgtggccggtgcgcgaaaccgagcgcaaggtcgggcgcaccgtatccaatgcgctcgcgctgatggatatcgacccggacttcacttacgtgatgagcgccgcccagcatttcgcatggctcgaggaacgccaccccgacctgttcgaacgcgtcaaggcccgcatcgcggaaggccggttcatcccggtcggcggcatgtgggtcgaatccgacggcaccatgccgtgcggcgaatcgctgattcgtcagatcagttacggcaaacgatacttcaaggagaagctcggcgtcgtgccgaacggcatctggctgccggacagcttcggctataccggcgcatggccgcaaatcgccaagcgctccggctactcgtggttcctcacccagaagctgtgctggaacgacaccacacgcctgccgcatcactccttcatgtgggagggcgtcgacgggtcacagatcttcacccacttcccacccgccgacaaatacgattccgacatgtccgcgcacgacatggcctacgtgcagagcaactacaaggacaaggacctctccgaccgaggtatcttgttattcggctatggcgatggcggcggcgggcccatccgtgaaatgacgatgcgcgagcaccgctttgaaagttttgaaggtatgccaaaagtcgaatacggcactccggacgacttcttctccaaagctgaaaccgagatgaaggccgaggccggctcggaaatgccccgatggaaaggcgaattctatttcgagctgcatcgcaagacgttgacctctcagcaggagatgaaacgcggatgtcgcaaggaagaatcgatgttgcgcacggttgaatatctcggtgccgtggcttcgctcgaatctgccgactatgtgtacccgactgagcggattgatcgcatctggaagacattgctgctcagccagttccatgacatcctccccggctcggccattgaatgggctcatcgcgtggcccgagaagaatatgcccgcgatcttaaggcgctctcggatatcgcccgtgacgcgatcgcggcaatcgccgtcgccaacccggacgtggcccgtatcgccaaagcccggatcagccaattcgccgatgtcgatccgtggcgtccggcatcgctggtctcctgtggcgaaccagtcgaggtgaatcgtcgcgaagacggctcggctacgctggataacgggctgctgtgtgtccacgttgccgccgatggcaccgtcgactcgatgatcgacctgaagtccggacgcgaaatggtcgccaaggatcacgtaatgggccgttacgagattctcaaggacgagcctggcgtattcgatgcctgggatgtcgaacgcgatgccttcctgtgcgccaccgcattggctgacggacatatcgtctcgatcgagaccaccgcagacgggtccgccgtgatcgtcaccaagaacagttaccgcgacgacgagatttccaccacaatcacgttgcgcccgggcaaaagccagcttgatttccatgcagatgtcgaatggaatgtgcccgagaagctgctcaaggtagacatccccatggcactgagcgccagccgtgcccagtatgaatgccagtatggcctcatcgaacgcccgatcgtcaagaacaccgaaggcgaagaggcgatgttcgaaagctgttcacatcgcttcgttcgcatacacgattcctcatacggcattggcgtggccaacggctcgacctatggctccgacgtcagctcgctacgtgatcgggatgatgccctcgccggcacgatggtgcgcatgtcgttggtcgcggctccgacggcaccggatccacgcaccgacatcggccaccacgagttcgactggaccgtactgccatgcgcttcggtcgcgccactggtcgccgccgctggcgagatcaatgctccgacgattgagaacatgcccgacatcgccgcgccgatcacgctggaacccatagagggcacgccggtcatcgactggatcaagctcgccgatgatggttcgggcgacatcgtggcccgactctatgaggccgccggggcgaaagccaaggcaatgctgcatgtcggcggtacgctggacggctggacggtgcgtgagacgaacacgctcgaacaggatgaatcctacccggatgaacctgccggacttatcggcggcaagcagcaggccgaaggcgccgaactggcgctcaaccccttccaactgaccacattgcgcctaagccgcgcctgatacggattcggcccgggtcctgaacccgggcatggtccttgcctccaaccgtcaatcgacatagcagtcgaatcgatgcgttcgccaacggaattcagcctccccgtgagcgctcaacatgaaccggtcggcaatgaccgcgttcccaccatacgtttcgaagaacaaaccaaatatatcaaaggagaaaacaccatgaaaggcacattcaagaaggcggtcgcattgggctctgccattgcccttgtgggcggactcgccgcttgcggatccagctcgggcgacggcaccgccgaactgaagttccagacatggaatctgaagaacgagaagttcaccgactacttcgagggactgatcgaccagttcgagaaggagaaccccggtatcacgatcaagtgggtcgaccagccagccgacaactacgaggacaaactgtccaccgacgccgctgcgggagaactgccggacgtggtcgatatgggccctgaaccggcatatacgctggccagtgcgggcatcctgctcaatctcgccgatgccgtgccggaagccgaagatgacttccttccagccgcctgggacgccgccacactcaagggaaccgaccttgaggaaggcacctacgggttcccctggtacctcaactccggccccaccttctataacaaagcggtgcttgaggagtgcggcatcaccgtggatccgaacgacccgccgaccaagcaggacgacatcttcgcgatggccgacaccttcggctccaactgcggtggcaagtatgcactgacctccggcatcccatccatccaggacttcggcatgtatggcgtggaactgatgaacaaagaccacaccgagttcacgttcaacaacgcgaaaggcgtagaattcgtccagcactacatcgacatgtacaacgccggcgccttcaccgatgacatgctcaacagctccacctcgggtgagtccaagagcttcaacggtggaacccaggcgtttatgaacggcaacgcctacagtgtggacgatattcgcaagaacgccccgaaggtgttcgagaatctggcgatcaccgatttcatcgccaacaccaagccgaacatgttcatggagatgcttacggtcaatgccacaagcaagcaccaggaggaggctatcaagttcgcccgattcgtgaccaactcagacaaccagctggcattcgacaagaaggcgaacgtgttcccgtcttcgaagggtaccattgacgacaaattcttcaacccgtccgacgataccatggacgccgaagccatgcgtatgtccgccgatcagattcgcaacggtgagatttggggcccggcccagttcacctccgcctgctccaccatgctgcgtgaggaaatcgctcaagcgctgcaaggcaagatcacggccaaggaagcgcttgacgccaccgtcaagtactgcaacgaacggctctaattatggcaagcgaagcgaaatcaaggaagcgcgcggccaaggcctcacgccaggcggggctgggaccgaacagtagcggacgcattgttccttggctgttcgtgctgcctccgatcctatggatctgcactttctccctgttcccgttcttcaatacgatcaggctctccttcaccgattccaccctgctcaagcccggtacgttcgtcggccttgaaaactacatcgacatgttcaccgaccgccgcttccagacggcgttcttcaactcgtcgctgtatgtggtgtgcatcgtcccgttcatggtgattctgcctcttatgctggcctccctggtggccgagaagacccgcatcatgaacttcttccgcaccgccttctacacaccggtcatcatgtccagcgtcgtcgtcggcttgctgtggaccaatatcctcgataaggatggtctgctcaacggcacgttcaaggcactcaaatggatcaccacgccaattccgttcttgaccgatcgctggctgctgcttttcagtgccatggccgtcacgatctggagtggtctgggctattacatgcttatctatttggctaacattgccaatatagacagcacattatatgaggcggcttcgattgacgggtgcggtggcatccgccagttcctgcacgtcacattgcccggatgcagaatgacgatgatcctagtcatgctgctcagctcgatgtccgctttccgagtcttcggcgagatctacatgctctccggaggttccggcggcgtcggtggcgccgatctgacgatgaccatgctcatcaagcaggaaggtaccggcatcaacgcccgaaccggctactccggtgccctcggcatggtgatgttcgtggtgctcggttgcatcatcggcatcgaatggttcattcagagcaggagcgaagactgatggcaggcacacacgcagtcatggaaaacaaatataatcatgtcactccgggcaaggtcgttcgcatcatcgtgctgatcgctctgctgctcttcctggcggcacctctgctgtggcagatctcactggcgttcaaaggtcccaaggacgacatgtacgccgcgccctacctcatccccgttgacccgacaatccagaacttcgtcgatgtgttcaatcgtctgccgttgctcttctacgtgtgcaacacgttgatcgtggcggcattgaacatcggtggcaacatcatctcaggatgcttcgccggctactcgatcgccctgctcaagttcaaaggcaaggggctggtcgtaggcctgctgttcctatcgatgctggttcccggtgagacgatcctcatctcgcagttcctgattatccgcaaccttcagctgcagaacaacctgatcggcgttgccttgcctggattggtcagctccatgaacattcttctgttcatgaatgcgttcaaggccatacctcgcgagatgatcgaagccgcagaggtcgatggagccaatgtctggcaacggttctggcgcgtatgcgtacctcaggtcaagggaaccatggcgttggtcggcatcttctccttcatgggatcgtggaacgacttcctgtggccgttaatcgtgctgactgatgactcgcactacacgcttacactcggcatgagccgtctgcagggcaccttcgtgtccgatccgcgtgtggtcgcagccggcaccataatcgccctcgtcccgatcatgatcttcttccttgtcttccaacgttatatcttcaatggcctggaagctggatcggtcaaggaataatcaaaggttcaccatgaaattcggagtcaactacacgccttcgggcgaatggttctacacctggctcaatcccaaatgggaagtcatacgccgggatttggcgcagatagccgagctgggtgcggatcatgtgcgtatatttcccctgtggacgctgctgcagcctaatcgaacttggattaatcccaaggcattggcagatgttcgccgtatggtcgaactcggtggagaagccggtctcgatgtctatgtggatgtgattcaggggcacttgtcgagtttcgatttcgtgccttcctggctggtctcctggcatgaaggcagcatgttcaccgatcagtcggcgatagaagcccagagtgcgttgactgaggcgatttacggtacgttgtctgacatgaaggcctttgcgggccttacgttgggcaacgagtgcaaccagttcactgatgccacacatcccagacgcatgccggccaatgccgagcagattggtgaatggctggatacgcttatcggattggttgccaagcgatgccggcgcgatggccgtctaatcgcgcatagcgaaaacgacgcaatctggtacgccgatggccatgccttcctgcctagatatgcttcatgcaagggcgacgtgaccaccgtgcactcctgggtattcaacggtaccggacagcattacggtccgatgtcatgcgaaagcctgggacacgcggcctggctcgttgaactatccaaggcattcgctgctgatccgcatcgcccggtgtgggtacaggaaatcggagcacctggcaatgtgatcgattccgccgatgctccggagttctgccggcgctcgattgatgcgattgctgactgtcctgatgtgttcggcgtcacgtggtggtgctctcaccgcatcccctcggcattctcggatttcccgttcttcgagcaccagcttggcctgttcgatgtggacgggactctcaccgacgttggcaaggcgttccgagacgcaatcgccacccaccgggatacggttgcaccgccacgcacgacagcgattgtcatccctgtggatgaacagggcgacccgctcatgcgagctgctcaagctccgggcggctcgctcttcgaggcatgggcgaacttgaatcgtcagggtgaaaggccatgcgttatcacctcgcttgatgctggcaatccggccaagctcgccaatcggggcatcgtccgccttgagcgcgtcgaactcgtggcgggccatgcctacaatgcggtgtccgatccagctttcgagcataaaggcgaatgatgacgcattgacgaacggtcatacgatgtagtacaaaccgttcgtcattgtccggacatccagacatcgaaataaccgaataattgttcgaagttcctcttcgaaggggccggctctcctcggcttgaacttggcggccggcctttctataacagacgatgctattccttgcaagatgttggcactcattacatttgcgcatccggcgcaccggtacgtaccggtatcggtgcgccattgttcacacacatcgcgcatccaatgggggagacgacgtatggtagatgcgacgctgttcaccggtcagccgccgaatagtgatccggcggcccgccctgaagccatcattcggggggatcggtggcgtatttcgattctgacggactctttggtgcgtttcgaatggtcggatgccggcgtcttcgtcgacgaacgaacgcaaagcgtcgtcaaccgtgatttcggagagcctgcggcatacactgttcgccgtgatgccgatggctggctcgatattgagaccgaacggttacgtatcgtttatgatggaggcccgttcactgccgagggcttggcggtaagtgtcaaggattcgctgtcacaacacaacacttggcgttacggcgacgctcagaatgccaatctgggcggcactgtgcgaaccctcgaccagattgacggtccgaccgaactcgaacccggcctgctgtcgggtgacggttggatgattcttgacgattcagacgacaatctggtagtcgaagcatctgaagtcaatggcagccccaatccatttggctcatgggtggtccgtaagccggcctcctccaccgatctgtattttttcggatacgcgcggcgtatccacgatgcactgcatgactattaccagctcaccggaccggtccctctattgcctcgctgggcgttgggcaactggtggagtcgctatcatcgttacagcgaaaccgaatatcgtacgctgatagaacgttttgaaacagagggcatccctttcaccgtcgcggtgcttgacatggactggcatgtgaccgatcccgatccgtgctatggctcagggtggaccggattcacctggaaccgcaccctgttccccgacccggaacgttttctgggatggctgcatgagcggggtctcaaaaccacgcttaacctgcatccgcgagacggcatacgtgcgttcgaggactgctacgatcgcatggctcgggcagtgggcgttgattccaagtccggcagctcgattgagttcgatgcgtcctcgccggtgttcatgtccgcttacttcgatcaaatcatccacccgatggaatctcagggcgttgatttctggtggatcgactggcaacaaggcagcgtgactcgccagccgggacttgacccgttgtggatgctcaaccacctgcacttcctggactcggcctcgcgaggtcggcggcctatcacgttctcgcgctatgccggttacggctcccatcgttacccggtcggattctccggagatacggtcgtatcgtgggaatcattgaaattccagccgtactttacgacgatggcttcgaacatcggctacggatggtggagccatgacataggcgggcatatgttcggctaccgggacgaggagctggagacccgatggtaccagctcggcacgttcagcccgatcaaccgtctgcactcgaccgactccccattcaacggcaaggagccatggaacttccactccccggctcgcgaggcgatgatagccgcacttcgtttgcgccatagactcatcccgtacctgcatacgatgaaccgtcgtgcggcttatgacgggctgccgttggttgagccaatgtactggaaccacgggggcggcaccgtgcccacggaatttgagttcggcaccgagctgatcgtttcgccagtgctcgaaccggccgatcaggccgcaggccgtgccaaagcagaggtctggctgccagtcggccaatggttcgacttcttcgacggaagacgttacgtagccgacaatccggagggccgcacgctcggtgtatggcgtactctcgaccgtatcccggtattcgccaaagccggaggcatcataccgatgcaacgtctcgacggcgctccactcaacgatgtttccaacccgtcggcattcgatgtactggtatttccgggcgcggatggcacgttcacgctatgggaggatgacggcgagtcggtcggcggagaatgggcttcgacccgtcttacgtttgattgggtgcgcggcatgttcaccgtacatgcgcttgacggcgacagttcgctggtgccgagctcacgcgcatggcgtctcatattgcgaggtgtggaacagccggacggcgatttgccggcatcggtctctatacgccatggcggtcggccaatcaacggcacagtcgactatgacccggatacgttaagcctaagcgtcgaggtcggcgctctgaatgtggacggcgacctgacgattcacgtggctggaggactttcgattgcgccgtcgccggtcgagcgagacgccttcgacatactcgccgacgccaagatgcactatttcaccaaggaacgggcctggcaatccgttcagcacgagggcatacgcgcgctcgccaccctgcacacgctggaaatgccgccgggctactacggggagccgcggtggttttcctcgcatatgccgcaaggcgtcatcgaggcgttgtcagaggtgttgctgcgcgactgaacaggcgcgcgggccccaagcccatacagatatgtcccgacgcaagaatgcggcggggagaacaggaaaggaaaccgatgaacaagacaatgacgtggcgccgggtgctggcggcctctcttgccgcgatgcttgcgatgtcgctggcggcatgctcgggaggcacctccgcgaccaagtacacgatcacaccggagaacgagaatgaggagcttgtgctgggcaaccggcccgaggcgtcctactggttcccggaagatctgctgaagtggaatgcggacaaagacccggatctagcatacaatgtgagcactgtgccgttggccaagcgtgtggccaaggccgacctcaaaccagtcaatgacacgcagaacaccgataccaaggtgatggccatatcgatcatgaactcctcgacaagcggcaacgccccgcatggcctgaacaccgcgaacgcgaacacgttctcgtattggcagtacgttgacgagcttgtgtactggggcggctcttcgggcgaaggcatcatcgtgccgccgagccccgatgtgactgacatgggccataccaacggcgtgccggtgctgggcacagtcttcttccctcagaacgtatcaggaggcaaggtcgaatggctggaccagacgcttgcccaaaagtccgatggctcgttccccgtggcggacaagctcattgaggtcgccaccacgtacggtttcgatggctggttcatcaaccaggagacagagggtgagaatgaaacctcgctgggagccgactacgcgacgaagatgcaggcgttcatcgcctacctcaagaagcaggcccccgacctgcgtgtcgtgtattacgactcgatgaccaaggacggctcaatcgattggcagaatgcccttaccgatgaaaactcgatgtacatgacggatggcgatcatccgatagccgatgagatgtttctgaacttctggtggaccgaggacaaactggccggcgacgacctgcttgccgcctccgcaaccaaagccaaagaactcggcatcgacccgtattctctgtacgccggtatcgatgtgcaggccgacggctatgacaccccggtcaaatggaacctgttcgccggcaaggatggcaagacgcatacctctctcggcctgtactgcccgagctgggcatattggtccgccggcaatccgaccacattccgcaaaaacgagagtcgtctatgggttaacgatgagggtaatccatcggtgagcactccgtatgaggacgatgagaagtggaccggcgtatccaattacgtggccgagcagtcggctgtcacctcgctgccgtttgtgaccaacttcaataacggttcgggctacagcttcttccgtgaaggcaagcagatttccaagatggattggaacaaccgttccgtcagcgatatccagccgacctatcgttggatagtcgccgatgagggcggcaataagaccaaggccgattacagcgatgccgacgcctggtacggcggatcgtcactgaagttctcgggcaaggtcgccaaggatggcaagaccatggtcaagctgtactcggcgagcgtcaagacaggggcaaagccgacgctgtcgattgccgccaaggccaatgtcgataccgatcttaaggccgtgctgaccttcgcggatggctcggtcgaaaccgtcaatggcaagaagaaggtcggcaacgattggggtgtcatcgactacgacatcgccaagttgtcgaacaagacgctcaccggcatcgacttcacctaccagtcttccgaggataagaccggctacgagctgttgctgggcaacatcacgctcaaggatggctccgaggagaccgagctcggcaaggtcaccgaagtcaaggtcgatgacagcgagttcgacgatgacgccctgtatgccggtgcccgcatttcatggaagaccgatggcaaggctccggcctacgagatctaccagatcaacgaggacaagagccgttcgttccttggcgtctcaaacgtcgagaacttctatgcaaacgcactgacacgtgtaggcgagaccaataacaccacgttcgagattgtgccggtagaccgttatggtacgcaaggcacgagcgccaaggccgatatggattggcccgacaacagcaagccgaaagccggtgccacggcttcgcgcacactgctgaatgtgggcgacgaagtgacgttcacctccgcaagctcgaagaacactgccgaggtcgcctggtctctgcccggatcaagcaaggagcatgccactggcaagtccgtcaccgtcacctacgacaaggagggcgtgtatgacgttgagatcaccgcgaagaacaagagcggcgaggccactgcgacgctgaaggggcagattgtcgtctccgcggatgtcatggaccttgtgttgctctctcaaggcgctcaggtcagcgccgacgggttcacgaacggcaacgagaagcctgagttcgcggttgatggcgacgtgaagaccaagtggtgtgtcaccggcccggctccgcatgagcttgttgtcgatctcggcgcacccaagaccgtctctcaagtcgatattttccatgctcaagccggtggagaggatgccagcatgaacacgcaggaatatgcgatcgaggtcagtgaggacggaaccgaatacacgcaggtcgcgttggtcaagggcaacactgaaggtgccacgtccaacgcctttgccccggtcaatgcccgttacgtcaagttggtggttaacaagccgacgcagggcagcgacactgcggctcgtatctatgagatgcaggtacgtggcgcagacggcgcgatcctctaggagccgctgtttgttctgacgaatacatcgcttccgggtgagccggtatatcggtgttacccggaggcggcatctcggcccgtatcgaatgcatgccgtgcgaatttccactttgtggtgaatgagggcaaagaagttctgtatcgatgtgggccatgccatatactaaactgattcatgcagtatgcatgcaatggtgagtgctatcgaagtccgttttttgaggttccccattgcagggaaccaacatatcgcgaaacgggagagtacgccgatgacgagcacggagccgacgatgaacacaaaccccctccacttggagtcaggagccgcgcatccggtcgccaaaccgcatcgggtgggcctcaaggacatcgccgacgagctgggaatctcgcagaccgcggtatcgttcgcgatcaacgatcgtcccggcgtctccgaagagaccaaaaggcgcgtcaaagaggctgcgtcgaagcttggctggagcccggtgtatgcggcgcaggcgctcggctcatcgaagaccatgacggttggcttcgccccggcacgctcctcaaacggtcttcgggacgaaggcttcatgctgcatttcatgaccggtttgcatgaatccctgagtctcaaaggttacggtctgttgtatcggccctgctcatcggtcagggaagagttgtcggtctacgaggattgggctcgacgtaagcgtgttgacggtgttatcctcgttgacctgcgtgctgacgacccgcgccccgcgctgcttgctcggctcggtgtgccggctgtgcttgcgggaggtccggatcctgagaacatcgtgccctcgctgtcgattgacgattcaggcgccatggaaacgattctccgacatttggtatcatgcggacaccggcgtatcgcatacctatcgggggaccgcacccttgactattcgcgtgatcgcgaacgaatgttccgtgaattcgcaaagcgccgcgatcttgagtcgatccgtgtcgaatacaccaacttcagcgtagacatcgcctcggcaatgacgcttgcaatgttgtgtggaagcaatccgcccaccgctttcatctacgagaatgagacattggccgcagccagtctgcatgccattaccgagtggctgctcaatacgccgtccaggaatccggacgcaccgcgatatccgcataatcttccggctatcgttagcttcgaggacagtttcttgtgcgtatcgatctatccatcgctcacgtcggtacaccgagacccgagcgtgtatggaatgaaggtcgccaaactgctgatcaaggtcatcaacggtgagacggtcagtggcaaccgccgcatcctgactcccaagctcgtgatcagggacagtaccagacttgcctgtgtctgattcgtctacggctacatcctgttggtggagcggatagaaacggcatgagacgggaataggcaaggtccgacgggagttttccgtcggaccttgcctattcgttatcacgaattgtatcgccttacgccgcgttcttcacggccgtcgcaatggacacagccgggtcgaggaacggaatcagcgtggactggaaggcatggtacaggtcggacttgcccggccagaccgtgccgatcacatgattgtcgccgtcaagctggtggaaccatgatccgccttcgtggtcgatgacgtgctcgtcgacgtagcgggcgaacgtggcgtaccagttggcgtatcgtgcctcgccggtggcagcgtgcagcgtggcggcggtgttcaacgattcggcggccgtccaatgcatgcggtcggtgaccaccggtgtgccgttccagtcggtcgtatagacgagcccctccgcgccgtccgcgttccacgcatcgtccaccgcccgcgcaaacaggtgctcggcggcgtcgatgtagggccgcgcgccgtctcggttggcgaaggagctcagcgcccactgcacgatgaggcgcgcccattcgatgccatggcccggcgtggcgccatacggtttgaactggtcgtccttcttgtcggcgttgcattcgaggtccaacgaccagtcggatttgaaatgctcggggatgcgccaccggttgtgtgccgcccattcgatgacgtggtcgatgatgcggccggcgcggacgcgataggtgttgttcccggtggcgtcggccacggccaggaacgcctcggtggtatgcatgttggcgttcaggccccgataggggtcgagtgcggtgaatgccgtgtcccaggtatcgacggccaggccgatctcgtcgtcccagaaatgctcgtcatatgtggcgagcgcctcgtcgagcagttccttggcacccggacgcccggccagcagggcggaggacgcggcgagaatcacgaaggcatgcgcatagcagaccttgcccggcgcatgggaaccgtcggcaaacacctgcggataccagccgccgtgctcgtcatcgtgcagaatgccggtcaatcccctgagcgccgcgtcgaccagctcgcccgcacccgggtatccgagcatggcgccaatcgaatacacatgggccatacggctggtgatccacgtttcgacgccgtgtgaggggtcgagggtgccgtcggcgttcagccagccggaaccgccatccggcgctgggaagcctttgccgaacttcagcagctcgtaggtttcggaagccatgaaaatgcggttggcttcggtgccgagcgtataacgtgggttattggtcataatgattgttcctttccttaatgagaacatgcggtgggtgcgcaatgagcatgcggcgggcacgtcttagtgcttcacacgaatgtcgaaatagtccatgaccagttcgcagaacatcatattcgaccagctgaaccattcgcgcgtgtacttggtcggatcatccacgtcgatgccttcgtgcatgagatgcgtaccggcgtcggtggccacgagacggtcgagaatatgcgccttgaaatccttgctgtcgctggtcatcgcctcgatggacagcgcgatgggccacacatatcgtggcggcgtatgcggcgagccgatgcccttgaggtactcgccctcgtaatagtacgggttttcgtcgctgagcagcgtgcgtcgggttgccagataggtcggatcgtccggtgcgcagtaccccaagtaaggggccgccatcaaggagggcacattgctgtcgtccatgatattgacgtgacccagaccgtcggtctcgaacgcgtagattgtctctccgttgcggttcgtcgtcttggcgtgggcttcgatgccttcggtgatggtgcggcgcagcttgccggcgcgtgcggcgatatcggcgtcatgcagaatctccccgccgaagatgcgttccagatagcccatcaccactgcggcgaacatgttcgagggcaccagatagtggtaggtgcaggcgtcgtcgctgggacggaagccggaccaggtcatgccggtgtacgccaccggcaaccccttgccgtcattgctcagcgattcggtggggatgtccgtgtcgcggatgaagaaatacggggagttctcgtgatgctgttcggtctcgaagacgtcaagaatcttcttgacgccggcaatgaattcgtcattgaaatgatcggtgttgccggtgttcgcatacagcatccaagccagctgaatggggtagcacagcgagtccacctcgtacttgcgctcccaaagccagggactggagaagtcggactgatcatccttgtcccaggaagcgccgttcggctcctcgttgaaggcgttcgcatacgggtcgatggtgatgtagcggaactgctgccgcaccagaccggcgatcaggctcgcaatgtcgtcgtcttcggtggcaagggtcagatacgggcgcaattgtgcggtcgaatcacgcagccacatggctgggatatcgccggtgagcaggaatgtggtgccgtcgtcatgccgtttgaccgtggtggtcagggtgttggcaaagcaggcgttgaagttctcggcccaggcggcgtgttcggtgccgcacaggtccgtgatgtgctgcatgaaatccgagaccgacttcggtatcgcggtggtcgtcataattcaacttctttgtttgagggatatacatatcaagggaacagcattattctaaaccgctttagttgaagacacgcgaaaggatgtgaagagcatgagtgtgagcgcaccatatgaaaaaccggtgagatttcctgttcggagaatctcaccggttgcgatcagtcgattcgtgaagtcgcacgaatggcggataaggggatgggtggattacttgccgatttcagccaggtagtcgggcatctcggccgggtactgcggccaggcaccggcctgggtgcagacgtaggcggcggtgttgacggccttgcggtgggcttcggcgagcgtgtcgcccagcaggatgcgggcggtgaaggtgccggagaaggagtcacctgcacccacggtgtcgttcacctcgacgtgcggagtgtccagcgtggagacctcgcccttgcgggagatgatggtggagtaggcggagccggcggtcagaatcacgtagtcaaggccgaattcctcgatgaaccagcgggaggcatcttcgccggaggtgccgcggatgtcgaacatgtcgcgcagcagcaggagttcctcgtcgttgatcttgaagacggtggccgccttgaggagttcctcgataagttccttggagtagtggtcgccgcgcaggttgatgtcgaagaacttcatcgcgcccggcttggtgtgcttgagcagctccgtgatggtggcgtgcgattcgggggagcgcagggccagggtgccgaagcagacggcgtcggccttggagaccacgtcgatgagctggcgggtgtacaggatgtggtcccaagccacgcccttgacgatggtgtactccgggatgccgttcttcagtgcgacctcgacggtggaggtcggccaggcattgcgctggatgacggtgttgataccggcctcgttggccttggcaatcagttcgtcgccgagttcatcctcgccgaccgcgctgatggcccagccttcggtgccgttcttcatcgcgtggtaggcgaagttgacgggggcgccgccggctcgcttgccgctcggcagcatgtcccacagcagttcaccgaggctcagaacgatcggggtagtcatggttggtttcctttcctttgtttcctttatcgggtgtttcgtatggaaaatcttgtgatgtcggcgcttggtttaggagacgtcgaagaacaccgaggggtgttcgaggaattgggtcactgccactgctgcggcaccggagaccgtcgcgtcggcggacaaggtggataggctgatggaagtggaggcattgatttcggggatggcccgttcggccaccgtggcgcgcacctcatcgagcagtatcgggccggcttcggacacgatgtcgccgatgatgatgtgctcgggattgtatccattgaagatggtgacgcatccgtagccgacgtatcgggcgacttcgcggacaatggcgattgccgcttcgtcgccgtcgccggctttggcgaacagggcgcgggcggcttcggtgtgggtcatatcggccgcgccgggaaccacggtgccatcggcgatgagcgtatcgtgaatggcgggggtggagcagtagcgttcaaggcagccgacgttgccgcaatcgcaggggcggccgttgacgtcaatggagatgtgtccgatttcggtggcggcaccgaggaagccgttgatgaggcgaccgttgtcgatgacgccgaggcccacgccttcgccgaccagataataggcgaggttgtcgtcggcgtgcaccgacgggtcgaagagataatgtgcgagggcgccggcgcgggcgtcctgttcgatgaacactggcacgcggaaagcggtggcgaattcgtcgatgaagttgattttgcgccagccctgcatgttggacaccacggcggtgcggcctacgttacgcagataggggccgggcactgccatgccgatggccacgatggatgggtcgttgtcgagcagttgttcgacgcgctggtggatggtgacgatggagtcgttgatggtgttgtcgcacaccgtgggcaggttttcaaagctcagggtgttgccgcacaggtcgaacacgccgatctgcaccagcgagcgggcgaatttgatgccgatgatgcggaagtgcgtggtgttgagcttgagtccgatggaacggcggttcttggagccttccagatcgccggtctcttcaatcatgccggcctcgataaggcgtgcggtgattttggtgatggccgcgggggtgagttccagtgccttggcgatttgcgcgcgggaactgatgccgttgtgatacaggtgcttgacgatgcgggagcggttggattcggagacactggcctgggaagtggcgtgggtggtgtttgttgccatcggtcttaagtcctccttgtctgcaccgctgcgagttgttccgctcgtctttgaatctgaacttgattaagatattaacgctgttaattgattgacgcaatcaatatgtcattcggcgtgtcgtgcatgtgagtgtcgtcttgggtgaatttgttaagatagttgtcaatagtcagatgtacactgatatcaagcgaaacgttcgatgaagaacaggggaggactgatgtccgaaaacactatgaacaatctcaaaatcggtgttgacgtgggcggaacaaaaatcgaagctgtgctggttgacgcaatgggcacggtattgggttccgcccgtattcccgccagacatggcaacgatgccgtgatcgaagacatcgtcgctgtagcgcatcaggcggcgggtgagcgttttgacgaggtgagggccatcggtgtcggtaccccgggcacggtggattcggccagcgggcatgtgggcaatatcgtgaatctcgacgtggtctcgctggatatggggccgttgatctcgcagcgttcgggcgtgccggcccatgtggaaaacgacgtcaacgccgccgccgtcggcgcggccaccgtgttgggcggtgcagatggcatggccggtaccattgcgttcctgaacttcggcaccggactggctgcgggcattgtcgaaaacggcgtgctgatgcatggctatagcggtgcggccggcgaaatcggccatatcccagtcgaacctcatcgcctcaagtgcccttgcgggcaatacggatgcttggaaaccgtctgctcgggcgcatccgtgggacgtctgtggcccaacgccgacccgccgatgcccgacctgattcgtcgcgcgaaaaagcgggaggccgaggccgtcgatgtgctggacatggtagtgcgcgccatcggcgacactatccagattttggcccaatccgttgacccgcgactgattgtcttgggtggcggcatggccaaaaccggtgaaccgttggtcgaggtgatcacggctgagctgcgccggcgcgaatcgcaatgccgattccttgaaacgctggacctgccggcccggctgcgtctggcacccgtcgatcaaccggtcggagccatcggtgccgccatggcggcatagcactggcatagtgccggggcatggaagatgaggcgtcggatttgtctccgagaccgcatcttccatgcggtcctatatcgctttatgtcgtgctgtgccgcgctgtgccgcgcttggccttgcgcgtttcgttgccggggtggccagctttatttggccaagtgttggaagaccacggcgatggcctcgccctgtacggtgatgtcgggtccgcattcgcagcgccggatcaccgtgtgtttatggaaggacgaggacgtggcggcatccagatactgctgtgccgcgtcaatgaacgtctcgttgatgatgttcggctgcccatagacgcatacgtctgccatatccaaaaggcccacaggcatggacagggcctggccgagatagcggcccgcccgagcgaggatattctgatgctgctccacgtctgccgcgctgagctgctttttcaatgcggttccggaaatcatcgtctccaggcagccgcgcttgccgcaagggcatagcggcccatcaaggtcgatggaaatatggccgatttcgccggccgcatgcagttcgccgattaccggcgtgtccgagagcagaatcgccgagccgatgcctctttcgatgcgcacgaagagcatattcggcccgccctggccgaagaaacgttcggtgagcatggctgcggtgacgtcgttgctgacgttcacctcaagtccaaaatgctcggcaatcggcgtggacaggtcgagattgttccatccgcgcatcgtggaggagcggaccacgccgttatccaccacgccgggggaggagactccgatgccgatgacctcgccgtcggacatgcccagcatcttctcgataagttcgatgatcacatccacggaaacgaatgagccggtgttcagggtgacttcggcgtggcgtagcggctggccgagcagattggtgactgcaccgtgcagcaggtgctcctgcgtcaggtcgatgctgatgatgcgcagtcgatcgatatcgatgctcagcagtgtgcctcgtttgcctttgccgccgctgggtgcctgaccggtctcgcgcagcaatccttcctccagcatctgaccgaccacatcggaaacggccacgcggctcaatccggtgcgtcggccgagctcggcgcgcgaatactggttggtggggaacagcaacctgaagatgagttggcggttcttgcggcgcacatcggcgggggaggccttggccgcatggtcgtcggtcgttgtgttgagaccgagatatgacatgtttcctcctgcctgatggtgagcgagtgaacggcgattgttgttccgtacacagcttagacggtgaagcacaatttcgtcgttgaaactgttatgaaacttcactaataaattccagtgtacctgtgtgaagcgtcaggaaacaccgtgagtgttcataaggtccaaaattgttactattattaacaaatagcgaatcaccaatcgtcactatggcgaacggtggttggaacgccgcgcggcacccggacgtgacaaggatgttgccattatccgcaagacgggcggcggtacggcgactcgcatcgggcgggccgcacggaactggaggaaaccgatgccggaaatcatcattgtcaagaacgaagccgaggccggcgagatctacggccgttgcgtggcggacctgatcaaagcaaagccggacgctgtgctgggcctggccactggttccagcccgctggccgcctatcaggcgctcgccaagatcgtcaaggacgaggccattgacgtttcgggcgtgcgtggtttcgcgcttgatgaatacatcggactgccgctgacccatcccgagtcctatcatgcgaccatccatcgcactgtggtcgaaccgctcggcctggacccggccaaggtccatgtgcccggcgacgtacttaacggcactccgcttgaagacggcgacaagatcgcgctggccggcccggcctatgatcgtgccatcgaagccgctggcggcatcgacgtgcagatcctcggcatcggcactgacggccacgtcggcttcaacgagcccggttcctcgctggcctccggcactcgcgtcaagaccttggccgaacagacccgcatcgacaacgcgcgcttcttcgacaacgacatcaaccaagtgcccacccactgcatcacgcagggtattggcacgatcatgaaggcccgtcacctcgtgctgctggcgttcggtgccggcaaggccgaagccatcgaggagacggtggaaggcggcgtgtcagcgttctgcccggcttccgcgctgcagatgcacccgcacgccacgattatcgtggatgaggaggccgcgtcccgcctgcgccacaaggactactaccgttacgcctacacccacaagccggcctggcagggcatctgagttatcgtgtgctggctcccgccagcgggagcgcatgagcggtaaggagaacaacatgtctgataggaacgagatagtctcgcgcgtgaccgcggcactggagggcaagccggctccggtggcgattcgtaacgcgcgcaaggtggatgcgcgcggcgaacggcgcggatattgggtcgtctccgatgccgccggcgtcatcgtggcggccggcacgggggagggggccttcgagcactgctgccgcacggtggggctcgacccggccgatcgcaacgcggtcatcgacgccgaaggccgtattctgacccccggctacgtggacatccacgcgcacggcgcatgggagaagagcttcgatgacgggccggacggcatcgacgtggcgcgggccggccacgccgtgcatggcaccacgcgccaggtgctctcgctgatcaccaaccccgtggacgtgatctgccgcaacatccgcaccgtccgcgccacaatggagtccggccgccccgacatcctaggctgccatctggaaggcccgttcctggccctggcccgcaagggcgcacatgacccggaatgtctcaaggatccggtgcctgacatcgtcgataagatgcttgaggcctccggtgccgaccccgcctccggcaagcttggctgcatccgccagatcaccatcgcccccgaactgccccacggcatctccgccatccgccagttcgccgctgccggcgtggtgccggccgtgggccactgcgacgccgactacgagaccgccaaagccggcttcgacgcgggcgcgggcatcatgacccacatgttcaacgcgatgaacggcctgcatcaccgcgaacccggtccgattccggccgcggtggaggacccgcgcgtcaccatcgagctcatcaacgacggattccacgtgcaggatccgatggtgagcctctccttccggttcgcgcctcaccgcacggccttcgtgaccgacgcgatggccgccaccgactgcccggacggcgcctacaagttgggcgcgctggacgtgaacgtggtcggcgggcatgcgcgcctggtctccaacggcgccatcgccggctccactctgctgctggaggtcgccgtgcgccgtgcggtgtgcgaactgggcttcagcccggtgggcgcggtcgaggcggcaactctgacgccggccaaggcgttcggcttcgaccggccgaacccggtcaccggggcgccgatcggcctcatcgcccccggcttcgccgccgatttcaaccttgcggacccggccgactggacggtcgaacaggtgtggtgcgcgggccgcaagctcaagtagcagtaggccgaccggttgacgaatggaaggcattcgtctacgaacatggtcacatggtgagatgatagtatatttgtctcaccatgtgaccgttattcacgtcgtaatacaagaatccgtaatactgctcgataccgcataaaaccggccttggtcgccacaagcgaaacataagtcgatgactatggaaacgcagaggtaacacatccgcaccatagtcaggcggtaatccacgcccgcagtgatgacgtggaaacaagttatgagagaggattcctgttgaattccaagaagattctggccgccgccgtctccgtggccgccatcgcatccctgaccgcctgcggcggtgtgaaggatgacaccaccgcaggtgccgattccggcaacgccatcaccatcggcaccaccgataagatcaccagcctggaccccgccggctcctacgacaacggttcatacgccgtgcagatccaggtgttcccgttcctgtacgcccaggattacaacacctccgaactgagcccggacatcgccgccgatgacggtacctggaacgatgacggcaccgaattcaccgtcaagctcaaggacggcctgaagtttgccaacggcaacgacctgaccgcttccgacgtcaagttctcctacgatcgcatcaagaagatcaacgacccgaacggcccgagctccctgctcgccaacgtcgaatccgtgaccgccaaggacgacaccaccgtggtgttcaaggattccgtgcccttcgacgtgaccctgaagcaggtcatgtccagccccgccggcccgatcgtcgatgaggataccttcgacgccgacaagctcgccgacgccgacaccatcgtctccaagaaggccttcgccggcccgtacacgctgacagccttcaagatcaacgagtccgccgcctacgccaagaacgactcctacaagggtctgaccccggccaagaactccgtcgtgcaggtcaagtacttcgccgacgcctccaacctgaagatggccgtccagcagggccagatcgacgtggccaaccgctccctgagcccgaccgacatcgaggacctctccaaggactccaaggtcaaggtcgtcaagggcccgggcggtgaggagcgcttcatcgccttcaacttcaagattcagccctacggcgaatcccagcccgatgccgacgccaacaaggccaaggccgtgcgccaggccgtcgccaacctcatcgaccgcgaagagctctccaccaaggtctacaagggcacctacaccccgatgtactccttcatcccggacggcctggccggtcacgatgacacgctgaagtccgcctacggcgacggcaacggcaagccgagcaccgagaaggccaagaaggtcctcgccgacgccggcgtcaccaccccggtcgacctcaagctccagtacaacaacgaccactacggctccgtctccgccgacgagtacgctgccctgaagtcccagcttgaggcaggcggcctgttcaaggtcgacatgcagtccaccgaatggacccagtacaacaaggatcgtgtggttaccgacgattccgacggtgtgtacccggtctaccagcttggatggttcccggactactccgacccggacaactacctgtccccgttcttccgcgatggtaacttcgtgaacaacggctactccaacaaggaagtcaacgacctgatcgtcaagcaggccggcgagaaggacgagtccgctcgtggagacatcctcaagcagattcagaagctcgagaccgaagacctctccaccatcccgctgctgcagggtgcccaggtcgccgtcaccggcacctccgtgaagggtgtcaccctcgacgcttccttccgcttccgctatgcctccgtcaccaagggctgatccagcatgagctcccctctttgaggggggggggagctgtctgccgacggcagactgaggggagcccaactcgtatgactcccctcagtcggcttcgccgccagctcccctcggagaggggagcctttattgctttatataccgattaccaacaccaaggagcatcgcgtgtcagacagcgccatagcgacctccagcaccactccggcgaaagccaagacgaagaagaaccgactgtcaggtagtttcttccgcttcgtgctgacgaggttccttctcattattcccaccgttttcattctggtcaccatcgtgttcttcgtgatgcgcgccaccggcgacccgatttccgccgccttgggcggccgcctgacacccgccgaactccagcagcgcatccacgcggccggctatgaccgcccgctgattgtgcaatacgtcgactatcttggtggcctgctgcacggcgacctcggcacgacgctgaccgataaccagccggtgatcagcatccttacgcactacggcgccgccacattcgaactggccttcctcgccctgatcgtggcgctgatcgtcggcatcggcctgggccgactcgccgcccgcaagcgcgaccgtgccgccgatgccggcatccgcaccttcgccatcctgtgctacgccaccccggtgttcttcctcggcctggtcctgaagctcatcttcgccgtctggctcaacatcctgcccgcctccggccgctccgacctgaactccgaaatgcagttcacccgtctggtctcgccgaccggcttctacatcatcgacgccatccagctcggcgacatgaacgtgctcgtcgacgtgctgcgccacgccgtgctgccggccgtcgccctaggcctcctgaccgccggcgtgttcatccgtctggtacgcaccaacgtcatctccacctacaattccggctacgtcgaggccgcccgctcgcgcggcgtctccgaaaagcgcctgctcaacaagcacgcctggcggccggccctgatcccgatcatcaccgtcatgggcatgcagatcgccctgatgctcgccggcgcggtcctgaccgaaaccaccttcgaatggaagggactgggcttcatgctgtcccagtacctgaaggcccgtgacttcgtggccgtgcagggcatcgtgatccttatcgccatcatcgtggccgtcgtcaacttcctcgtcgacgtcatcgccgcgcttatcgacccgagagtgaggtactgagatgaccaccgcatcccaagacaagatcaccgtccccggtgacgaccgccttaccaagctcaacgtcagcaccaagacgccgttctggaccaagatcccgatcatcaaggaactgcgcgtggcggtcggctggcagaagggcatgctgatcaccggtctcgcgatcaccgcgttcttcctgctcgtggccctcttcgccccgctgatcgccccctacggccacgcccagatcaaggccgccgacggcacgtccttcccggcgcaggccgcaccctccgccgaacacatctggggcaccaccgccgccggattcgacgtgttctcccgtgtggtgtggggcgcccgcaccgccgtcatcgccatcgtcgtggccgtgctgctctccatcttcgccggcgtgctgcttggtctggtgtccggctactacggtggctgggtggaccgcatcctggtgatgatcgccgacgccgtctactccttcccctcgctgctgctcgccattctgatggccatcatgatctcccacggccagtccggcctgtggagcggcatcctggcctccggcatctccatcaccgtggtgtacatcccgcagtatttccgcacaattcgcgccgaagtgatccgcatcaaggaatccgcgtatgtcgagtccgcgcgcgtggtcggcgcctccacctggcgcatcatgaccaagcacctgttcaagaactccacccgcacgctgccggtgatcctgacgctgaactcgtccgaagccatcctgaccctcgccggcctgggcttcctcggcttcggcatcgagccgaccgccgccgccgaatggggctacgacctgaaccgttcggtttccgacgtgaccgccggcatctggtggaccgccgtgttcccgggcatcgccatcgtgctcatcgtgctcggcatcacgctcgtgggcgaatcgctcaacgatctggccgacccgcgtctgcgcgcccgcaagtccgccggcgaagtggtcggatcgatcgaagacacgtccgtcgacccaaacgagaagccgaccgcacgcaacgaggtgatcgccgaactcgacgcgaacgtcgacccaccggccaccgtcaccgaccatgacccgaccatcgtcgcctccgaatggaccggcgaaggcaagccggaaggcaaggagtgagagatgagcgaagacaacaagaatctcgccgatatcaaggacctgtccgtctccttcatgaccgacgccggctccatcaaggccgtcgaggacgtgaacttcaccattccgcgcaagaccgtggtcggcgtggtcggcgaatccggttccggcaagtccgtgaccgcgcgctccatcatcaagctgctgccggagacggccaccacctccggtgccgtctacctgtccaagcgcgatggctccgattcgctggacgtgctctccctgagcggcgaacagctgcgcgaagtgcgtggttccgaggccgcgatggtgttccaggagcccaattcggtgctgaacccggtgtacaccatcggctggcagattgaagagggcctgcgcgcccacggcatgaaggacaagaaggaactgcgcgccaaggccatcaacatcctgaagaaggtcggcatcccggatgccgaaacccgcgtggactactacccgcaccagttctccggcggccagaagcagcgcatcgtcatcgccatggcgttggtgctgaaccccggcctgattctggccgacgagcccaccactgccctcgacgtgaccgtgcaagccgaaattctcgacctgctgcgcctcgcccgtgacgagttcgacgcctccgtgctcatcatcacccacaacatgggcgtgatcgcggacatcgccgaccaggtggtcgtcatgtaccgcggccacgtggtcgagcagggcgacgtggagcagatcttctaccatccgaaggacgactacaccaagcgactgctgggtgccgtgccgcgcatcggtcagaagctggtcgtgcgcgaccgcgagggcaaaccgatcgagcgcaaggccgattggcgcgaacagccgatcgccgtcgaggccaagaacctgaccatcacgtacccgggccatctcatgcagcccgacttcaaggccgtggacggcgcgaacttcaccatccaccgctccgaagtgctgggcctggtgggcgagtccggttccggcaagtccaccaccggccgtgccatcgccggcctgcagaaggtgtccggcggctccctgaacgtgctcggcatcgagatgaacggcgtcaaggagcgtgacttcaagcccaagcgcgcggacattggtttcgtgttccaggatccgggctcctcgttcaacccgctgatgaccatcgcggagaatgtggccgagccgctgctcgtgcaccacaagtacggttccgtggccgatgccaagaactatgtgggcgatctgctggagatggtccagctgccgcgcgcctacatgaaccgtttcccgcatgagctgtccggcggccagcgccagagggcgtctttggcgcgtggtttggcgttgaagccgtcgctgctgatcgccgatgagccgacttctgcattggacgtgtcggtgcaggccaaggtgttggagctgttcaagcgactgcaggcggaaatcggcttcgcgtgcctgttcatcacccatgatttggcggtggtcgatatgcttgccgaccgcatcatggtgatgcataagggccagattgtggagcacggcgatgccgaccagattatgcagcacccggagaacccgtacaccaagaagctgctggcctccctgcccgtgcccgacccgcgcgaacagcagcaacaccgcgcccacctccacgagctcctagcccaagaggcgtaatcgcatagcattggagctccctcgtcagagggagctaactttatatccgctagtactgctgcccatcgaactggaacagggcgtgggcgtcgccgtgttttttgttctcgatgtaagtatggaacagctccagccgctcgctcgtgctggccgccaggggagtgggcaggtcatccagatcgaaccagccgacgctcaggctttcctcgtcgcctacgaacggctcggcattgccgccgggcttcagggcgcacaggaacgaatgatccatgtacatggtgttgtcgccattggcgtaggtcagtaccttgtttgacgaggtgacggccaccaaatcggtgacgatggcatcgatgcccgtctcctccttgatttcgcgcaccaccgtgtccgccggctgttcgcccggctcgttgatgccgtagaccatcgcccattcgcccgtgtccgaacgacggcccaacagcagttgaccatgttcgttcagtacacaaccggtcacgccattgagccacaacagatcatggccgatcttcttacgcaattccaacacaaattccggagtggacacattgcctccttagtagaaaaaaggagctccctctgatgagggagcttaagggttacttggcttgggcagcctgcttaatatggtgcgcttcgcgcatgatttcattttcctcgcgcttgtcagcgttcggcgtcgcctacaatcagtccaccggactgattgctttacggctccgcatccacgcttcgacgtcgtcgatctgcttcgggatgccggcggaaatccattcggggccgttctcggtcatgagcacgtcgtcctcgatacggatgccgatgccgcggtattccggcggaatcagcagatcatcctcgcggaagtacagaccgggctcgatggtgaagatcatgccgggcgtgatcttcgcgccctgataggactcatagcgggcctgcgcgcaatcatgcacatcaagacctaggtggtgggccacgccgcaggcgagccaacggcggtgctgctggccttgcggggacagtgactcctcgacgctcaccggcagcagaccccaatcgtgcagacgctcggcgatcacacgcatgcaggcgtggtggatgtcggaataggtggcacccggcttggcggcttcgaaaccggcctgctgcgagtccagcacggcctggtacagacgcttctggaagtcggtgaacttgccgttggtcgggaaggtgcgggtgatgtcggccgtgtacagggaatcgacctcaacgccggcatccaccagcagcatgtcgccggtcttcaccacaccggtattgcgcatccagtgcagaatcggggcgtgggggccggaggccacgatggagtcgtaaccgatggcgttgcccagctcacgggacacggtgttgaacgcgccttcgaggatacgctcggaacgcggcttgtcgagcgcggccggcagtgcggagagcagacggtcgaagccatgcttggtggcgtccacggccttgcgcatttcgttgatttcgtagccgtccttgaccatgcgtgcctcggcggcgaactcgtgcagcttgtcgtcggatgcggagttcttgtccggatcggcgaaaccgttggcctcgcggatggattcaaccatcgaagtgatttgcgggtcggtttcgctgaccacgcgcacgcgtacggcgccggcttcggcacccacgtccttggacagggcgtcggccagctgggcgatgtcgtgggtttcgatgccggtcatcgcctgcatctccttgagaccggcacgcgggccaacccagtattcgccgtagtgggcggacatgaagaagtcctcggtggagttgtcggcgcgcggcgccacgaacagttccggagtgtgcgtcttgccggcggcggcttcgggggagtcggggtcgaccgggttcaggaccagcacggcgccggcctcgtaatcggaacccagaccggtgtagtaggcgaacgtggtgtccgggcggaacatgtaatcgcaatcattgttgcgcaccttcggctggccggccggaatgaccagacgttcgcccgggaaggccttgcccagcgcctcaaggcgggctggcgtgaacttggaggattcgagaggcttgatctccggatcatcgtcggcccagccggacttcatgaactccttgaatgcggccgactgcgggcgcagcgagcggttgttcacgcggtcgctcatcgactggttcgcgcccggtgccgtagcgcgctcttcggcctcatattccttgtccttggcggtgatcacttcacccattgccactctcctgtatgtagttgttgtcgaatcatcgattcccacctcatactagtcggctttatgcgatgtgccacgattgacggctgacggtaaaaccaagtacggaatttggacggtcttccggacatgcccatatggcgagtgcggcgggctggaatgcgggcccgtttattgttctcggtagggaaggagaggggcatgggcttgggctggagcttgccgattgatattgacatattctgtgggctgaatccatgtgaacccatgcgatgaaggtttatcgcgtcgcgggactcactgctatgcggaggtctccacctgaggcaccccggctttgatcagttttacccgcagcggagtacgttcgatgacgtcggcgtatgtgaaatggacgatttcggtggcaccggctcgtttcagtccctcgtcgcgtgcgcgttccttggccaccacctcctgaatgctgcggttatcggtcatggctgggtccacgtatttttgtgtgccgtcgtattcggccactatcacgcgcccgtcatcgagcttccatacgaaatcaacgcggtactcggtattcgtctgtgggtcggtcaccgttacctgaatacgcggcgtgaggaagcgatcttcgatgatggtgcctcgcgcgagggattctccaccattctcgctcctttcgtttgcatagcgcagcaggcggaatactcgggcataatcgattctccattgaacgcagtcggcggctatctcttccttggttattcccttggcaagggccgagtcaaagatcggtaacgcaaaccgaaaatcaaggtctatagcggcctcgaccaaggttctagccggtgatatcagggataggccggaggcctcgtaatgtgtcttcggattgttcatatcgggcatatagacatgtcgtaagcgctgatggcattgacgagatccatgatcggaagtcacgatggttatgcagtcatcatgcaaatgccattgatgttcgaatccataggcacttactgccaccaagccgccaaaaacccactgaggatgctcttgcgcaagagcgcgggctatatgcaacgttcgctccggcggcgtcaaaccatcccagtatgcagtatttgcataaagactgggaatgccgtcatacactttcaacaactcaccactctgggcacggcggcgtagagcggtctgttccgcttcatttcttgaatagacgcatctcagctcattctgcgcggctgatatgagcgaggccactgctttgtgtgtcttcatgacgtcgagcgtagccggaacgaagcagcgtaagtatgaatttcagccattgtggttctagcctcggagcttggctgtcttggagcgagatactcccgataatttcaaggtattaggccgctaattcggaatagtggataacacacaaaacttatccaccatcagtaatgtcattcgaacaacgtgctttggggattcgaacaagatatcatcggcgaaggcggatgtagctggtagagggcggcgaattgacggttaacggtgcttatgctttgtacgccgtcggtgctggttcagatattggctggcttctgtctgagtgtggaatctagcgtcggcgtgagtccaatggttgtatcggggccgacgatttgctgcaatttattggcggcatagatccagggcttggacggctgccgacggtgagagcagtcataacagtgaatgagcctctgcgagttcaaaagatgatgtagaggacgtttgtgagagtcgtttccggggcaagacatggtcgattgacgacattgaaatttctcaacgacggcagaatggcatgccttggcgaggagacgacactgagaggcgatggagtcgggattaatccaggttttggccagccaccgactcgcaagagcatcatagcgtcggtgtaccgccagaagctggcactgtaccgacgctgaatagcatcagcgtcgccggacatacaagttttggattgcagccgactaagaatgagatgccgacggcaagagccgcattgcaactatatgagacggcttcactgtgcgtggctgcaggtagagactgcccgcgcggcggcgacatatgagacggtttcactgtgcgcgcacgataaaccaccccggcggctaggatagagggaattgagggagtgcggctccacgcgtgaaggcaagaatcccgaatcatgcagagcaaacctgtgcaaggggagcttcctgcgcatgcggaagcggaaaatatgcgggcatgcgtagacatgacgagaatggcgcgaacacgtaagtggcatacgcactccgaacggcgcaacagcaacacgagcagaggttagaagaggatatgtcattcgagcatccgaatcggaacaatgagagcatgcgggacgtcgaactggacatcatgagccgcccgccggagcataacaccaccaatctggatctcgaccggatgaacctgatgctcgacatcctgggccacccggagcagtcgttccgcgtgattcatatcaccggcaccaacggcaaaggctccaccgcacgcatggccgaggccatctgccgtgcctacggtatgcgcaccggcctgtacacgtcgccgcatctggagaagatcaacgagcgtatcgccatcgacggccagcagctgtccgatgacgatttcatcgacatctgggaccagaccaaggatctcgtggccctggtggacgccaagatggaggagcaaggcaagccgaagatgagcttcttcgaggtgctcaccgccatggccatctggaagttcgccgacacgcccgtggacgtggccatcgtcgaggtcggcatgggaggcctgtgggacgccaccaacgtgctcaacgcggatgcggccatcatcggcccggtggacatggaccacatgcagtggctgggcgacaccgtcgaacagatcgccaccgagaaggccggcatcatcaagccgaactgcaccgccatcatcggcccgcagccgcatgaggaagccgtcatgccgattctcgccgaagccgccgaacgcaaccacgccatgctcgtgcgcgacggctacgaaatgaccgcgtccgaccgtatggccgcagtcggcggccaagtcgccaccctgaccacgcccaacggcacttacgagggcgtgccgatcgccaagttcggcgagcatcaggcccacaacgcgcttgccgcgctcgccgcctccgaagtggtgattccggtcaacggcccgctggacggcgacttggtggccgaggcgttgagctcggtcaagattcccggacgcatcgaacagatccgcacctcaccgaccatcattctggatggcggacacaacgtgaatgccgccgaagccctgcgcaaggccatcgaggaaagctacgacttcaagcagctggtcggtgtggtcgccatgatgcgcgacaagcaggtcgaggaatatctgggtgttctggagccgatcctgagctccgtggtggtcaccgagaactcgtggcgcgagcgcgtgatgccggccgacgagcttgagaagattgccgtggacgtgttcggccgtgaccgtgtgatcaaggaagcgaacctgcctgacgcgattcagaccgccgtcaatatggtcgatgccgaggacgagctgggcgtgggctacggccacggcgtgcttatctgcggcagcttcgtcaccgccggcgacgcacgcctgatgcttgaggaacacgccagccccacgatgaggcaggctatggccgttcatcagccggcggttgacccggacgattcggatcagccggcagacaaggccgaggatgaggccgccgacaacctcgaggattcggtaagcccggacgacttcgacgtgttcgacgtcctcggcctcggtaaggaacaggccggtgacgccggcaccggcacggccagtgccgacaccgacagcactgacacagccagcgccgacaccgacgattccgccgacgcccggtaacccgcatccaaggcatatcggatacccggacacccggcatacggaaaacagtctcacgccatgtatctcaaggaactcaccctccgcggattcaaatccttcgcctccgtcaccacgctgcgcttcgagcccggcatcacggcggtcgtcggccccaacggttcgggcaagtcgaacatcgtcgacgccctgatctgggtaatgggtgagcagggcgccaaaaacctgcgcggcacttcgatggaggacgtgattttcgcaggcacgtcctcccgcccgccattaggccgtgcacaggtgagcctgaccatcgataattccgatcacacgctcgatatcgattacacggaagtcaccatctcccgcaccatcttccgcaacggaggctccgaatacgcgatcaacggctcgcaatgccgcctgctcgacattcaggaactcctctccgatactggtcttggccagcagatgcacgtgatcgtaggccagggacgattggatgcgattctgaaggccgacccgtccggccaccgtgcgttcatcgaagaggccgccggcatcctgaagcaccgcaagcgcaaggaacgcgcgttgcgcaagctggccaataccgaaacgaacctgagccgactcgacgatttgctgggggagattcaccgtcagctcggccccctcggacgccaggcacgcatctcccggcgcgccgacgcgattcagatatccgtacgcgacgcccaagcccgcctgtacgccgaagacgctcaacgctcgatgagccgtcgcgacacggtacgtcaagaacttggcgctgtgcgcaaccagctggccgtcgcccaacgtgaactcgcccaagtcaaagtacgcatcgaacaggtcgaggcgttgagctccgaatccagtccggccatcgccaaggccaaccaatactggcatgaattctcgcagacccgcgaacgactgaacgcgctcgcccagttggccgaagagcgcagccggtcactcaccggccagatcgtcaccaacttcggtgaggatcccggcatgctcgtcaaacgagccgaggaactggaatctcaggccgcggcacaaaccaaggccgtggccgatgcgcgcatcgcactcgacaaggccaccgaggaacgcgccgacgacgagaaaaagcttgcctcagtccgccagaccttgacggaactgcgcaaaaccgcacaggaacgcgatgcgcaaatcgcccgactgcgcgaactcatcgcccgcgaggaatccgccgtacaactggcgaccagccgcgccaaggattacgcctcccaacgcgactcgctgacttcccagcgcgacgatgcccagcaacagctggacgcattgcgcagcgaagcggactccattgccgacgatgacggtgccgcattggacgccgcacgtgcaacgctcgccgaatgccgcgaccgactgaatgaacgcgccgataagcagcgcgagatacagtccaagatcatctcgctcaaatccaaggccgatgcgcttgccgacacgctagacagccgcaatgcctccggatcgttggagcgcgatacggacgtggcctcgcttggccgactcaccgacttcatccatgtggccgaaggctgggaagaagccgtggcccacgcgctcgaccagtatgccagcgccatcgtggtacccgcggcaggcaacatgttgcacgccctcgaacgcgctcgggaagataagctcggcaaagccgtggtgctgaccgcgagcattgccggcgatcccgccacagagccgggcacggagtcggaggagagtagcgccgagaacgcgggggccgccccgcaatcgggcaacgcgctggcagcactcgtcaccgcgaacccggatgccgagaacccggcacaggccgaagcggtcgtgcgcaccgtgcgtctcctgctggctgatgtagccgcggccggcaccgccgacgaagcacagcacatcgtggcatccggcgaagccatgcgggccgtcaccaagaacggcgagaccttcacacacggcgtggcggcggtcggcggctcttccatctctcaatcggacctgtctttggccgcacgccgagacaaggcattggcacaggtcaaacagttggccgcccaagacggcggaatggctgagcaagtggccgaggccaaagccaaacgcgatgaagcggcccgactcgtcgaccaggaatccgccaaacgcaccgaagcccggctcaaagcccaacaggcggagaaatctctgaaatccgccacagaccgcgtcgcatcgttcacccgtcagcttgagcagctggataggaaaatcaccgagacccaagagaatcgcaacgagcatcagctcaagctcgacgatctcaatcgcgctttggcatcggcccggcaatccacagcggaacatgccgatttcgacgaacttgatgaacgtgaacgcacgctggagcgcggactgaacctgactcgcgagcatgaggtcgccgcgaaaatcgcgtggaccgaggcaagccgcaaaggggagtcactgagccgacaggccgggctgctgcgggacaacgccagagaagccgccgaacgccgcgcccgcatcgaggcgttgaacgatcgcagacgcgagcaggccgcacacctgcaaggcgtggccgatgacgcgcgagcagtggccgccatggtggaacatacgctgcatgacgtggccgccaaacgagacgagctgcaggccgccgcctccagccatgacgaggaactcaaggccctgcgcgcgcagcgcaaccagatcgagcccaaggtcaccgatctgaccgggcgcgaacatgccttggatgtaaaccgcgaacggttggccgccgaatccgggcagctcatgcaaaaagtgtccgacgaactcggtctcactttggaggaattggttagtggttacggccccgaacagccggtgcccgtgctggatgatgagggcaaccctgtgccgttggatgagacggaagctgaggctgggaccgaagagggagaaaccgggggagagaccggcaccaacggcgattccgccctctttaagaccgtgccgtataaccgtcaggagcagaagaagcgtctcgataaggctcgccgcgatctggccgcactcggtaagatcaaccctttggccaccgaggaattcgaagcgcttgaggagcggaacaagtatctcaatgatcagcgcaacgatgtggtcaaatcacgtgacgatttgatgcagctcatcaaggatctcgattccacgatggtccaggtgttcaaatccgcgttcgacgataccgccgaggcattcgagcagatgttcgccacgctgttcccaggcggcaccggacgactgcgcctggaaaacccggaagacatgctcaccaccggcgtactggtcgaggccagcccggccggcaagcgcgtcaaacagctgagcctcctgtccggcggcgaacgttcgctgaccgcgctggcgctgctgttcgcgattttcaccgcccgccccagcccgttctatgtgatggacgaggtcgaggccgcgttggacgacgtgaacctgacccgtttgattaatgcgttcaatgagctacgcgcccatgcgcagctcatcatcattacgcaccagcaacgcaccatgtcgattgccgacgcgctttacggcgtaaccatgagagccgatggcgtaacagccgtggtgagtcaaaaactcgaacgataaacgaatggttcccgctggtaggaactggtgccacaggtgacagagggcggtccatatcgaaagaccgccctctgtctcgcttcgttcgacagctcccaccagcgggagcggggaggtattagcgcaatgccttgcgcacgccctgtacagtctgcagcgtcttgtagaagaccttcttgatgggtacgtcgcgggcgggggccaccggggtgatttcctcggtgaacttgcacttgaactcgttaaggcccttgagagacggcgcgaagtcggagccaatgcccatgagatcgtattcagtaataccctgcgagcccaggatgcagcattcggaatacagcagcttgtcggtcacatgcagacgcataacctcgttgcgcatgccggcatagtagcgcaccgcatgcgtgccgttcacggtgacaatcgaccatgccaccacacggtcttcaatacgtgcggcgaacacacggcaatgatcggcacccaacgcgccgatcatatcggaatagtcgctcatcggagcaggcgtgaatccatcgcgctggccggtctcgaccatcacatcgtaatattcggagaaatcggccagcgccttatccgtctcatcggcaacctcggccgggcactcgcgcagagacttgcgcacgtcacggcgtccacgacgcttcatccgagccagaatctcatcatcgccaccagtgacgtcgatgaccacggtctggtcgtacggcactgtggacagcaccttctccgtaccatcggcgaaccaggtgtcgatacgcaggaacgcgatgttcttgtcggccttcttgacggtgtccacgatggcgtcgacgacctcgcgctcctcagcttcggtgggcttggcagcccacgccggcccatgcatcgagcgcagataatgataaccgtgcgtctcaaaatcgataaaggagatcacggcgaccaattcaccatcacgcttgatcagataatcgccccatggcgtgcgtccgtcgatatccgcctgaaaaccagaccaaaccttggtctgttcgataggcaacgtgatgccggccttctcggcttcggcttccagtgtggctccgtcaactttctccaacgtgatcattacgattcagctatcctttttcgttcgtatccgtatgtcgtgtttctggtttggtcgtattgcgcgtgatctgatgtgggccaatcggaatccgatcaggatctgattggccggaatcccgtcacaagccaaacatgcgttcgaccacgtgatcgtcgccgtcgaacggcacatgcttgtgatggtccttgatccaacgctcgttgcccttgccgatgatcagcaggatgttgaatcggtcggcgtgcgcacgggcatcgtaaatggcgttggtgatggccgtcggacggtcggaaatcaccgtggagaccacatccttgttcgtgatgtagccttgcatttccatgcagatgtcgatgaacggctcggtgtccgtatcttcggcggtgaaaatgaagttcgcgatacggttctcggcagcctcgacgatttccttacgacgatcgtaggccttgttgccggccgatccggtcaccagcgtgatacgcgggttttcctcgccccaacgctcgtagacgaagtcaagcagcgcggtgacggatgcgtagttgtgcgcataatcgacgatggcgagcgtgttcgactgcggatcgcggaactgttccatacggccggcgatacgtacggattcgatggcgtgcagtgcgccggcgtcatcgagcgatacgccagccgcatgggcgatggcgatggccgccgccgcgttgaggtagttgaagtcgccatcgatggacagatggtagtcgccaagggtctgatctccgtcggcgatgtggaaggaggcgtgcgccgtgtcggcgggccaggcgacgacgtccgcactggtgccggcattatccgcgtcatgcagggcgaaggtggttgcgccgatgccggctgccgccgcgtcctcccgcaacagatcggcgtgcagactgtccgcgccgagtaccagcgacttcgcgttggcgatgatctggcgcttgcaatacaggtaatcctcgaacgtggggtgttcgatcgggctgatgtggtcgggggagatgttcaggaacgcggccacatcgaaagtcaggccatagacgcggtccaccttgtacgcctgggaggagacctccatcaccagatactccatgccgttatcggccgcctcgcgcatcatgcggaaggcgtccatcgattcgggcgtggtcagatcggactcgacgtaggtgtggccgtcaaggcaattatcgaccgaggagaacaatgcggccttgccgccggagacggcgttgataagcgcctgcgtgaagtacgaggtggtcgtcttgcccttggtgccggtgacgccgatgaccgtgagttcgttctgcggatatccgtagaacgcggcggacagcaggctcatcgccttgcgtgcgtcgttgacgatcaggccgggggcggcggttgcggctgagtactcggtttcggccacgtatgcggccaggccggcttcgtcgatgccgttcagatactcggccttgaatcggcccttgcagcacagcagggtgccctgcgtgaccttgcgggtgtcgtaggtgatgccggcgaacggttcatccgccgaagcgatacgggccgggtcgtcggtccagacatccccttggatgatttcacgcagcagatggtgttccttgagcaggtcagcggccgaagccaaagtcaaagccataattgtttctccctattatctagccgatacgccattctacaggtggggtgcagcgtgttgtggctcacacgtcatcgaccacgatatgggcacatgatttgattagaatggtgaaccgtgacgacaagcgaagcaactacgcaatccgggcagtcagccggatcgggcgagtccatggcagccaagcgcgccagattcgagcagctcgccatgcccgccgtcaatgcactgtaccggcaggcgatgaggctgaccaacaatcccgatgacgcgcaggatctggtccaggacaccttcgaacgcgggttcaaggccttcgactcatttcagccgggctccaacttcgaggcgtggatgaccaccatcgagcgcaatgcctacttcaaccagtatgccaaggccaagcggcgcccgcagcgtgccaacgactccactggcgaatacgacgattgggacatttacgatgccgccgaacatacgtcggacgggctcaagtccgctgaagaggaatatttggacgccttcgcgcccgaggaaatcatggccgcgctcgccaaactctcgccggaacgccggcaggtgttcatcgacgccgccatcgacggcaagtcctaccagcaggtggccgatgagcagggcgtgaaaatcggcacggtgatgagccgcctgaatcgcgcccgcacgcaactcaagcgtgagctcgcttcgtatgcgaaagagcgcgggtacgtgactggttcgtcggctggttcaccatccgcgaagttgggcgaaaacgttggtcgaatcgccgattccggccataatggaagtagtgaacaaactgttggtagcaatggcgacacgcaagccgtagtgagacatagtcatgcgactggcgcccgcacgccacaacagtcaagcaagctttcgggaaaggagatctgatgaacgatcagccggtagagcgtactcgccatatctccataacccgtacgggggccgatggcatggtcagccagaccgaagtgcatatcacggcggtgcatcatcgttcagtggataccggctcggcctctgcgtcggtccaggcggacgtgcatatcgttacggagggcgactgttttgaccctcgtacctgctgcgacgagcgtgaacaggcgttgattgccgcgttgcgtgcctacttgcgcccggatgtggcacccgaatgtctgatggcccggctcaaggccacgcttgatcactgctgcggcgaagataagtaacgacatatacaacaaggcccgtctgatgtatcatcagacgggccttgagcgttctataagaaacgcgaagaatcaggcgttaggacgcttgccgtggttggcggccttcttacgacgatccttgcgcttacgtccgcgcatgcccatgatggactcctttgctgcagtaaaaaaataagccttcggaattatgccacataagtacgacgtgatgcaacacgggtgtccatgtggcgatgatcgtcaggcttggttattcggtttttcagatttgttcggcgtggaaggtgaccacggtggtgtagtcatcgcccggctcgagcacaaccagatccttgccggtgcggaaggcgtcggcgtaggcggtcatcggttcgacggccacgccggcctgacgaaccttctcgccgatttcgttgccggtgcacacctgccaggagttgatggtcttgtcgccggtcagcgtgaccttgatgccgtcggggcgggtgaacacggcggaagtgctgccgtcttcaccgcggttggtgatatcggtccaggcatcatcgaagccacgtccctccagcgtggggttatcgcgcaggtcgaagatgccggaaaccggctcttcaccggtgggcagcaggtgttcgtctacggtcacgtgagtatcgcagtgcagctcaagacggcagagctcgttgtcggcggtaatggcctgaccggtggcgtgcttgccgttggccagccacgggtggatgccaaatgcccacggtgccttcacgctgtcgttgttgtgcacggtgaaggtttccgtgagaccgttctcgtcaagtgcataagtggcggtgatggtgatatcaaacgggtagccggcgatgtcgggggaacgccaggagagcgtcacatgcgattcctgcaggtcctcaagctcccacatataacggtaggcatagccgtgcagggaggattgacggtcaaattcgtcgatcggcatctgatagtcttcaccgtcgaaggagtactgaccgttggtcacacggtttgggtacggtgccagcacccagccgttgcagcagggaatgaccttgttcgggtcaaagggaacgatgaggtcttcgccgcgccacttcagctcgcgcaggctggcgcccagttcggtgacgacggcactccattcgccggacgagatgacatattggttaccagtgcgaggcttcaaagccatagtgcacactcctttgtggaacaaattgttatcgctcacaatcgtatcgcataagtcccaagacgcggcggcacataaggataaaaaaattggctcccctctggaggggagccagcgtaacagaactacttctggactgcttcgtagcggaccacagtggtgtagtcgccgttgggggcgagcgacaccaagtggtcaccagtgcggaaggcattggccggggcggtcatcggctcgacggcgatgccatacggatgctcggcgaacggtgcgccagtggcggtgtagcactgccaagcattaatcgtctcatcgccaatgattttcacttcgataccgtccgggcgggtgaatgtggtggtggtcgcaccatcggcggcacgctccacgtcaacccaggcatcatcaaaggcgcggccttcgagcgtcgggccatcgttcaggtcgtagatgccggtaaccggttcggtgccggtgggaatcagcgcctcgttcaccgtcacatgactggcggccttaatctgcaggtggcaggcggcggagtcggcatcgcgttcggcggcagttgcgccctgcttgccgttggccagccacggatgcaggccgagagcccacggtgccggctcgtcgccatcattgcgggcattgacggtcgcggtcatgccgttgtcgccgagttcgtatgtgacggtcacggtcacatcgaacgggtatccgtccaggttggggaagcgcagcgaaagcgtcacggcgctatcggtcaacgattcaagcttccacatgtagtggtaggcgtatccgtggttcgcattgttgcgcggtgcgggatgatattcgttaaccggcgcgcagtaatgcttgccattgaaatcgtattcgccgttttcgatgcggtttggccacggggccagcacataaccgttacaggtgggggtcaggtcgttgacgccgaacgggcagaaaatttccttgccttgataatcgaatcggcgaatcttggcgccgagttcgcagatgacggcggaataatcgccatagtgaatcgaatactgatttccggtgcgtggtgttttactcgtcatggaatcactcccgtagtgaggttggtgggccggtagctcctgctatcgctggccccagtctagcgcgtctcctctatcgaggcggggattggcgatatgcggcatataataaacaattcgtataaacacggtagcaatacgtggagtgacgagtctcacaccatcatgcgagaagcacgtggattccttggaaaccggtgatttgtgggagacgcggaaaagttgtgacggcagattcctgtaatccctgccttacactggaaaacactattgacgttcaggaggttccgatgaccaaaagcgttgtgctcgctgatccgcgaggcttctgcgcgggtgtggaccgtgcgattcttaccgtacagaccattctcaaagccgcggaggcttccggaaagcggacgcgcgaggatgggctgcccccggtatatgtgcgccggcagatcgtgcacaacaagcatgtggtcgaggacttggccgggcaaggcgcggtgttcgtccaggaattggcggagattccggatgctgctgcccaagcgggtattccggtggtgttttccgcccatggcgtatctccggtagtgaaggcggaagccgaacgtcgtggcatgcatatggtggatgccacctgccctctggtgggtaaggtgcaccgtgaggtgctgcgtttcgtgcgcgaggggtatgaaattgtctatatcgggcataaaggtcacgatgaagcggtcggtgtagtgggggagagccccgaacatgtgcacttgatcgagcatgaatcggatgtcgattcgctggattttgcgcccgacaccaagctggtgctgctctcgcagaccacgttgagcgtggacgagaccgccgataccattgccgcgctgaaggccaaattcccttggattcaagagccgccgagttcggatatctgctatgccacgtcgaatcgtcaggctgcggtcaaactggtggcccagcagtccgattgcgtggtgattgtcggatcggccaactcctcgaattccgtgcgactgatggaggtggcgcaggagggcttgggggagcgcggcaaagcgtatcgcgtggatgatgccagcgagcttgacccggcatggttcaagggtctggaatccgtaggtatctcctcgggtgcctccgtaccggacgaactggtgtccggtgtgattgacgctctgcaaaacttgggcttcaccggtatgaagtccgtcgaaaccatcaaagaaaacatgcactttgtgctgccggcggagttgcgcaggaagaagtagtcattcttggctcccctccgtgaggggagccaagaacggtcaccacgtgccgattggtgcggcaacggcgttcaagaccttgagcaggtcctgtggattcacgcccacagacaggcctcgcttgccgccggagaccagaatttggtcgaattgcagggcgctttcatccaacacagtcttatgacgtgtcttctggcctaacggcgagatgccgccaaccacataaccggattcacgcatcgccaccttgggatcggccatagaggccttcttggcacctacggctgcagccaaggctttcaaatccatatgaccgctcaccggtaccacgcccaccacgcgttcggcaccggtgtccgccatcaacgtcttgaacacctgatgctcgtcgaagccgagcttggtggccgcctccacgccgtagccgtcatccatatggtcgttggagtgctcgtattcgtatacgtggaattccacgcccgccttctccagttggactgtcgccggagtggaacccgcgcccttatcatgcttgcttttctttgccatgattaccgttctactacgaagagacccccgcacaaggcgggggtctcacagcttagttctcaaacgaaccgtagcggcctagaccgcaatggttcactcggagatctcagcgaagtacagcagggtacggatcatgttggaggtgaagccgtactcgttgtcgtagaaggacacggtgcgagccagggtcacgccatcaatggtgttgacgtcggtctgggtcgggtcgaacacgccaccgtgggtgtcgccgaggatgtcggaggagacgatgccctcatcgttgtagccgtagtaatcggtgtcggagaaggcagccttgaaggcggcgttgatctcgtcggcggtggtctcggtgttcagaacggtggtcagctcggtgacggagccgtccggaacctggacgcgctgggcgtggccctgcagcttgccgttcacggacggaacgaccttgccgatggccttggcagcgccggtggagtgggcgatggtgttgatggcggcggcgcgcaggttgcggccggtcttggtgccacgcgggccatcgagcagcatctgggtgccggtgtaggcgtggatggtggtcatgaagccggccttgatgccgaacttctcgtccagcagcttgaccatggcggccatggagttggtggtgcaggaaccggcggagacgatcacgtcggaagccttgaggatgtcgtggttcacgccgaacacaacggtcggggtggtgtcatccttggccggggcggagatcaggaccttcttggcgccagcgttgatgtgagcctgggacttctcggcggaggtgtagaagccggtgcactcgagcacgtactcaacaccgtcgttcttgacccacggaatgttgttggcgtccttctcggcgtagaccttgtattccttgccgtcgacgatgatggagtcttcggtggccttgacgtcaaccggagtgccatcgtcatgacggaaggtgccgtgggtgctgtcgtacttcagcaggtaagccagggtagccggggtggtcagatcgttgatggcggcaacttcaatgtcaccagcctggccgccgcgagcctgcagctcgaagatgcgacggaaggcgagacgaccaatgcgaccgaagccgttgataccaatcttaactgtcatgtaattctcccttgtagggtggccttggcgcgctttggcacaccgggccattgtttaccaacagttgctactgtaatgccgactctgtacacatggcaacgtttcagcgtgcgttttgggcaaaaatgccgtattttctgtgagcgctcacaattcggattgcccgcaaccgacatgtgatttttcctctcctttggaggaatgtctcgaatcatcatgagcaagcgcgcggcatgcaagtcagcgaaccagcagcttggacactgcggtgtccagctcgccgatatcgccgccaaattcgtggaatcgactcacctgaggcaacgccacctcgatggggaaggtgacgatcagtgtgccgtgctccacgctgatggccgcgtccacgccgtcgcggaactcgttgctgaccccctgcaccaccgtattggtcagcgtgccgtctttaagctcatatttcagccccggctcgttcacgccaagcgaaacatcggagtgggagaacgcagacaccatgcggccgtcctcgggcaccggatgcgcggggaacgaaagcctaccatcggtgatggccgtgacgatgagcccatcaccatacagatacccgcttgccccatgccgggccaataatgccatcagttgaatgccggaaatcgtatggtcaatgcggccgcccaaaccgccatagacatggaattcgcggcaacccgccgaccaaccgaccttcagcgcggagagcatgtccggatcgtccttcagcgcgggcagcgcgatggtgcgcacatcggtgcggggcggccggccctccagcgaatcgaagtcgcccaccaccacatcgggcacgatacccaactggcgcgtatggtcgagcccgccatcggccgcaatcacatacgcgctggccggcaccacgggcgtgcccgcatagtattcgcccgcaccaaaaatcacgcatacctgagtcatgatgcctactgtagccggtatccacccatcggccgggaaaatgctgataggctacgcatcagaacagtagtcgataggcgcacaggcaggggagcggagcgatggcacagatcaccgaggcaagcgaacggccgattctcaaatcaaagatattcctctacatcaccgaattcttctccggcatgtccgctgatctacttcatctcgatcaaggccaagcgcatcgcctgcgtggtcagcgccgtgatcttcgtggccacgtcctgcgtctcgcccctgaccggcttcgcgttctgggaaaccaacctggcctatgagggcgagtccatctacaactacctgcaggtcaagaacctctccgaccgcacgatcctgtccaccaacgtgctgttcggcgtgcagtccgtcacgatgaaagacaaaggactgacaggtatgtactacgacacggccctggctgcgccggcgctcgccgacaatgccaattccgcgctgatcctcggcatgggcaccggcacctacgcccgccagctgaagcagtattatccgaaaatgaacatcaccggcgtggagattgaccagaagatcaccgatctggccggcgaatacttcgatgagcccgccgacatccccgtgaccacgtatgacggccgagcctggctcgccgcctcgcatgacaagtacgacgtgatcatggtcgatgcgtatcaggacatcaccattcccttccagatgagctccaccgagttcttcaccatggtcagagagcacctgaaccccggcggcgtgatggtggtgaacatgaacatgatctcggacggccaaggttcgatcaacgaggcgttgagcgataccatcgccagcgtgttcggcaatgggaacacactgacggccgacgtgccgaacaccacgaaccgtgaactgttcgccaagaagccgggttccggctccgaagagaactccatgcagcaggcctccaaggcgctcaacctgcgtgagaccacctacgagcgcaccggcagcgaagatctcgaatggtatatggaagaggtcgcctctcgattccggaaggtgaacgaaccggactcagcgtcgactattctcaccgacgacaaggcgccggtcgaagtactcggcatacatgccatcgatcaaatcatcgccgatgaggccggcccatatcggcagattctcaaagacgaaggcttcggcggtctgctgcgcgccgtgcagtaggttcgacacacggaccgcgaatgtccgggcgtatggtagactttctatttggcttgagaaatcaagaaagcggggcaaccccacctggaagcctttcaaggcctcgggttcaaggcaaacagcctagcgattgcgatatacaacgcgtaatcaggaatgacgcaaagaactgatatgcgtctgcagaagctgagcgcatattggcgcgggctttggcttgccatgaacccaaagcattgaacaggactccagcaaaggccctcgccacggaattgaagtagaggattggagtcatcatcagcgacgaaccacgtattaacgacgagattcgcgtcccgcaggtacgcctgatcggcccgaagggcgagcaggtgggcgtcatcgcgacttccgtcgcgctgaacctggccaaggaggcaaacctcgatctcgtcgaggtggccccgaacgcgaagcctccggtcgccaagctcattgattacggcaagttcaagtacaacgagaagatcaaggctcgtgaagctcgccgcaaccagagcaccgcggaaatcaaggagattcgtttccgcctgaagattgacgaccacgatttcgacgtgaagaagggccatgtgacccgcttccttaacggaggcgacaaggtcaaggtcaccatcatgttgcgcggtcgtgagatctcccgcccgattggtggcgtggaactgctgcagcgtctggccgacgatgtcgaggaatacggcaccgtcgagtccaagccgaagcaggagggccgcaacatcatcatgacccttgcgccgaagggcaagaaggtgcacacccagtccgagcagcgtcgtcgtggcgccgagtcccgcgccgagcgtcaggctcgccaggcggctcgtctcgcggccaagcaggagtctcaggctcaggccgcggccgacgcgcagtccgcgatttctcagaagacttccgacaagaagcaaaccagcaaggagggcagcaatgccgaagatgaaaactaattccgccgcttccaagcgcgccaagatcaccggcaccggcaaggtgaagcatgtcggttccgccatgcgccacaacctcgagcacaagtccgctcgcaagcgccgtgaactgtccgccgacgatgtgctgcgcggcggccaggccaagaagctgcaccagcttctgcagaagtgagcatagggcttacccggaaataacaagactttagaaagctgaggaatagattatggcacgtgtcaagcgcgcagtgaacgcccacaagaagcgtcgcgttgttctcgagagggcttccggctaccgtggccagcgctcccgcctgtaccgcaaggccaaggaacagctgctgcactcctttaactacaacttccgtgaccgcaaggctcgcaagggcgacttccgcaagctgtggatccagcgcatcaatgctgccgtccgcgctgagggcatcacctacaaccgcttcatccagggcctgcgtctcgccggcatcgagctggatcgtcgcgctctggctgagatcgccgtctccgacccggacaccttcaagaccatcgtggacgccgccaaggccgccctgcctgaggacgtcaatgctccggttgaggcctgattgcttgaagtcgtgacttcacactagaaaccccgcttccgagcggggtttctttgtaccatgggcactatgaccaacggattcaccagactcaccgagcagttcctcgtccacatcggcgtggagcgagggctcgccacggccaccgtcaccgcctacgaatccgacatcgccaaatacattgattggctcgaaacccgcggcatccacgaaccggacgccataaccaaacaagacgtcgaagactacatcgccgcccttgaccaggcgggggagtccgcccgctccaaagcccgaagactggcctcgatccacgaattccaccgtttcgcgctcggtcagcacgcggtgacggcggatgtttcggccgcagtcaaggcgcccaaaggcgccagcaccctgcccgacgtactcaccgtggacgaggtaacccgtctgctcgacgcggcggcagtcggcggctcaaccgatccggtggtattacgggacaaggccctgctcgaattcatgtacgccaccggctgccgcgtctcggaagccaccggtgcgaatctggacgacatcgacctggacaagcacatcgcgcgactcatgggcaagggctccaagcagcggcttgtgccattgggcagttacgcatgccgggccatcaccgcatacctcaatgcggggcgtggcgagttggaacagcgctccagcgccaagattcccgagaggcgcgcactgtttctcaacaaacgcggcaagcgcatctcgcggcaatcggtatgggaaatcgtcaaagcaaccggggagcgggccggcatcaccaaaccactccatccgcacaccttgcgccattcctttgccacgcacctgatccaaggcggcgcggacgtgcgcaccgtgcaggaactgctcgggcacgccagcgtgaccaccacgcagatctacacgcacgtaagccctgaaaccctgatcgaaacgtatctgacctcacatcccagagcgcggtgagacacaccattttgcgacgcgtccgcccatagcggaatcgcggcgggggagcaccaaagtcggccggaaattcaaggcgtgacaatacagtacataacagcgaaccgtcagccaggaagaggtattcatgctgcagatcaaatcgatctcgaagcgctataaaaccggtgatttcgttcagcaggcgcttgacaaagtcagcctgaacctacgcgacagcgaattcgtcgcgattctgggtccctcgggttccggcaagaccaccttgctcaacatcatcggcggcctcgaccggtatgacgacggcgatttggtgatcaacggcatctcgacgcgccaatacaaggatcgcgattgggattcgtaccgcaaccacaccatcggcttcgtgttccagagctacaatctgatccctcaccagacgattctgtcgaatgtcgaactcgcgctgacgatttccggcatcggcaaggccgaccgtcgcgaacgtgcgcgcaaggcgctggagaaggtcggactcggcgaacacatcaacaagaagccaaaccagctgtccggcggccagatgcagcgcgtggcgatcgcccgcgcactggtcaacgacccggacatcgtcctggccgacgagccgaccggcgcgctcgattcggacacgtccgtgcagatcatgaacctgctcaaggacgtggccaaagaccgcctcgtggtcatggtcacccacaaccccgaacttgcggaacaatatgccacgcgcatcgtcagcctgcgcgacggcgtgatccgctccgactccgacccgttcgtcgtggacgagacggccgaacagccggccgtgtacaagacgatgggccgcgcgtcgatgtcgttcgccacgtcgctggcgttgagcttcaacaatctgaaaaccaagaaggcgcgcaccctgctgacctcgttcgccggctcgatcggcatcatcggcatcgcgctgattctatcggtgtcgactggcgtgaacacatacatcagtgacatccagcgtgacacgatgaccgcctacccgatcaccgtcgactcccagaccttcgacctgagcagcatgatgggcggacagatgggcggcgatgacggatacggtggtaagacgcacaaaaccgacggcatctacccggacgaccgcagcgtcaagcaggcgtccagcctgaccagttcgattaccgaaaacaatctgacccgcttcaagaaatacctggataattccaagagcgagattcaccagtatgtgggttccaccggcatccagtacacgtatgacgtgaaattctccgtgttcgaccacgaccccgatggcacgctggtcaatgcggacggcgtgacgatcggtgccagcgattccacttcaatggcctcgcagatggcgtccacaagctcgtccggcatgtccggcacctcgtcgatcacctcgcagcagatgtcgatgctgaccggcaaaaccgatgagaacgccgcgcccgactcgttcaacgagatcatgccgggagcggacgacagcaagctcgtaggcaaggtcatcaccgacaactaccaggtggtcaacggttcatggccgaagtccaaggacgaggtggtgctggtgcttgacgacaacaacagcgtgccgctgaccacgctgtacgagctcggcctgctgcccgcctccgattaccacgagatgatgtccaagcttaacgccggcgacaaggtcagcactccacaagacaagatcgactatgctaaggccctcgatcagacgctgtacatgattccggcatccgaccagtacgtcaagggcgatgacggccactaccgtttcatcggcaacgacaaggacgaaatcgaacagcgcctcgaaacggccaccaaactcaaggtggtgggcgtcgtcaaggcgaagaaggatgcttcggccacgccgttggccgctggtgtggggtacacgcgcgctctgaccaatgatttgatcgaccgtgcggcctccagcgccatcgttaccgatcagaaggccaacccgaacacgaacgtgctcaacggcatgacgttctcgccctcggacgatgccaccaaggtggccgacgcgcgcacctacgtggcttcgctgggcgtgacgcagaaggcgaacatggccaagtcgatgatgagcgccgggcagcagtccggcacgggcgcatcggacgccgctggtgctggtgctgcaggtgtcgctggcgcggcgggtgccggcgatcaggccgccgccatggccgcgatgagcgaacagcagctcgccgacagtttcgacgcgtatatcgccacggcttcgaacgacgtgcttgtcgcgatctacgaccagtacgtgtcgaccggcacctacgacgacaacctcgccgcattcggtgtggtgagtcgtgacgcgcccagctcgatcaacatctacgccgacagcttcgaagacaaggaccacatcgccgacgcgatcaccgactacaacaacaccgtctcgaagaaagacaagatcacctacacggattacgttgggctcatgatgagttcggtgaccaccatcgtcaacgtgatttcctacgtgcttatcgcgttcgtgtccgtctcgctgatcgtctcctcgatcatgatcggcatcatcacctacatttcggtgctggagcgcaccaaggaaatcggcatcctacgcgcaatgggtgcctcgaagcacaacgtatcccaggtgttcaatgcggagaccggcatcatcggcctatgctccggcctgttgggtgtgggcttgaccgtgctgctcaatattccgatcaacgccgtgctacaccacttcatcggcaatgcggacgtcaatgccgccctgccggtgaccggtggcgtggtgctggtgatcctaagcgtggtgctcacgctgatcggcggcctgattccctcgcgtaaggcagccaagcaagacccggccaccgcactgcgcaccgagtaagcgcatcgacatagtacgagacgagatccataaacctcggaacactggaataccagcggcaaaacggtgttccgaggcgagcccggcgagtacattaggatgggcgagcaggtattcccgacaaagggggcgagggcaacgatggacgactggcgagatacccgcgataaagacagcgcattccgtcaaggaacgctgcctatgacaggaacgtatgtcgttgcacccccagcgaacccggatgttgataaggtagacagtatgcctaccgatttgcttggacgtgaatacgaaaccttccccgcacccgaaccgctgcaacagcacggtccggcgcgtgtcattgccatgtgcaaccagaagggtggcgtaggtaagaccaccagctccatcaatattgccggtgcgttggcccagtatggccgccgcgtgcttatcgtcgatttcgatccgcagggtgccgccactgtgggactgggcgtcaacgcgaataccgtggagaacacgatttacaccgcgctgttcgatatttccgtggacccacatgatgtggtgcagcacaccgcattcgagaacatcgatgtgattccggcgaacatcgatttgtccgccgccgaggtccagctggtcaccgaagtgggccgagagcagatcctgaacagcgtgctgcgcaagctcaagtcggaatacgatctcatcatcgtcgactgccagccatcgctcggcctgctcaccgtgaacgcgcttgccgcagctgatggcgtgatcattcccgtggccgccgaattcttcgccttgcgcggtgtggccctgcttatgcagtccatcgaaaaagtgcagtcccgcatcaatcccgcattggaagtggatggcgtgctcatcaccatgtacaccaagacactgcactgcgaagaggtctgccagcgcgtttacgaggcgttcagcgaaaaggtgttccacacgttcatctcccgctccatcaaactgcccgattccacggttgccgccgcgcccgtggtggtctatgcccctgagcacaagacatcaaaggaataccgtgaggtggcacgtgagctcattgctcgcggcatcgtggcgtaacgattgtttcgataaacgatgaatgagacttccctttctcggctcccctctctgagggaagctggctcgcgtagcgaggctgaggggagctccgcggaagccgaaatcagcacggaggaatccgccacttccggcttccgggtcaacctcgaagtctattccggtccgtttgatgccttgctcggcatgatcgccaacaacagactcgagctgaccgaagtttccctctcctcgatcaccgaggaattcctgacatacgtgcgcgggctcgatttcacaaaaaacatggatgaggccagcgcctttctcgatatcgcctctattctggtcgaggccaaaagcgtggcgattctgcccggcggcgaagacagccagcacgacgagcagagccttgaagcgctgcgcgaacgcgatttgctgttcgcccggctcctccaataccgcgcctacaagcaggccgccggtgatttccgggcgcgtatcgccgccaactccggccgattcccgcacccggcggccatggacgagggtgttgccgccatgctgcctgagctggtatggacgctgactccgctcgaactcgcccgactggccgcccaggtcatcgccaacgcgcccgcctccgaagtgtcgatccatcagctgcacgtaccgttggtcgatcttcgggcccaatcgctggtggtgcgcgaccggctgatcgcggcattggaatcccagggcgaccagtcgatgtcgttcagcgaattgacccgggactgcgcttctcgtattgaggtggtggctcggttcatggccgtgctcgtgttcttcaaacaaggtgtgctgcagtatcagcaagatggtccgtttgccgaactgcacctgaggtggatacccggcgtagccgaaacgatgagcgacgtgaacatttccgaaggtgattttgcgtaaggacggcgattggtgactgaacagattgacgcaacgaatacaaccgaacacatggcggatgccgaatcgacggctgaatccgcaaaggccgcggtgaggggagtggaggagacgcgccccgaatacgtggatttcgcggtagacgattttcccggcgggctgcccgcctgtctggaagcgattctgatggtcgccgaccagccgcagaccgccaccgagctggcccgtattttggcattggatcgcaacacagtcgaagaggcattgcgagccctgcacgatgactatgagggcgatgaatcccgtggcatccgcccgcgcggcttcgaactgcgccgcaccgctcgtggctggcagttcgccagtcgcgccgcgttcgagccggtcgtctcatcattcgtcactgacggccagactgcgagactcagtcaggccgcactggaggcgcttgccatcgtggcctatcgccaacccgtcacccgagcccaagtggccgcgatccgcggtgtcaactccgatggcgtgattcgctcgctcacggtacgtggccttatcaaggaagacggcgtggaccccgaatcccgcgcggccctcttggtcacctccgaattcttcctcgaccaaatgggtctgaagagtctcgacgaactaccctccctagcgccattcctcccgtccgtcgccgaaatgacacagtcgaaatcggaagatacggacgtgatttcgtagcgattggggcccgctgcctgaccaatattcgtgcgctagaccatccgatatgtgatttatggtcattgtgactataagtagtgctatgctctcaatgcagggagaacaaccggtatggaaagaggcatggcatgggattcggcaatgtgtccgagcgctgcagcgcaccgccacaggtcggcgtgtcagtggtgattctggcactcggcccggaaggcgataccggcaacagtgccgccgattccggcaacgccgcgaactcggcccattcccgtctctggttgcccctggtcaagcgcgtccgtcagccgttcctgggctgctgggcgttgcccggcggtgacctgcgctccgaccggtcgttggaacagtctgcctacgcggccctcgaatcgaccacagacctgcacccgcgatacctcgaacagctgtacacctttggaggcccgacccggtcccatggcggattgcccatggtatccgtcgtgtactgggcgctcgtcggccagaccgaggccgcgggcttcgaggacggtgacaacgtacgatggttccccgaagacgaactgcccgagctggcgttcgaccatcgccagatcatcgactacgcgctgctccgcctgcgctccaaaatcgaatactccgacgtggccacccgactgctcggccccacgttcaccctgcgccaactgcacggcgtctatgaggcgattggcggcgaacccctcgacttggcgaacttccgccgcaaaatgcttgcctcgggcgaccttgaagacaccggggagaagatgcgtgaaggccgccaacgaccggccaccgtctaccgctacatccccaaacgacctgtcgagaacggtacgccccacgaatccgatggcgacgacatcatggaactgtccagacaaggcgagcgtgaagacgctctcgacgcgctgatcccatccgcgcgcatctgatttttcccgccgacccgattcgggccggcatcacagacgtatataggaaaggaaccactatgactgcactattcactgcgccgtccgttgacgagatcatcgccaagctgggcgcgcaaagcacctgcgatgcaggactgacccaggacccatggcacttcgacaccaccacacccagctacggtcccggtgcctcgatgctcgaccgtctgcccgccaacgcgccgcgccagcaggtgctgccggacgaataccgcaaggcctccgacgaggaactgcagcagcgcatctccgacgccaagcagcgtctcggctccaaactgttgattctgggccacttctaccagcgtgacgagatcatcaagcacgccgatttcgtgggcgactccttccagctggccaagaacgccaccgaacgcccggacgccgaccacatcgtgttctgcggcgtgcacttcatggccgaaaccgccgacatcctctccacgcccgaacagagcgtgaccctgcccaacctgtctgccggctgctcgatggccgacatggccaatatcgaccaggtccaggaatgctgggaccagctcggcgagatctgcggcacccagccggactccgatggcttgcagcagatcatcccggtcacctacatgaactcatccgccgcactgaaggcgttctgcggacgcaacggcggcatcgtatgcacctcttccaatgcgcacgccgtgctggaatgggcgttcgcccgcggcaagcgcgtgctgttcttcccggaccagcacctgggccgcaataccgcccgcgccatgggcattccgctgagcgagatgccgctgtgggatccgttcaaggcacagggcggcgccgccgatccggccgattacgcccgcgccaagatgattctgtggaagggcttctgctccgtgcaccagcgtttcaccgtcgaacaggtcgaacgtgcccgcaaggcatacccgggcgtcaaggtgatcgtgcaccccgaatgctcgatgcaggtggtcgatgccgccgacggtactggctccaccgcgtacatcgtcaaggagatcgccaacgcgcccgccggatccgccattgcggtgggcaccgaaatcaatttggtgaaccgtctggccgcgcagtacccggacaagaccgtgttctgcttggaccccgtggtctgcccgtgctccacgatgtaccgcatccacccggcctacctggcttgggctttggagaacctcgaagccggcaacgtggtcaatcgcatcaccgtggacgaagacaccgcccgcgaagccaaggtggcactggagcgcatgctgcgcgttcacccgtgattcgtccctggcgctcctcgtacatgaggggagctgtccgcgtagcggactgaggggagcagatgacgcaaaaacagaggaaagcaacacaatgagcaacactgaaatcgtcgtcgtgggcgcaggcgtcgccggactgtccgcggcactggccgtggccggtaccggacacgacgtgaccttggtaaccaaggccgaactggtggaatcaaacacctatcatgcgcagggcggcatcgccgcggccatcttctccgacgacgacccgaagctgcacgccgccgacaccatggccgcgggccacggcctgtgcgacccgaaggccgtggacatcctcacccgtgagggtgcggagcgcgtccgcgagttcgccgcggccggcgtccacttcgaccgcgacgcgcatggacacatgctgcgcggcctggaagcggctcattcgcgcgcccgcgtggtgcatgccgggggagacgccaccggcaaagtgtttgaactggacgtctccgccatggtgcgcaagaacccgcgcatccacatcatcgagaacgccttcctcaaagatctcatcgtgcggggcggccacatcgccggcgtccacctgctgatcgacgggcaggacaaggatctggccgccgaccgggtgatcttggccgccggtggagcaggccgtatgtacccgtacaccaccaatccgccggtcgccaccgcggacggcctcgccgtcgcatggcgtgccggtgcccaggtcgccgatctggagttctaccagttccatcccaccgccatggccgtgggcgagcacttcctcgtctccgaagccgtgcgcggcgaaggtgcggtgctgctggatgagcatggccacaggtatatgaaggacatcgatccgcgcgccgaactcgcgccgcgtgacgtcgtggcccgcgagaacttccgcgtgatgcaggcgcaaggcggcaagcccgtgatgctcgacgtctcgccgatggcccgcgagaaccccgacctggccagcttcttggcccaccgattcccgaccatcgacgcctatacgcgttcgcttggcttcgactggagcaaggagccgattccggtggcgcccgccgcgcactactacatgggaggcattcgcaccgatctgaacgcccggacctccattcccggcctgtatgcggccggcgaatgcgctcgtaccggtgtcatgggctccaaccgtcttgcctccaactcgctgctcgaggggctcgtctacggacgccgcgccggtctggccgccgtcgcggacggtgacgacgcggtctgggcacccgaaccgttcctgaactccgccaccggtgccgtgttcgaccatgcgccgatcgcgctggccgcccctgccgctacggctgctgctgacgataccgccgccgacaaggtgtggaatcgtacccgcatccagaacaccatgtggcatggcgtcggcgtgctgcgcgacgaggccggactgaaaaccgccatcgccgaactcggccaaggcctcgccgccgcaaacgcccaggctgatgtaaacgccgatggtgctgcaagcagcgttgaggctttggagaaccgcaacatgctcaccgtaggctatgtggccgccaccgccgcgctcgcccgcaccgagtcgagaggcgcccacgcccgcaccgaccacagcgagccagtcgacaactgggcccactccgtcgcctacatcaaggactgacccatgctcacatcacacatcatccgcgtcgccgtcgaagcggcgctcgccgaagacgcgccctacggcgacatcacctgcgagaccaccatccccgcggacgaaaccggctcggcccacctcaccgcgcgcgaaaacggcgtgatgagcggcatcgacgtgttcgccgcagccttcgccgcacagaacccggccgtcaccgtcaccgccgccatcaaggacggcgagcgattccagcgcggccagatactcgccaccgtgaaaggcccggtacgcgacctgctcaccgccgagcgcatcgccctcaacttcactcagcgcatgagcggcatcgccaccatgaccgccgccttcgtggacgcggtgaacgccatctacggcgatgattatgacggacccgtcacccggccgcgccgctacgagcgcacccgcatcgtcgatacgcgcaaaaccacgcccggcctgcgcccgttcgagaaatacgccgtggtctgcggcggcggccacaaccatcgttacggactgtccgacgcggtcatgatgaaggacaaccatctggcggcgctcgccgcgcgcggcatcgacctggccggcgcgatccgccacgtgcgcgaacaggtgggccacaccacgcatatcgaagtggaagtcgaccgccttgaccagattcccgccgtgctcgccggcggagcggacaccatcatgctggacaatttctcgctcgacgacacccgtcgcggcgtggagctcatcgacggtaaggccatcgtggaagccagcggcaacatgagcctggagcgagtgccagccgtggccgtcaccggcgtggacgtgatctccgtgggcgcgctcacccactctgtgcgcagcatcgacctcggattggattggaactagtcatggccgatacccccaacgcatccggtgaacccggcgaactgtacctggacgccgccgccaccgaatcagtgagcccggcagtcatcgaggccatgaccccgttcctgactgaggcctacgccaatccggccagcgtgcaccagcccggcaaaaccgcggcccgcgcgctggacgcggctcgcgcatcatttgccgcggcattgggcgcccggccggatgacgtgatcttcacctcaggcggcaccgaatcggacaatctggccatcaaaggcatcgccatggcgcgcatgcgcaaactgggcttgcggccggtctgcggattcgccgaagccgatggcaaacagccggcaaattgtcgcccgcgcattatcatttccgctatcgagcacccggccgtggcccaatcggcggcatggctgcacgaatggttcggtttcgaagtcgtgcgcattcccgtggatgcgcaagcacatctcgatctcgacgcacttgaacgcgagctcgacggcgaggccagtgaacgtaccacgatggtctccaccatgctggccaacaacgaggtcggcaccgtggaacccgtggaggaactggtccgcatcgcccacgcgcacggcgtgcccatccatgtagacgccgtacaggccgccgggcagattccgattcgttttcgtgactgggatgtggacgccctgtccgtatccggacacaaattcggcacccccaaaggtctgggagcgctgctggtacgcggccgcacacccatcgaaccggtgctgtccggcggcgggcaggaacgcggcctgcgctctggcacgcagaacgtggccggtgccgtggcgctcgccatcggactcaacgaatcgaatgcgcgcatgcaggcgcagtaccgtgagttggtcgcgtcccgagacatgctcatcgacgcggttcgccgggtcgcgcctcgcgccgacctgaccggcgaccccgaacgccgtctgcccggtcacgcctccttcatcttccccggcgtcaccggggaagcgctgctcgtcgacctggacgcgcgcggcatcgctgcctcatccggctcggcctgcgccatcgggcgccacgagattcccgccacgttgctggcgatgggcctcgaaccgtccatcgccaaatcggcattacgcatgaccttccgcaagccgctgacccgcgaacaagtcgaacgcatcagcttggccatcgaagagtcctacaccgacctgacccgccattaaatctgacgccacttaccagaaaggaaacgacgtgagcaccaccacttcagcgcaacccgcgcagctcacccgcaacgagcgcctcgaccggctgcccttcaacaaggcgcaccgcaaactcctcgtcgcctccggcatcggctgggcattcgacgccatggacgtcggcctcgtctccttcgtagtcgccgccatcgccgccgacccgcacttcaacctcaccccgaccgaaaagtcatgggtgctgtccatcggcttcgtcggcatggccatcggcgcggcagtgggcggcttcatcgccgaccgcgtgggccgcaaaaccgtgttcaccgccacactgattatcttcggcatcgccaacggtgccatggccctatcttggtcactcggcatgctgctcggcgcccgactgatcatcggactgggcttgggcgcggaactgccggtcgcctccacgctggcctccgagttttcgccgaccaaacagcgcggccgcatgactgtgctgctggaatcgttctgggccgtcggctggatcgtcgccgccatgatcggctacttcgtgatcccgaacaccggcgactggggctggcgctgggcgctggccatcggcgcgctgccactgctctacgcaatcgtcacccgcgtgcacatcccagaatccgtgcgattcctcgaagccaagggtcgcgaagacgaagccgaaaaggccgtgcgctacttcgaggaagccgggggagtagccccggtaacctctcccaagggcaagccgctgccgaagatcaagacgcgcgaactgttcggctccaagtacctggcccgcaccatcgccatctgggccacgtggttcttcgtgaacttctcctactacggcgcgttcacatggatgccgtcgctgctcgccgaccagttcggctccctgaccaagtcattcggctacacgctcgccatctccatcgcccagctgcccggttacttcctagccgcctggctggtggaggtctggggccgccgcaagacgctgagcatcttcctggccgtctccgccgtggccgccttcgcgttctcgcaggccggatctgtggccctcgtgctcgtgttcggcatgctgctgtccgcctccaacctcggtgcgtggggcgtgctgtacgccgtgaccccggaaatctacccgacccgcctgcgtggcgcggccgccggtgccgccgcagcggtgggccgcatcgccgccatcatcgcgccgctcctcatgccgtggttcctgaccctgtccggcggcaacaaggccgtggccttcatcatcttcgccgccgccttcatcctcgcctgcatagcagccctctgcttgcccgagcgcaaaggcctcaatctcgaagactgattacacttcagccttcgctactaaagtggcccacaccaatgtgtgggccactttttgtcttatagctcccgaatgacacggcaagggttgccgtatgtcactgatcaatcgagggaacgacgggtgagattgcgcggtggttttgtgaccagccacgccaccagcagtccggttaccactacgccgaatgccagcgccgcctgcaatccccagatcggcacggtttccagccaatgaccgtccacaccgatcctgcggttccatgccacatgcagccatcccaacgccacgccggataccacgcccactggcgcgccggccagcagaatcaccgcagcctgcgtcaggccgtaacgtctgaggaatcggggtggcgcgcccacggcgaccatcgtggccatgtcgcgctgggcctgcgtgcgggccagcagcagtgaaacgagcgtggccatcagtgccagcaatgccaacaggccaatgggcaccaatgccatattgtcaccccacggcaggcgattcccgtcagtgctcgtggatgccagcggcagattttcgattgcataagctgaggccttctttacggtaacgggggagttgccaccggcgaagtctagatactcacccagatactgcaattgtttgatgccgagcgcctgtgctgttgccgggctcatcaccagcgggtacgcgccgcgcacgtagatggccttgcgcttctcgatatgtgtggcctgagattcgtttgcaattgccggattcggcgaaatggccacacgcaccatacctcccgcgtcgattgtgccggcatcgccgaccaccacaccgcccgcgtcaagcacctgtgccgcctcatccgcgttcgggaagccggacaaacgcatcgcattgccatccataatgagattcacgccgcggaaactcggcagtatattcgaatacgttggctgatgggatcggtctatcggcacacaacgtatcggaacgtttggatacagggccgaagcggcatcctggcccacccatgtggacgtgtccggttgctcttggatcgttgggttatcacaagtgtgaccggccgggagcaatgcagcggcatacatgtagccgtgttcggcgttcaacttgtcggaatcgacttcggtcgtatcattgagctttgaccatcgcttgacatcctcggtgtacaccgggtaatgagcgcgtatcggcgtctctttgccaagccggcgtatcgcatccgacaccacagcacggtcgaactcattgctgacatgcacgtcggccccaatggccatccccgacggtccatacgtcatcgtcatcgtggaatttcgctggtccgccaccatggagccggtgattaccagtgtgtacgaggcgatgcacatggtaatcagcaccgcgcatgccgccggaacgaaccgtcgatgatgctcggctgcatccctgagtgccaggcgtgcgccgatgttcagttgggaactcgctttgccgcaccaccgtgcaaaagtgcgaatcgacaacgcaagccctatgacagccaacaaaatcgtggcaacaagcagagccatatgcgcttcggttccggccggaaccgcgcccggattgtgatcggccagcgtgggcaatggcaatgtcagactgagcgcggcgcatacgatggcggccaagaccagaatcggaccaaccgcaacacggagcagtctcaaaggattacggcgaagcttcgtatccacgccattcgcggattcaccgtagccgatttcctctcttgtcgggcgatccttcaacgcatcgactggatgcatacgcgccacatgccgagccggcgcaatcgtcgcggcaaatccaatgatgattgccgtggcaatacccatcggcagcgagctccacgagaatccgtgcaggatctccagcggcgtggatccacgcaatgcgcctatcgcagggccggccgccaaggtaagcgcgaatcccaatgccgagcccagcacgccaccgatggcgccgataacgagaccttgcgaggaaatgattcgactgaggtcacgtggtgcagcaccggatgcggccgcgagcccaagcacacgacgtgactgatctgccgacaccgtaaacgcgggcgtgactagaaacagtaccagcaacatacccaccagcatgatgatgaccacagtgaccatgtggttcaacatggtagccgcatcgatctgcatcgggtagagctgcgatgcgggcggatagccgtcagtcagcacatggcgggaaatgacgatggcctgcaacaggttcatgctgcgggtgtgcgcccacgtgaccggctctggaccgaccaccaaataatggccatccacgccgacgccatcagattccaatatggctgacatccagccttccaagccccatgccgcggcttcggattcatcggtcagcccgctgactgtccaagcacgctgagtgtcggccaccgcctcgccgatgcgcccgtccaggctcatccagccatcgaacggcggagcgacgaacgtcaccgtgctaccgagagaagcgccgagattatccgccaatgtgcggctgatgacaatctgcgtattattctgcggcgccgaacccttgaccagcttcggcaacattcgttgcaatgcctcaggtgaagcctcggtcatggtcgcggtggaggccgcgttcagatcaatgtcattcccgcttttcacgtcgatcccagccttggtctgttcgccgggttgcaacgcggtgccggtgatggcgatgagttcgggcgactgccaatacgggagcagccgatcctgttgcggcagaatcttcgcaagctcggcggccgaggccggctgctgggagggatcgtcctgccacgtgccgccgctttcgggtgactgccggaacggttggccggtgcggggcctggcggtggcggtgatgaccgcctgcgtatcagccgggattgtcgccagcgcacgcgatctggtgggcggtatggtggtggtcataccgatggaggccaccattgcggcgattggcagcattaccagcagcaaggacagtagggtgcgggccttgtgccgtagtgcgtcgcgccagccgagtcgcagcgcggcccgataccggttgcaacgtgcgccaaggcttggcctagcggcatggggaatttgggcagagcggccggcggtggcattggcaagattattgagggctgcgcgtgccatcatgctcccctttcctcaaggttgagcaaatcatccatattgctggagccggtttcatcgatgatacagccgtccttcaaaaacaccgtgcggtcggcccaggcggcgaagcgaggctcatgagtgaccagcagtacggccgcgccgcgatctgcgcgggtgcgcaacacttcgagaatcgtcatgccggcattggaatccagagctccggtcggctcgtcggccagtagtagacggcgtgggccgaccagtgcgcgggcaatcgccacacgttgcgcctggccgccggacatgtcttcaggtcggcgatcagccatatcggctactcccacttcattgagggattgcatcgcggcctcacgtgccttgcggggattccagccatccaattccaaggggaacgacacgttctcggctgcgctcagggaaggcagcagattgaaatcctgaaacacgtaacctatcgatttgcggcggatggccgcgcgttcggccactgacagtgtggccagatcgcggccttcgaccagcacgtgcccctgcgtgggcacatcgagcccgcccgcaagattgagcaaagtggatttgccggaaccactggggcccatgatggccacgaattcacccgggcgaagcgtgagattggcgtgactgagcgcggtgacacgacgtgcatctttgccgtgaacgcgagtgacgtcgtgtaattccagcgcgcatggggaagattgcgggagagaagaaagaacgggagaagtcatgatgtgctcctatgcactattgaatggtggcggtgagtgcggctgagcttgccgtgagaggtgccgaaacggggtgctgcgccagttgtgctcgcagctgggtctcatccacggtatcgagccagcgcaattccgcttcagtgatgaaaatgtggtggtcgagtactagacgtgtggcgagttcggtgggcggtgtttgccggcgcagtcgggtgatgtcgtgcagcagttgctgcaaagcgtggcgttggtgttggatgagttcggaaacatcgaggccgggtatttccacggcgacggccagcttcatcaccagttcgtcgcgtccgcgttgttccggggtaatgggggagcgccaccatcggtcaagctcttgggcgccggaattggtcaatcgccataatggtgcggccgctgcggtgccgacatcattggatccgctagtagtcggcgcggtctcttcaatcagtccgtcgcggttcaaccgctgcagcgtagtggaaacttgccccatattgagcggccaagtcagaccgatggtgcggtcgaagtccttcttaagctgataggcgctggccgggcctcgctccaacagtgctaatagcgcttctctgattgccataccgcatcccctttgcatagacggtttgccttgggcgaaggttactgagtaactatcgttggatatcaggttactcagtaactacccatgacggtgctgtactcagggatgattcaggggagattcaggggatacacttggcgcccctcagttgcccacggcgacagctcccctcagggaggggagtcgagagtgtggaatacaaaaagtctcgcaagccagatgacatgtgactaattctcagaaagccgggcccgttgtgtgtcaaggtgtgccagtaacatcgtgacggtttgtgtgtaggtacaggttgatatccaagagcaagtactcgagaacgcaagtaccgaacgattacgcaaaagaatcagtattaagagaggtttcgatggcggttcgtggagatatccgtaatgtggcgattgtggctcacgtcgatcacggcaagaccaccctggtcaatgccatgcttcagcagtcgcacgtgttttccgagcgtgaggaagtgccggatcgtgtaatggattccaacgatctggaacgcgagaagggcatcaccatcctcgccaagaacacggccgtggaatacaccggtccgctggccgccaagtacggccacccggagggcatcaccctcaacatcatcgatacccccggccacgccgacttcggcggcgaggtcgagcgcggcatctccatggtcgacggcgtcgtgctgctcgtggacgcctccgaaggcccgctgccgcagacccgattcgtgctgcgcaaggccctggaggccaagctgccggtcatcctgtgcgtgaacaaggtcgaccgccccgacgcccgtatcgaagaggtcgtcggcgaaacctccgacctgctgctcggcctggccgacgacgtgcagcacgagggcatcgacctgaacctcgaccagctgctggagatgccggtcatctactgcgccgccaaggccggctacgcctccgtgaaccagcccgccgacggtggcctgccggacaacgacaacctcgagccgctgttcgaggccatcatctccaccatcccggcccccgaatacgaggaaggcgccccgctgcaggctcacgtggccaacatcgactcctccgacttcctcggccgactcggtttggtccgtatctacaacggcacccttgagaagggcaagacctacggcctgtcccgtgtggacggctccctcgagaacttccgcgtctccgaactgctgcgcacgcagggcctcgagcgcaccccggtcgagtccgcgggccccggcgacatcgtggccgtcgccggcgtcaacgacatcatgatcggcgagaccatcgtcgaccccaacgacccgaagccgctgccgctcatccacgtggacgatccggccatctccatgaccttcggcaccaacgactccccgctggccggcaccgagggcaaggaccacaagctcaccgcccgcatgatcaaggaccgtctggaccgcgagctcatcggcaacgtctccatcaaggtgttgcccaccgaccgccccgacgcctgggaggtccagggccgtggcgagctggcgctggccgtgctcgccgagcagatgcgtcgcgaaggctacgagctgaccgtcggccgcccgcaggtggtcaccaagaagatcgacggtgtggtcaacgagccgatggaaaataccaccatcgacgtgccggaagagtacatgggtaccgtcacccagctcatggccgaccgtaagggccgtatggacggcatgaccaaccacggctccggttgggtccgcctgcagttcaccgtgccgtcccgtggtctgatcggcttccgcactgctctgctgtccgccactcgcggcaccggcatttcctcctccatctccgctggctatgctccgtgggctggtgccatcaccattcgtcagaacggttccatggtttccgatcgtcagggtgtggccactccgtatgccatgcagcgtctgcaggcccgtggcaacttcttcgtcgaaccgcagtccccggtgtacgagggtcaggtcgtgggcgtgaacaacaagcccgacgagctggatgtgaacatcacgctggccaagcacatgaccaacatgcgttcctccaccgctgacgtgctcgaaaccctgaccccgccgatcaagatgagccttgaggagtccctggacttcgccaacgaggacgagtgcgtggaagtcaccccggagtccatccgcgtgcgcaagatcatcctcggccgtgaggactggtacaagtggcgcgccaagcagcgccgccagaacgccgcccagcagggtaagtgatctggtgcgactgtagccgaccattctctctggctcccctctctgaggggagccaagtttattcctcgccaagtcatatccccacctatactgaaacgcatgactgtgaagagcactactgaactgcgtccgtggtcgtatcgccagaacgcgctggtcaaatcgttgatcacgattgcggcgggcgtggcttccgcctttgtgggcacgttcgcccaccgtatgggtgcagaactgagtattccgtatggtctggtgctggcatttctgctgatcggcctatcgacatggtgcgcccgttcgcgcatgggcgcggtcggactggccctgcacctcatcgcctcctcgctgaccgcatggggcatggcactgaccaccacatccggcaaggcggtcatcgtcgccggattccaaggcgacatgccgttcttctcccagcatgccggctacatctggctgtacggcctgatactggtccaagtcgtcctgctcattcttcccgcccgctggttcgttattcccactcattctgaatcgcgcgcgtaactatatatggcggcacatttccgcgaatgcgtcgcgtatcggcgggcgtaggggattacggccgctaccatagaaccttatggcacgcatgaaactgttttacttgggcccggaaggcaccttcacccatcaggcggcaatgacggccgccgaccagttcgccacactcggcgacttcgacctcaccgccctgcccgacgtgcccgcgatcatgcaggccgtacagtcgcgccaaggctggggcgtcatcgcatgggaaaacaacgtcgaaggctatgtggtcccgaatctcgatgcgctgatcgacgcccccgacgcggccggcttcgcccggatcagtgtggacgtggccttcaacgccttcaccgtgcgcggccacagcatctgcgactgcaccggcaaccccgtcagcgcccacccgcacggcctggcccaatgcacccggttcatcaccgaacaccatttgcagcccgaacccgcatcctccaacgccgccgcctgccgcgacctgaagcccggccgcgtggcgctcggccccagcctctgcggcgaactctacgatctcgacaccctcgccgaacatgtgcaggatttcgatggcgcgcacaccgaattccttgtcatcgccccgcgtgaggtggtccaggagctcaacgcccgcgcccacagcaatgacgccggcgacttcgaaaccatcatcaccttcatcccgctggtcaccggccccggcgtactcgccgacctgctggacgtcctgcgcgatgcgggactgaacatgaccagcttcatctcgcgcccgatcaaaggccacgacggaacctacagcttcatcgccacccttgacgccgccccctgggagccgagattccgcaccgcgctggaagagatcgccggacacggcgactgggcaaaaaccctggccgtctacccacgccgcgaacgcccgaacccgccggtcgacgcctggatgctgcccgagggcggcgtccacatcaccaatcgcgcgccggaaggctggcagtacaccgaggaagcaaggaaggaactgctgtggtagatacagtcggaatcgtcggactcggattgatcggcggctcgctcgcacgccgcctgaccgagcgcggcgtgcgcgtcgtcgcgtggaaccatcgcccgcacccctacgcccaggccgaagccgatggcattttctgcaagagcacgctctccgaactcatggatgccgagccggatgtggtcgtgctgtgcaatccgctcaaggcgatgcccgcaatcctcgccgccctggccccgctcatgggcgaccatccgaacaccacgctcaccgacgtgggctcggtcaagggcatggtccgcgatcaggtcaaggctgccgggctggggaagtgctacgtcggcgcccatccgatggccggcaacgaactgtccggctggcaggccgccgacccgcatctgtacgacggtgccctatgggccatcaccgtggacgagtccacggactaccgccgcttcctcgacgtcgccgcgatgatcaccaaggacgtcggcaaccgcgtcatcgtcgtggacgacgaaacgcatgacaaggccgcggcgatgatctcccacatgccgcatgtggtgtccaccgcgctgatcaacgaactggtcgccaacccggaccgcaacatcgccgccgcgctggccgccggctgctggagggacatgacccgcgtgtccctgaccgacccggaccgcacgcgcgcgatggtcgaggaagactcgctgaacgtcgaagcgctgctgcgccgcatggcggcacgtctgaccgatatggccgaccaactgcacgctggtgccgccggcgagcaggatgtgatgggattcttcgccgaaggcgaccccttccgccggtacaaggccgccgtgacacatgccggcatcaccgctgcacaagacggtacggccaccgctgcgccgcaagccggcacaactgccgccggattcccggaacgcgagctcgccgtccccgaagccggctggcagcagaccctgctgttctccgcacgccgaggagaagccatcaccggcttcgcccatccacgtcaggccatcatccaactgcgccccgccatgtaactgcgtaccgccatgtaggcccgtgcgcaggttcccctcgccgcctgtcacgaagaaggccgcgcgagggggatgaagttcccgcttgttttcgtgagaagaccgtgtggctccgctgttcgaaaggctcaaaggagtaaggtagtctgtaccgtttttcgggaaacgcatcgaagttgatgcggcgaatggttaagggggatgatgacgtatgacgttaccaaggcagattccggccggtgcccgcgtggtggtgcgcatcaccgacggcattgacccggtcgaccaccgtatgaagttccgcgactatgtgggtcacgtggtttcctgggacggatacacgttggagatggtgcgtgacgccgccgccaatggttcgcgcccggcccagaacgtgaccatccatcaggaacagattgccacattgaaacccgtgccggagcggcgcaacacgccaccccggccgtaacccaaggccataaagaattcggaggagaacgagagtgtcatctacgcagttcgacggcgatatcgactccttcgtctcctatctgaagtccaaccgcggcctgtcagcgaatacgctcaaagcgtatcgcgcggatctcacggcatgtctgcacctgttcgagctgcgcggcgtgaccgatctgaacgagatcacgctggatgatctgcgtagctggatggcggtggaatcgcgcgatcacgcccgcagcagcatggcccgcaaaaccgtggccgtgcgcgggttcttcgcgtgggcctatgagcatggggtgaccaacaccgacccggccgccacactgatgactccctcgattcccagcacgctgcccgcggtgctcaccgaatctcaagctgagcagttattggatgtcgccgaacaggccgttgcaacaaaccagtacaagggcgatgggggagcggcagccgcgtccggcagtggcagcggcaaggcagtcggcaagacagctgataagtcagccgacaccgtaaaccgcaacgaggcacccgcccgtgcagacaagcgcgacagcgcccgagtcgtcgccgaatcgcagcgcaacgccgcgattctcgaactactgtatgccaccggcatccgtgtcgccgaactggtgtcgatggatatcgttgacgtcgacttctccaatcgcaccatcaaagtcaccggcaaaggcaacaagcaacgcgtggtgccgttcggactgcccgcccagcgtgcgctggagacttggcttgaacaagggcggcctgtactggcccgtacggcaacggatgcagccaagtcccgtgctaccaacgccctgttcctcggcgcacgaggcggccgtatcgaccaacgcatagcccgtgacatcgtacacagagcggcccgagaggccggcgtaccggacatcagcccccatgcgttgcgccattcggcggccacgcacatgctggacggcggtgccgatctgagggaggtgcaggagatgctcgggcattcctccttgaaaactacacaacgctatacgcacgtctccatcgagcagctcaagaaccgttacggacaggcctttccccgggcatgaccactatgtgggcattggttaacaaacttagcaaagactgaacctagccggtaaaagcccccgaattttacatgggtgtaacaaaaatacgctgcttgtctcccaagtgcgcaaaaatgacaggtaacagcaacggggttgggtgtccgaagcggcgggaagcgtaagtgtcccgacgatgaggaaatccgaccccgttcgcatgaggcgaggctgaaacgcttcgcaacctaatgaataggagaaatcatatgaagaagaaagctcttgctttcgctgccatggcttgctccgtggccatgctgctgagcgcctgcggcggctccaacagtaacgctgcctccggtgacaccgctggctccaacatcatcactgcgtacaactccgaaccgcagaacccgctgatcccgggcaacaccaacgagaccggtggcggcaagccgggtgacctgctgttctcccgtctggtctccttcgacaaggatggcaaggcttccaacgaagtggccgagtccatcaccccgaacgatgacgccacccagtacaccatcaagatcaagtccggctggaagttcaccgacggcaccccggtgaccgccgagtccttcaccaaggcctggtcctacgtggccaacgtcaagaacgcccagaagtgctcctccttcttctccaccatcaagggctacgatgagctccaggctgatggtctgaagggtgacgagcagctctccggcctcaaggtcgtggacgacaccaccttcaccgttgacctgaaccagtccgactccgtgttcccgatcaaggtcggctacctggcctttgccccgctgcctgagtccttctacaaggatccgaaggccttcggcgagaagcctgtctccaatggcccgtacaagctggaccactgggaccacaacaaggaaatcgccctcgtcaagaaccctgactacaagggtaacgagcagcccaagaacgacggtgtgaccttcaaggtctacaccgacgactccgccgcctaccgcgacattcagggcggcaacctcgacgtgatggattccgtcccggccgccttcaccaagaccttcaagactgacaagaaggtccaggcttactccgaggccggctccgttatccagaccttcaccatcccgtcctcccttgaccacttcaagaacgacgaggaaggccagctgcgtcgtcaggccatctccatggccatcaaccgtgaccagctcatcgacaaggtgctcaacggcaacgccaccgccgccaccgagttcacctccccgaagaccccgggctactctgactccctcaagggtgccgacaacctgaagttcaacgcctccaaggccaaggaactgtgggccaaggctgacgccatctccaagtacgacggccagctcaccttctcctacaacgccgatggtggtgccaagccgatttacgatgctgtcgtgaaccagctcaagaagaacctgggcatcgacgcggccaccaacccgatcccgaccttccaggaattccgtgacgccgtcaccaaccgtcagatgaagggcgccttccgtaccggctggcagcctgactacccgtccgccgagaactacctgtggcagctgtactccaccgctgctgctgatggcaacggctccaacgatggtgactacaagagcccggccttcgatgacctgtgcaagcaggccgctgccgcttccagcactgatgacgccaacaagctgtaccagcaggctgaggagatcctcctcaacgaccttccggccatcccgctgtactactccaacgcctccggtgtggcttccctcaacgtgaagtccggctacgccttcgattggcagaacctcccgacctacgccgagatgtccaagaagtgagtctgactcactgaacggataccgttaggtagttcggaaataaagggcgaggaccgcaagatccccgccctttttgttgtgtgagggtgcttgctcccgccagcgggaaccaagttaaagtatccactatccgaccgcaaccatggacatatccaccggcattgcttactctcaaccttgcgttagcgcaaatttacatatcacagtccgggcatgcggtagaatgtcggagtatttatcgaccggcgggggcgtgctatgccctttctggccggtctaggaaataaggagcaaccgtatgggtaagtatcttctgcgacgcatcctgcagatgatccccgtggttctcggtacgacacttctggtctatgcccttgtcttcgccctgccgggcgaccccgtcaaggccatgttcggagacaagcctgtcaatgaggccgtcgcagcccagatccgcgcagaataccatctcgaccagccgttcatcgttcagtactttatctacctgaagaatgcactgaccctgaacttcggcgataccttcgccgggcagcctgttctcgacgaaatcgcccgcgccttcccggtcaccatccggctcggcctgatggcgttcgtgttcgaggcgatcttcggcgtggtcttcggcatcatctcgggcctcaagaagggcaagtggtacgacaccgtcatcctgatcgtctccctgctgctcatttccgtgccgaccttcgtcaccggcttcgtcatgcaatatgtctttggtattcagtgggcgatattgccggtgacggcaggcgcagacccgggcttcatcgacctgctcatgccggccatggtgctcggatcggtgtcgatggcctacatcattcgattgactcgctccgaaatctcctccaacatcgccgaggattacgtgcgcaccgcacgtgccaaaggtatgtcgaacggtcaggtcatgctgcgccacgtgctgcgcaactccctgattccggtcgtcacctaccttggtcaggacatcggcgccctgatgggtggtgccatgatcaccgagcagatcttcaacatccacggcatcggcttcctcacctaccagtccattctgaagggcgaggcaaacctggtggtgtccatcgtcacgttgctcatgctgatcttcgtggtatgcaacctcgtcgtcgacctgctgtacgcggccctcgatccgcgtatccgttacgcgtgatagggaggagtgagtcacatggcaaacgaaaccactgaaaacgagctcaaccagaccggcgagtcggaaaccgaatacttcatggaaaccctgcccggtcaggaccgttatgtagcccccctcgaggagaccccgctgcaggacgtcgattccgtcgatgaatccgcaccggccaccagcatgtgggctgacgcatggcgaaccctgcgccgcaacccgctgttcatcatctccggcttgctgatcctgttcatcatcgtggtggccatcgcccccggtctgttcaccaagcaggatccgaacgcctgcgatctgggcaactccctgagcccctccaccgccggtcaccccttcggcttcgacctgcaaggctgcgatgtgtacacccgcgtggtctacggcacccgtacctcactgtccgtcggcgtgctctccacgctgctggtcgtgatcgtcggtaccctgatcggtgccgtcgccggcttcttcggcggctggatcgacgcagtgctgagccgtatcaccgacatcttcttcgccctgcctatgctgcttggcgccatcgtggtgctccagatgtttaagacctccaagtccatctggaagatcgtgctggtgttgacgctcttcggctgggtcggcgtatgccgtatcgcccgaagcgccgtgctgaaatcgaagaacctcgaattcaacaccgcctccacggccctcggctccacgcctgccaggaatctgttccgccatatcctgccgaactccctggccccgatcatcgtcatcgccaccacttcgctggcctcctacatcgtggccgaagcaaccctaagcttccttggcgtcggcctgccgaccaccacggtgagctggggtggcgacatctccagcgcacagaccaacctgcagaccgatccgatggtgctgttctacccgtccgccgcactggccatcaccgtgcttgcgttcatcatgatgggcgacgccgtcaaggacgccctcgatccgaagagccgtacggcctgagcgaggggagtggagaaacattatgactgacaacaccaacgccaagatgctggctatgcagaaagagcatggtccgctgctcgaggtcaaggatctggccatcgacttcaccactgacaccggcaagccggtgcacgcggtgcgcgatgccaacttcaccgtctaccccggccagtgggtggccatcgtgggcgaatccggctccggcaagtccacctccgccatggccgtgctgggtctgctgcccggcaccggtcacgtggtcaacggctccatcaagctcgacggcgaggaaatcgccggcgccaagcagagcgagttcgacaagctgcgcggcaccaagatgggtctcgtgcctcaggacccgatgagcaacctcaacccggtgtggcgtatcggcacccaggtcaaggaagcactgaaggccaacaacatggacgtggctcacgaaaagcgctccgcccttgccaaggctctggccggcgacgaggtcgaagtcaagggcaacgacgacgagaccttcctcggcgccaaggaactgcccgagctcatgaccgaggccaagaaggctttgactgaagccggcgtgtccggcgaggccttcgacaaggccgtcgcccgcttcaccaacgaatgggttccgggctccgaaacccgttggcgcgtggccgacgacctcatcaaggccggcgtggccgacgaccaggcctggtatctggctaagaagtacgtcaccggctccacaatggatgaccgtatcgcgggtctgctgtccgaggccggtctgcccgacgccgctacccgtgcccgtcagttcccgcacgagttctccggtggtatgcgccagcgcgcgctcatcgccatcggcttggcctgccgccccgatctgctgatcgccgacgagccgacctccgccctcgacgtgaccgtgcagaagcgcatcctcgaccacctgcacatgctcaccgactcgttgggcaccgccgtgctgttcatcacccacgatctgggccttgccgctgagcgcgcccagcacattgtcgtgatgtacaagggtcaggtcgtcgaatccggcccatcccttgaagtgctccagcacccgcagcacccgtacaccaagcgactggtggccgctgccccgtcgctggcctcccagcgcatcatctccgccaaggagcgcggtgagaacgcggacgccctgctcgatcaccacatcgccggcgaaagcacgcttgagaagagcgagcacatcatcaccgtcgaccacttgaccaaggaattcaagctgccccgcaagaaggagatgttcaaggccgtcgacgacgtgtccttctccgtcaagcgcggcaccaccctggccatcgtgggcgaatccggttccggcaagtccaccgtggcgaacatggtgcttcacctcctgaagcccacctccggcaaagtgttctatgaaggtcgcgacacctccacgttcaagtccaaggaccttctgggcttccgccgccacgtgcagccggtgttccagaacccctacggttcgctcgacccgatgtactccatcttccgttccattgaggagccgctgcgcatccacaagatcggcgacaagaagtggcgtgccaaccgtgtcaaggaactgctggacatggtcgagatgccggcttccgtgatgggccgttacccgaacgagctctctggtggccagcgccagcgcatcgccatcgcacgagccatggctctggacccggacgtcatcgtgtgcgatgaggccgtgtccgctttggacgtgctggtgcaggaccaggtgttgcgcctgctcaacgatctgcaggccgaaaagggcctgagctacctgttcatcacccacgatctggccgtggttcgtcagatcgccgacgaggttgtggtgatgcagcacggcaagctcgtggagcatgccaccaccgacgaggtcttcgaccacccgcagaagcagtacacccgagacctgctcgacgccatccccggcggcaagctccaactcggtctggactgataatctgcgtttgagcgcattgtattgggttctttccatccgtggaaagaacccaatattcgtatgcgcaggtttgcatgatggttcgcgtgggacgaaaggcaaaaattggtgttttcccgatgttgtcccacaaattgtgggacaacatcaacatcaatcgatggacatgaatgttgtcccacagcagatttctcacgaagtccggaattacgccattcttagtgtggtcgataattactcatgctgtggggtgtgggacggcccgcgaaaatcgtcgattttcggatgttgtcccacggaatacgtcatacctcgtatgtgatcgtgagtggggcgtgatcggaccagcgtttgtcatacgtgggagccttgtcgatgacgaatccgcgtgcggtctccgccaactcgggcgtggcgaactggtagtcgattctccagccgacattgttgtcgaaagcgcgccctcgctggctccaccaggtgtatggcccctgaatgtcgccggccaacgaacgcatcacatccacgaactcgtattcgtccagccatttgtccacgtaggcacgttcttcgggcagaaatccggcgtgcttctcattggccttggcgttcttgatatcaagcggcgtgtgcgcgatgttgaaatcgccgcagagcacggcctgtttgccgccatgcgcagcctcgtcccgcaacgcgcccatgcgcttcagcatcgtgtccagaaaacggtacttctgttccattttggtcggataatcggtgttgccagcatgcacatatacggatgccacggtgatcgcgtagccctcaggcgttttgacatcggtttcgatccaacgccctgaatccacatcctcgctcagacctggcagcccatatcgcttgtcaagcacttccaagtcggtgagcagtccgactcccgcgcggcctttcacccggcagacctcgttcatggcatggaggttggccggtgcctcgatcttgccggcggtggcgtattcgaaaccaaattcatcgaaaatagaatcgacatcgtcctgaggcgcgcgaacctcctgtatgcaccagacatccggcgcatgcttgccggcccaatcctcgatgcccttgcgcttggccgcacgaatgccgttgacgttagacgtggtaatggtgatggtcatgcggccatactattgtggcctccctacgaatcgaaccggacaccggcggccgcgatgctcagctttctctaagcctgagtgctagtgttagcaaggttgcaaccgttacatgaaacgaggaattatgggactgttcggattcggcaagaagaagagcaagaaggaagccgagccggccgttgagcctgtcgatgaggacaaggtggccgccgaggccgcaaacgccgcagcaaaggcggaaagcgctgaaaccgtattggcggaaccatccagcgaataccagggccgcggagaagagcgaggcccgtgggacgtcaatgatgaggacgtgcccgattatgacgattatctggatctgggcgcctactacctgcccttcctccggggcatccaactgcgtatcaaggccaaccgcgccacccagcaagtgcttggttccaccatcaccttcggctcctccagcctggagatcgaagcctttgccgcacccaagaccctgggactgtgggatgacgttcgcggtgacctgcttgaagccaacaaggccgcttctgaagtggacggtgtgttcggcaccgaactgaagctgccggtcaatgtcaagggcggcaagaccgtgaacacgcgcatcgttggtgtggacggcccgcgctggatgctgcgtggcatcttctccggcaaggctgctatcgatccggacagcccggagaccgaggcgctgaacaagttcttcgccggcatcgtcgtcgagcgtggcgaggagcctttggcgccgcgcgatctgatcccgatgcatccgccggtcgcccccgctgagcgtaaggccgccaaggccgcggccgaagccggcgaggcgaacggcaaggaacacttcaaggacattccggacaacaagccgaagggcccgttgagccaggaccagcagaccgaagtgaagaccacgctgtctcgcggcccgatgttctccgaagttcgctgatttataggaagagacttggcagacaacaaacgcaccggcctgtccgctctagccgacgccggcaatgaaggcgaggatttctccgtcatcgacgccatcggtggcccgcgtggcgtcatcgaatccatgctgcctggcgtggtgttcgtcgtactgttcgtggccacgagcaatctgaatctcaccattgcggtttcggccgtgttggcggtattgcaggttattgtgcgactgattcagcgccagtcggtaatgggcgcggtctctggtctggtggcggtaggcatctgcctgatttgggcatggcagactcatgaggcccgcaattactacatcttcggattcattaccaatgctggctatgccgcgttgcttgccgtgtcgctgattgcgcgcgtgcccggactgggtttggtcgtcgaattcatccgtagcctgcccaccgagcatttcaaggcatggttccatgactggatggacgacaaggccctgaaacgcgcctatatgattgtcaccggcctgtgggtcggtctgttcctgctgcggctggtggtgcaggtgccgctgtatctgaccaaccatgtagctgcactcggcgtgacccgcctgctcatgggcattccgttctgggcattggcgatttgggtgagttacctcattattgccacgccgatgcaccggcataaggtcgcggctaggaagatacagactgaagtcgctgttgatgccgaactcgaaccgagcgcaaccggaaaggacgatgatgcaagctgaagttcgtatcgaacgatacgccgaccaaggccgctgcgtggcccatatcgacggtcgtgtggtgttcgtccgcttcgccttgcccgacgaactcgtgcgagtcgaacttgacgagccccacgaccgggacgaccggttctggaccggcgaagtcgtcgaggttctcgagccgtccgaagaccgagtcaccccggcatggccacttgccggtcccttggcgatgggcgggggagtgggcggcgcggatctcgtgcacgtctctttgcccggccagctcaagtggaaggccatcaccgtctccgaacagatgagccgactcggccatatcgacgtggccgttcccatcgagcgcatgcccggcgacaaggcagccggcggcctcaattggcgtacccgcatcgaaatgattgccgacgacaacggcatgccatccatgcgccggcgcggcacacacaaccgcgtggccatcgacaccatgccgcttgccacgcgcacgctgctggacgtcgccaagcgcgaacacgtgtgggaaggcggctttgaacccggctcccagattcgtctttccgtgcccgaaccgcgcggcgagatcgtcgataccgcggcagcagacgacaattacgccgtacttgtggacggcgaactgcgcgccggctcccagctgctcaccgaacaggtgaccatcaacggcacgaccttcgactatcaggttgacgccaacggtttctggcaagtgcatcgccaagcgccgatcgccctcggtacgcacgtgatcaacctggtcaacgggcagctgcagtcagcggcggacgccgtaatctgggatttgtattccggttccggcctgttcaccctgccgctggccacaatgaccggtgaacgcacccgcatgctcagcgttgaaggcgcgcgtgtggccgtcaagaacgcccagcgcaatctgcgcgccatgaacctgaacgacgtggacgcccgcgcgggtgacgtctcgcgcacgctggaccatgtgccggcgcatctggccaagccgaatgtcgtagtgcttgatccgccgcgtgccggtgctcgtgccaaggtctgccgccagattgccgcggccggcgcatccagcgtggtctacatcgcctgtgatcccaccagcctcgcacgcgacaccgcgacactcatcggcgaaggctacgagctcaaagacatccgtgccttcgatatctacccgatgacccaccatgttgagacggtggccctgtttacccgctgacaggtgagcatatgacacgacgaattctcggattgctggcctgcatggcggctgtgttgtccctggccgcctgcacgccggccggtagggcggtcggcgatacccaagacagcatgccggaagtcgcccacgattccacacatcccacggatgtcacagtcggctttgtggggtcgactgacaccgccgcagacgagttcgtcatcaatgcgctgtctgatgacaaactcaatgtctactatgcctcgctcgaaacatccgcaagctcggcaaacgcaactgatggtgtatccggtgaaaccgaatcttctgacgccggcactaccagcgaaaacggtgccgatagtatggatgctcatactggcgtcgacaagaatgcggtcaccgcacagcagggtgttgccgatttcgtggctcgcgcggtcaaaatcgtggttatcagcggcatcgacgttaccgacgccaaccgggagagctggaaccagacgttgaccaatgcgcgtgaagccggtattccagtcgctctcattgatccaaagcatgcgcccgaagatgaactgctgtacgccgtcatccttcacctcaacaccaacagtgccgattctggcgacactgccgataccaagccaatgactattactgacgccgtgctcaccatcacgcgcgacgaaccccacgaacgcgagatcaaagtcaccgtttcctgagccgaatcaggcccttgaagctgagaaagcaccctgaatcatccctgagccttagcggattgcgaaacaagacgcggtaggctggagaatatgagtgcaacaacagccgtggaaatgcctgagatcggagcgaccggtcttacccccaaagaagtggtgcagcgtatcgaaagtggccaatcgaatgcggtgaaaacatccacctcgcgttcggttcaagatatcgtgcgagccaacgtattcacgctgttcaacggcatcatcttcgccgcgatggtactggtgctgatcaccggttcctggagggacgcggtgttcggtttcgtcatcatcatcaacacgggcatcggcatcgtcaccgaactcagggccaagcgcacgctggacaggctttccatccttgtggcctccgaattcctcgtgcatcgtgacggcagggacgtggaggtgccccacaacgagatcgtgctcgacgacctgctgtggatccgtgccggcgaacaggtgccggccgacgggcagatcatccagacctggggactggagcttgacgagtccatgctcaccggcgaatcgcgtaccgtgcgccacaaggtgggggagcaggtgtattccggcgccaccgcggtctccggcatggcattggtcaaggtcaatgcggtcggcagccattcctacgccgccacgctcaccgcgcaggccaaggtatacaagaaaaccgtgtccgacctgaacaagggcatcaacacgattctgaaattcatgaccttcctcgtggtaccgctgtgcattctgctgattctttcgcagattcatacggtcggcggttggggcacggcactctccaccggcgaatggcggcaagccgtggtttccgcggtcgccggcgtagtaggcatgattcccgaaggcttggtgctgctgacttcgctgaacttcgcggtggccgccatgcgtctcgcccgtcacaatacgctggtgcaggagcttgaatccgtggagacactggctcgcgtggacgcgctgaacctcgataaaaccggcacgatcaccgatggcggtatcgccttcaaccggctcgtgatgctcgattccgccaatgcggctgcggaacaggcagccacgcaggccctctacgactgctgcaacgaagagcagcccaacggcaccggccaagccgtactcgccgggctcaaggcccaaggatatggggcaggtgcggttgagtctcgtgtcccgttctcttcggcgcgcaaatggagtgcggtgcgtaaatccggcgagacctggtacatgggagcgccggaggtgattatttctgcgcttgagggtgactattcgtcggtgttgcagcaggttaacgagtatgccaatgacggcaaccgtgtgttgctggttgcgcggtctacagctcccctctccgaggggagctgtcgccaaaagcgactgaggggagcagttgagggagccaatgtctcggacggccggcaactggatgtgcaggctgagccggtggcgttggtgttgtgctctgagaagattcgcgaggacgccgagcggacgctcgcttggttccgtgagcagggtgtgcgctgtcgtgtgatttccggtgacaatccagtgaccgtgggtgccatcgcccgcagagtgaaactgacaggcgaccatgagccggtggcgatggacgcgcgcgaactgcccgaggacgtgaacgaactggcccgcgtgctcgaaaacgtcgatgtgctcggccgcgtgctgcctgaccagaagaaggccatcgtgcaggcgttgcacacgcagaaccacgtggttgccatgaccggcgacggcgtcaacgacgcgctcgccatcaaggaggcggacctcggcatcgccatgggcaatgcggcgcccgccaccaaggccgtggcccaggtggtgctggtggattcgaagttctcgcacctgccggacgtcgtggcgcggggccgtcaggtcatggccaatatggagcgcgtggccagcctgttcctcgtcaaaaccgtgtactccgcgctgatctcgctcggcgtagtgctgacgcaaatcccatacccatacctgccgcgccatatcacgtatatcggcgctctcaccatcggcatgcccgcgttcattctggcgctcgcgccgaacacgcgccgctatattccgggattcctcaagcgcgtggtcacgttcgcgctgccgggcggcatcgccaccgcgctgtcggtgctgctggccgcttgggtgctgccgccggtcatgggctggaacgtgaccggcgatgccgcggacctgtccgccctgcgcgccaccagcgccatcatcctgttcgcgatgggcgtgttcgtgctggcccgcgtggccagaccactcaacggttggcgtggcgtgctggtggcggtgttcgcggcggcgggcgtaatcggcgcgttcgtcccgttcgtggcgaacttcttcgccctgattctgccgaccggcgccacgatggtggccacgctgatcgcgttggccggttccgcgctgatcttcgcgctgtgcctgtggctggcgccgctcgtgcgcggactgacgggcaagctctcgcgtcggcattgagacggcggcgcgtttgtctcatacttcaagccgacacgccagagcctcggtaacgtgcccgtaccatgtgtagcggataatcagcggcatcataagccgattcatgatttcggaggaagcatgtccttacgcgacgaccagctggctaccctcaaggcagccggcaaggacttcgattactacaacatcgccaatctcgacggcatcgatcatctgccgtactcgctgaaggtactggtcgagaatctggtgcgcaacatcgacggtgccaacatcaccgacgagcacgtcaagaccctgctcgactgggatccgaacgccgaacccagccacgaaatccagttcacgccgtcccgcgtgatcatgcaggacttcaccggcgtgccctgcatcgtggacctcgccaccatgcgtgacgcggtcaaggacctcggcggcgacccggaggtcatcaacccgcaggtccagtccgacatggtcatcgaccactccgtgcagatcgacaagtacggcatcgccgacgcggtccagcaaaacatggacatcgagtaccagcgcaacggcgaacgctaccagttcctgcgctggggtcagcaggcattcaagaacttccgcgtggtgccgccgggaaccggcattatccaccaggtcaacatcgaatacttggccaaggtggtcatgagcaaggccgaggccaacggcaacgcgctcgcctacctcgactcctgcgtgggcaccgactcgcacaccaccaccgaaaacggtctgggcgtgctcggctggggcgtcggcggcatcgaggccgaggccgccatgctcggccagccgatctccatgctcgtgccgcgcgtggtcggcttcaagctcaccggctccatcccggagggcgttaccgccaccgatgtggtcctgaccatcaccgacatgctccgcaagcacggcgtggtcggtaagttcgtggaattctacggcgaaggcatcgcctccgtgccgctggccaaccgcgccaccatcggcaacatgggccccgagttcggctccacctgcggcatcttcccgattgacaatgtcacgctcgactacctgcgcctgaccggccgctccgaagagcaggtcgcgttggtcgaagcctacgccaaggccaacaagctgtggggcgacgcttccgacccggattacgtggaaccgcagtactccgaatacgaggaactcgacctcggtaccgtggtgccgtccatcgctggcccgaagcgcccgcaggaccgcattctgctgtccgaagccaagagcatgttcgagaagaccgcccccgcctacgagaccgagaagaccgtcaaggatccggtggccgtgtccaccgacttccgtggcgatttcgacatcgaaaacggcgacgtggccatcgcctcgatcacctcatgcaccaacacctccaacccgtccgtgatgatcgccgccggcctgatcgcccgcaacgcacatgccaagggccttaagcccaagccctgggtcaagacctcgctggctcccggctcgcaggtcgtggccgactacctcaaggccgcggggctgcaggacgacctcgatgcactcggctaccagctcgtcggcttcggctgcgccacctgcatcggcaactccggcccgctgctgcccgagatttccgaggcgatcaacgccaacgacctgaccgtcaccgccgtgctttccggcaaccgcaacttcgaaggccgcatcagcccggacgtcaagatgaactacctggtctccccgccgctggtcatcgcctacgcgctcgccggcacgatggacttcgacttcgagacccagccgctcggcaccgacgcggacggcaacgacgtgtacttgaaggacatctggcccaccaatgccgaggtcgccgccgtggtcgacggcagcgtgagccgcgagatgttcctcaaggactacgcctccgtgttcgacggcgaccaccgctggaagggcctcgacgtgccggaaggcgagctgttcgcgtggaacgacaagtccacctatgtgcgcaagcaaaccttcttcgacggcatgaaggccacgccggacccggtcgccgatatccacggcgcccgtgtgctggccctcctgggcgactcggtcaccaccgaccacatctccccggcaggcgcgttcaaggcctccagcccggccggcaagtatctgaccgagcgcggcgtggagccgaagaacttcaactcttacggttctcgccgaggcaaccacgagatcatggtgcgcggcacgttcggcaacatccgtctgcgcaaccagctgctcgcctccgtgggcgaggaggtgacgcctggcggcttcacctacgacttcctcgccaagaagccgaccacgatcttcgaagcctcccgcgactacatcgacaacaaggtgccgctcgtggtgctcgccggcaaggaatacggcaccggctcctcgcgcgactgggccgccaagggcacggtgatgctcggcgtcaaggccgtgatcaccgaaagcttcgagcgcatccaccgctccaacctgatcggcatgggcgtgctgccgctgcagttcccggcaggcgaatcctatgagtccctgggcctcaacggcaccgagacctacgatatcgccggcgtcgagaagcttaacgagggcgtgacccccaagacggtccacgtcaccgccacccacgaggacggctccaagaccgagttcgacgcggtggtccgcatcgacacgcccggtgaggccgactactaccgtaacggcggcatcctccagtacgtgctgcgcaacctcatgaagtaaccaccttcttggctcccctctcttgaggggagctgtcagcgaagctgactgaggagagcaaggccggtatccgccaacggataccggccttttccacgcatgccaaaatgctatactgtatagcatcttcgaaatggaggttgccatgaccatggtccaaatgaacgttcgcattgatgcgaaactgaagaacgaggtcgaagaagtcctcaagggcaaaggcgtatcggtgagtgacgtaatccggtcgctgtggttgtacatcgccgaccgcaaggaagtgccggcattggaaacgaccgccgaagagcaagcccgcgaggaggaaaagcagcgcaagctgaaactgattcgagaaggtgccggatacgtacacaaggaactggtcaaggccggactgatctcagaagacaccgacctcatggaaggccttacctacaagcagttccgcgacaaaatgtacgacgagcaacttgatgcgtattacaacatgaagagggccgattgatgaccgacgtttccatgcagcgtattttgctcgataccaacgtactgttggactatttgctccatcgcgatgatcacgccaagatggcggaagcggttatggaacttggcgcgaagaacaacattacgttgttgtgcgcgtcattgtcgctgaaggatatcgcatacctatcatcatcggcgattcgtagggaattcaaaccgaatgaatcggaagtggagaatttcactcgcggctttctgtcgtcacgggtgccatggcgttgtatcgagcaggtgaaggagatgtgtgacatcgtcgctgtcgatgagtcgacatgtgataaggctttttccctgcaaaaacggcatcgggattttgaagatgatctgatcatcgttgccgcgcaacaatccggtgccaactgtgtggtcacatcggatgccgaattaatcagtcattttcccgaatattgcaaaacaccggctgaaatcgtggcggcgctggaataaatgagcgtgtggctcccctcacggagggggagccaccaatgacgtgccggcttactgtagcctactgcgcctgcagacggaactgcttccagatgtcactgagcttctggccgttacgcgtgcgcttccacacgtccagaccgccgccgcgacgtcctccggcggcggcacgggccgcggcggtcggagtcggatattcggagccgtcatccagacggagacgaccgttttcggtgaccgtggcaaaccagcgctcgcccttgcgcggccgctcccacaccagacgttcgcccggcaccagaagacccgcgtcaatcacctgccggatcgtgacgcgccgcgaactatgagacggccgtggagaagtcttcgacaactcatcgacattctgcttggtcagatcgcgggcgtccttgtcataccggatgccccagtattccacgatgagtcggaccgcctcttcctgccgcgcttccagcaatgcgggtgtgcagtcagcgaaatccttcaactgattggtcagcgggaaacgacgcgaatccgcgcgcagcagcatgcggtcgcgacgtgccggatattcactcaacctgtccaactgatcctcagggccctgcaccagcgccatattgccgagtcggtacatccagaaatcatgctgatcctgcggccagtccgcaaacgatttcgaccgttcgatatccaacggcataatcggcagcgcactgaaccggcgtggtcgatccaactgcatgccggccttctgctcgttggcgcgaatcagcagcagacggaccaaatcgccgtcaccctgcatctcgccatgcaaacggaccaatgcgccttcacggtcgccgtccgagacatgcaacccgttcacgcgctggaccaaatagcccttgtcaagatcacggatggcggcgttcgcataaccgcgccgctccaacgctccagtgcgattcagcgtgcggatgccggtcacctgttccaatgcggtcagaatttccagcagccgacgctcgtcatgggcacccaacgattccagcgtggccgtggttctggcgatacgcgaggcacgaaccacaaacggcgacaaatcggcgtcgcccagcccgcgatacgaattgaccaacgcccacatggccacgggcttccactcgtggctgcggtaatcatccaatccctcaagccggctacgcacctcggcgggcagtacggtatcgctggggcgtgcgatgatccgccacgccatcgcgtagggtgccagcacctggttgatgaacgtgggcaccgtgcctttgtcgatgtacggttgcagcacgtcggccaggaaatcctcgatgagcttgtcggtggccggcttgtgcgtgagcacgagatgcagataggcgaagaattcctcacagtcatgcggatcgtcgccaatcgggtcaatgatgtcatcccaacgggcggcgtacacgtcaagttcggcggtcgacaggccggccgtggcgcgcgccttgaacacgtcggacgaggtgagcggcaggccgcgcatgttcatcacgtcgaagatgcgatgcgcgccgtcgagatcgtcggtggtcacgatgaccagcgtcacctcgttgaccagatactgcgcgaattgctggcgttcggcatccgaccaattggaaatctcgtcgtacgtcttacggatgttggctacgatattgcgttgcgctgcggtcgccagatcatcgtcgttcatatcgaacacggattcgagattgtcttcctgcacgtgttcgcggaagaacgctgcgtcgcgctcgcgcaacgtgaggcgaggctcggtgacgatgccgcgcagcttgtcgccgggctccaccagcagcgcatcgagttggcgcatgaggtccgggtcgcgctccagatcgcgcaacacggcgatgatgatcgacagggataccagccgctgctgcccgtcgattacgtcgtaacggttatcgccctcgcgcaccagaattagcgagccgaggaagtacggagtaccgggcgacttgcaggcgtcatccaagtcgcttaccagttgcaggatgttctcggtcttccagatgtaggcccgctggaatgaggggatcgtgaaccggaaatccggggtgaacactttcccgagtggtagttccttcgcactgattgccatgtcagccccttcgtcgccggcctgtggacggtatgccggcataccaacttgtgctcaagcctaccagtgtttgcccgacggcgggcacatcacgccggctcgggcaccgacccctcatacaagtagaacgaagacgggttttctcccggcacggatgcgggcagtgactgctcgcacacctgcgtcaggccgcgatgtacatagaatccgacatcgcacgtggtatccgtgaataggaagtattgacgtatgccggctgcgtggaatgcgctcatcatcgtctcgaacatgcgccggcccagaccgtgaccgcgcgccgccggatcaagtacgaacagcaccacttcagccgaatactcatggccaatgttcgccgcctgcttacgcagttgcctatcgacatgaagagtcccgagaatctcgctcgcagctgccatgccgtcgtgggcaaacgccagttgcaatagcttgcgcaacgaatgacgccggtgcatgttcagcgggctgcgatggtcgagctcgtcgatacgccccacaatcaatgcgacgggtttatcttccagctccgcgacaaaggccgtggtcacacgtgccagacagttctcccaatcggcctcggctgccagcaagccggtccgctcatcatattcggcgtaccaagtgcggcgcaccaggtcgatcagcgccggataatcgtctttacgtaacgttcgaataatcgcttcactcatgttctccattatgactgatatggctcgataaccggacgtgttacagtcgtgccggcaaatcggcccgctccaccagcctcgccatctgtacgcggcccatattgagcttgtccgccgcggaggagagatgcgccttggccgtacgctccgagataaacatacgggaggcgatttcggtgttgggctatgtgctgcaagacgattcgccgattacggtgtatgccacgcgcatggtggaaacgcccgttacgctttgagatgagcagaacgagccgatcgatcatattcatggaatgttcagctttgttcctctaagattggtactggaacaaacgctaaaggagcgattatgacattcggtcagcagccccagaacaacgggcaatacaacccgcaatacaacacgcctgattacaacgccgcccaacagtctggatatggccagcaatacgcacagtccggttacggccagaactactatgcccagccgcagggcgctcccacctaccaatacgtgccgcagggtactggtgccggtgcgggtgcggccaccatcaacacgacgatgacctacaactatgaggaagcccgccgagtctcagtgaccaaggtgtacggcgagatgaccatcggcatcctcgtcaccgccgtggtcgccgtgctcggccagatcactggagcctactacagcttcctcatggccaccggcatggtgggcctcatcggcctgtgcgtggtgcagattgccctggccgtggtgctcggcatgcgcgtcaccaagatgaagtcggccaccgcgcgcgtcatgttctatgtgtacgccgcattgatgggcttcaccttgagctcgatcttcatggtctacgacctcggctcgatcggcgtggcactcggtgtcaccgccgcgttcttctttgcgctgaccatgttcggcatgactaccaagttcaacatgctcaaggccggcccgatcctgatgatcggcctgattgtgctcatcatctcgcagatcgtgctcgccttcgtgcaggtcgacggcatgaccaagatcgtctgcgccatcggcctgatcctgttcgccggcatgaccatctacgacgcgcagtccacgcgcgcgctgctgaccgaatacgaggcccagggcccggaaatggtcaagaagatctccatcctgtgcgccctgaacctgtacctcgacttcgtgaacatgttcctgtacatcctgcagctgctcggcaacagggactagcctcgacagccgattggcgagcggcatgtagcctgcccgtcaaacgtcacagcccgaccacattgtggccgggctttttcatgtctgtcacattcgcacgttaggctggctccccgtgaaaagacaagaactcgtaggcatgctgagcctgttgttgaccgcgctgatctggggttttgcgttcgtggcgcaggtccagggcatggattcgatgtcgccgatgttcttcaacgccgcgcgcttcacgctgggagcactgtctttggtgccgattctgctgtggatgcgtggccgggggagcgcggataagggcgatacagccggggccgatgtcgttgggaccgaggcatccgtggccgtctccacagatgccgcatcgaacggtgcatccgacgtcgttaccatcaccggtgccaagctgaatgcgaacaagcccgattcggccgtggcgcgattgctcgccaacccggtggtcatttccgtgatctgcggcatcgtgctgttcaccgccagcaccctgcagcagtatggcattctgtacggcaaatcggccggccgtgcgggattcctgaccgccatgtacatcgtgatggtgccgttgctggccttcgtgttcctgcgccggcgcatcggcatgctggtgttcgtggccgtggcgctgtccatcgccggcttctatctgctgtgcatcaccgatggtttcggttcgatcggcctggcggatatcctgctcgtgttcacggccgtgctgttcgccgtgcatattctggtgatcgatactttgggcggcaccgtggacgccatcaagctttcattcggccagttctgcaccaccgccgtgctgagctgggcgggttcgctgatcgaaggctcggtcgactgggccggcgctgctcattcctggattccgattctgtacgccggcatcggctcggtgggcatcgcgtacaccttgcaggtggtcggccagcaatgggtgccaccgacgcgagccagcctgctgatgagcctcgaatcgttcttctcggcggtaggcggtgcgttgcttctcggtgaggtgatgaccccgcgcggctacctcggctgcgccctcatcttcctcggcaccctactggcccaagcgccggccaggctgccgaagtggccgcaacggtgaatgaatcggccacaggccgattccatagcacctcagtccgaggtcttaggcgcttcgcccacttgcggcgcgccgttgatgtcgcggtggatgttctgcatctgtacctcgatgttctgcaatgagcgcgcgcagtcgagcagcgtctgggaatgctcggcgagcttgttgtccggcaaatcggtcttgtagcgcagcgcatgctccagcgacgcccaataatccatggcgatggtgcggaactgcacctccaccggcgtgtaatgcgcgcccgaggagaggaacacgggcaccgcgtagattacgtgcaatgaacgatacccgttctgtttcgggttcttgatgtaatccttgacgcgcagcacctgaatatcggactgcgacgacagatagttggacacggaatacacgtcgtcgcggtaattacagatcacgcggatgccggccacatcgaacagattgtccttaatcgaattgacgccgatcggcagacccttgcgctccagtttgccgatgatcgagctcaccgacttcagacggcgttccatatgatgtatcgggtcatggctgaaccgcacctggaactcgtcgtcgagaatctccagtttggtgctgatctcgtacatcgcgccttcatacacctgcatgaggtcaacgaattcaacgacctgttcgggagtgaaggtgcctcccggaagatccaacgctttgagacgggcttgcagatcggaggttttgagtcggctatgtcggtcaagtatcacgtccaccaatatactcggcggattccagccaatctggacgttcgcggggaatctttccaagaacccataatttgacatcgtgacaaccaatggcatacgtgaccggagcatgacgaaccccgtcgatagaatcggtcgttatgaatgaagacatgatgaccgaggcggagcgcgcctcgattgcagccgatggaaccgatggtttgctggggaaacgcggcaagggcgtgttccatatccatacgctcggctgccagatgaacgtgcacgattccgagcgcatcgccggcgtgctggaggccaatggctacgtgcctgcaaccgaggaccagatcaatgacaatgacctcgatttgctggtgctcaatacctgtgcggtacgcgagaacgcagccgaacgcatgtatggcaccattggccgattcaatcgcgtcaaactggttcggccgaacctgcagatcgccgttggcggctgcatggcccagcttgaccgcaagaagatcgcggatactgcgccatgggtttccgcggtgttcggtaccaagaacatcgaagatctgcccaagctgttggatcagaatcgtgcgaccggcaaggcgcaggtccaggtcactgaacaattgcggcagttcccgagccagcttcccgccgcccgcgcctcccgcatcagctcgtgggtggcgatttccgtgggctgcaataacacctgcacgttctgtattgtgcccaccacgcgaggcaaggaaaaggaccgccgccccggtgacattcttgatgagattcgccaatgtgtggccgatggtgccaaggaggttacgcttctcggccagaacgtgaattcgttcggttatggtattggcgatcgatacgctttcagcaagctgttgcgcgcctgcggcaccatcgacggtctcgaacgcgtgcgcttcacctcgccgcacccggccgccttcaccgacgacgtcatcgccgcgatggccgaaacgccgaacatcatgcaccagctgcacttcccgctgcagtccggctccgaccgcatcctgcgcgcgatgcgccgctcctaccgctccgccaagttcctcgacatactgggccgcatccgcgccgccatgcccgacgcgcagatctccaccgacatcatcgtcggcttccccggcgaaaccgaagaggacttccagcagaccatggacgtggtgcgccaggcgcgcttctcctcggcgttcacgttcatctactcgccacgccccggcacgccggccgccgcaatggaacagattccgcgcgacgtggtgcaggaccggttcgaccgtctggtggcgttgcaggagcagatcaccgaagagaacctcgccacattcgagggccgcgacgtcgaagtgatgatcaccggcaaactcggcaagaaggacaccgacacccaccgtgtcaccggccgcgagaaaaccggcgtgctggtgcacatcggcgtgcctgaaggcgaaccggtacctgaaatcggcgatttcgtcacggccaccgtcacacacgccggccgccataatctgcttgccgaccccgacgtggccgccggccagacctattccgtgcggcactgagggggcgtatatgacgcaacgagtcgtctccatcgtcggtcccaccgcgtccggcaagacggggttgggcatcgccatcgcccggcgtctggccgaagcgggggagcgggccgaaatcgtgaacgcggacgcctaccagatgtaccgcggcatggatatcggcaccgccaaacccaccgccgaggaacaggcggccgtgccgcaccatctcatcgacatcatcgaccccgaagacacgatgagcgtggcccgcttccaacagcttgcgcgcgagaccatcgccgacctgcaatcacgtggcatccggccgattctcgtcggcggctccggcttgtacgccagagcggccatcgatgacatcacctttcccggcaccgatcccgacgtgcgcacacgtcttgaggaacgcgagaaaaccgagggtgccggtgctttgttcgacgagctgcgggccaaagaccccgaggccgccgcgcgcatggacccacgcaatccacgccgcaccatccgtgcgctggaggtcatcgagcttaccggtaaaccgtattcggccagtctgccgcgctaccggtacgtgattccgtccgtgcagatcggactcgacctggaccgcccggatttggatcatcgcatcgatttgcgcaccaagcagatgtatgacgatgggttcatcgaagaagtcgaacggttgcgcccgcatctgggtgccaccgccgtacgtgcgctcggctatcagcagatcatcgacctgctggacggcatctgggatgtgaacgacgccttcgcggacatcgcacagaaaaccaagcgactcgcccgcaaacagatgggatggttcggccgtgacccgcgcatccactggctgcaggccctgaacccgaaactggtcgacaacgtgatggccattatcgcgcacgccgacgccggcgactacgacccgatcgacgcccgagccgacgaatacacccagcatcatctgggggatatcacggcgtaggaatcagccaaaggccgatgcaatcacccgcaatcagtgtgcaggcccctgattccagccggcgatcaagaacacgcgcgtcggattcgccgggcgtagtatagcgtcgaacatcgtctccagtgcagacgtgtcgccccgatatgccgagtgcttggcggagcgatactcctcgcgcgtcactgagccccagtcgagatcccagccggcgtcatgcgccaagcgtgaaccgaatatacgcagcaccatcgcattgccgccacggaacggatgcagataaccgagctcatcataaatagaagcgaacgcgtgaacgaacacgtcgcgatccaacgcatgcaggttgcgtttgtccgccaactccatcgcgatgttgtgtgtgccggtctcaatgagcccagccgggaagaacgcctcaggattcgcggctcgagcccggtcgttcgtcacctcgcgtgtggtgtttgaggtacgcaacttgcccgcatcctcgaacacgccttcgaacagccccttatgaatggcggtcagctcatccaagtcgccagacggattccatcgacgttccgccaacaacacggtacgtgcgaacaccgcatccgcccgatccgtggcatgatcatccagactgccggcagccagacgatcctttccggcagggtcggcggcggcgcgcagacgcatggcggtctgttcgtccgccacgtcgatgagatgggtcacgggcttcaagccgcgttcgtaggcagccgcggcgcgcatcgttgcctcgcccggcgtcatcgcttccagtgcgcagttcttgagtgcaaatgcgactgcgctcgcacgctctgcgggtgtcatgcaacccatgataaggcatattcgcgccccagcggggaatcgactcagacgaacgcggcgaatcggctgtcgggattcgtcaatcgaccatatcgtcacggtgtcgtcaccaaccatgcacccccgtactagtagaatcagacccgatatggcacgaacagcatcctccaacagcaccaaaccccgtaaatccaaagacaacgggtctacccatgatggcgaaaccaaggtccagcccgagcttgacctcgaacctgagccgttgtggaagaagatcctgctcgcgattccgcgcgcgttcggctccggcgtacgcgccgtcaccggcgtcggcgaatacgatccagcctaccgtcgtgacggtttgtgcttcctgctgctcgtgctcgccgtactgttctgcgcgtccgaatggttccgcgtcagcggtccattcggccagctgcttcacgccatcgcggccggtgtgcttggtctgatgagcgtcgtgctgccggtgttgctcgccgccgtggccttccgactcatgcgcaattccggtaaagggtccaataacccgcgtgtggtcaccggttgggtgctgctcatgtggtcgatttgttcgatcatcgacgtggcgatcgccgccgaccacaccggattcgacatcacgattctgcaatccgccggcggcctgttcggcttcttcctcggctcaccgctcgcctggggcctttccaacgtgttcgccatcatcattttcgtggtcgtcggcctgttctccttgctgatgattaccggcacccacgtcaccgatttgccggaggatgcgcgcaaaatcgccgctaaaatccagcgcaaaccgtatgtgccgatgggccaggagacggatgggagcgccagccagttccccaacgaggtccgtgtgggagataccactctcgcctttgccgacggtgttccctcgcatgacggcgacgatgacggcaacgacgacgatcaggccggcgatgcacggcccagcctgttcgcacgactgttcggccgcaaatccaagaccgaagacgacaaaactcttgacaagtatgctgccgacgatccgttcgaccgtgccgccagccagcatggtgccaccgccgaaaccccggtggtcgatccgatgaccggcgagattaccggtgcgcgaaccattgcatcgtcttcgtacgacggccgtccgcacctatccagccctgcgcctgctgccgatgcggatgatggcgacgcttcccgaacccgcgtcatcaccagtggccagaccgtcgccatgcccggtgggggagcggtagacgatccgtgggcacccagtgttgcccaggccggtactgtcgcgctcgcaggggcagccggtgcgatgggagcggccggagccgccggtgccgcggctgcggcagccgcgaccggagcctacgcgggtgccgatgcggacggcagcggagtcggccagggcgtgcccaatacgggcggccagccgaatgccaccgccggcaacgatacagacgacgacgccaataggccgtatcagttgcccgacctgaacctgctgaccaaaggccagccccatgcgatgcgcaccccggccaacgatcgcgtgatccgggcgctgacttccaccttcgaacagttcaacgtggatgccaaagtcgtcggcttcctgcgtggcccctcggtcacccaatatgaggtcgagcttggccccggcgtcaaggtggagaaagtcaccaacctgcagcgcaacatcgcctacgcggtggccagttcggatgtgcgtatcctttcaccgattcccggcaagtccgccatcggcatcgaaatcccgaacgaggatcgcgaaatcgtgcacttgggcgacgtactgcgctccgacaaggccgtgggcgatccgaacccgatgctctccggcatcggcaaggacgtcgaaggccacttcgtgaccgccgacctgaccaagatgccgcacctgctggtggccggtgccaccggttccggtaagtcgagttttatcaactcgatgctcacttcgatcatcatgcgtgccacgcccgaacaggtgcgtctgatcatggtggatcccaagcgcgtggaactgtccgcctacgcaggcatcccgcacctgctgaccccgatcatcaccgatccgaagaaagccgcacaggccctcgaatgggtggtcaaagagatggatgcacgctactccgacctcgaattcttcggattccgccacgtcaaggacttcaacgaggccgtgcgcgccggcaaggtacatgcgcccgccggctcccagcgcaaggtggccccctatccgtacatcctcgtggtggtcgacgagatggccgaccttatgatggtggccaagaacgatgtggaaagctccatccagcgcatcacccagctggcacgagccgccggtgtgcatctggtgctcgccacccagcgtccgtccgtggacgtggtcaccggtctgatcaaggccaacattccatcccgactggcgttcgccacctcgtccgccaccgattcgcgagtcattcttgacacggtcggtgccgagaccctgattggtcagggcgatgcgttgttcctgccgatgggttccgccaagccgattcgtgtgcagggctcgtgggtgtccgaatccgagattcgcaaggccgtggagttcgtgcgcacccagcgcaagccgaaataccgcgaagacatcgaacagatggccaaggaagccgaaaagaaagacagcatggagcccgacgaggagatcggcgacgacatggacgtgctgctgcaggccgccgaactcgtggtcaccagccaattcggctccacctcgatgctgcagcgcaagctcagggtcggcttcgccaaggccggccgactcatggacctgctcgaatcgcgtggcgtggtcgggccgtccgaaggctcgaaggcccgcgaagtgctcgtccagccgcaggacctgccgcaggtgctcgccttcatccgaggcgaaaccagctcgctcgaagccaccgccccgcaacagcccgaactcggcgaataattcacccatcgaccttcctctgatgagggaggtgccccgaaggggcggagagagaagcgcggccacgcggccatcagcacgcaacctgattcccgaataatggcagtcaatatccagccaatactcactcaaggtagaagtgtgggggtaacgtgaacactatggatgagaacacaatggacaagcagtcatcgcccaaatcatcgctgttcgacggatggaacgcgccgccgaacctagtcacctactcgcgcatcgtactcgtggtgattttcctgacactcgacattctcgccggtgcctggggtgagaacaacctgaccatgcgctgggtcgccgcggtgctgttcatcatcgccgcgtccaccgataaaatcgacggttggatggcccgcaaatacaatcaggtcaccgaaatgggcaagctcatggatccgatcgcggataagctgctcacttgcggcgcaatgattgtatgctccgcgttcggcgagctcagctggtgggtaaccatcctgttcctgattcgcgaaattggtatcaccgttatgcgtttcttcgttatggagcgtccgggcggcaaagtcatcgccgccgcatggcccggcaagctcaagaccgtattccagtgcgtgggtctgtccatgctgctgctgccgttctggtctctgggtaacggacaagccacgccgttctggatgaccgcttactacttcctgacctacgccatcatctacgtggcattggtcctgtgcctctactcgggtgccgtgtacctgtataacacgttcgtcgccccgaagcggaagtgacggatattccaatgcgggaattgtgcgacagtctcgcggccggcatcctcaagatttgcgaggcgaacaatacgaaaatcgcctgcgctgaatccctgaccggtggcctgcttgccgatgcgttcgtgcgtattcccggcgcctccaacgtgttgttgggctccgctgtcacctacgacatcaatgccaaggcctcgatcctgcacgtggacaaggccctattggatcgagaaggtgccgtacaccccgaagtcgcccggcagatggccatcggtaccgctcgcctatacagccagccggaatacggcgaccgaatcatcggcctttccaccaccggcgtggccggccccggtccggacggtgacaagccggccggactggtgtatgtgggcctgcgcatccccgcaagcctcaccgcggaccatgccgaagtgctcaaagccgtcgaactccatcttgatggcatgcgcgaagaggttcgtcgcctcaccgtattccacgttctgcaaaacttgagtctattcacagcaagttttaaggaataaaaccgttgggttgtcgtgttgtacatagtggaaacactgaaccgacctgggaaggggcgatggcgatggaaacgatgacccgagtgaacgaacagatggatgtggccgccaagaagccgatggctgtgcagccgggtgtcgcccgtatgcgtgaactgactccggcccagcgccgtgcggtgatgttcgcccagcagcaggtgctcaaggcacaggccgccaagaaggccaaggatcagcgtcaagccgttcgtgaacgtatgtgggatgaggattcgccgtcgtacaagccgactgccgccgccgagcccgtggtggctgaggaggagcctcgcgagttttcgctgcgtggtgctatcggtcatgtgctgcgcgagctgcgcacgcgcgatcgccgcacgttgcgtgaagtctccgagaaggcaggcgtttcgctaggctacctttccgaagtcgaacgtggacagaaggaagccagctccgaactgctgagctccatcgccgatgcgctcggagtctccacttcgcgcatgctgcgcatggtggctgattatctcgactcggtcgagggctgatcggttggcggtgtgaagccgcgtcccgtaatctatgtctagctgtgaacccgtatcgcttgtggcgatgcgggtttttgctgtcctgcggttggtggcacactggcgtgtatgcgtgaacgggaattctgggaattacttgaagaggtgttcggtcggacctacggtcgttcgctgtcgcgtgatcaacggatgcccaaactggcgaatatgaccgtggtcgaggcgctggacgcgggggaggagccacgcgtggtctggaatgtgctctgcgaccaaatggaggttccggactccaagcgttggggccacgatcataacgctccgcccatgcccgccgtctgacactgcgggattacggagtcgctgaatcgtgaaattggcgatttcggcgtgttgcacgccaaattcgaacaaatgttcgtgtgtgtggttatagttatccacagtgacaagaagccgcatacgtgtgcacagggtgcttgccatctgccataatccttaccgcagtagggcttaaggaggccaggtggccaagctcgggcaagctggaaccacaatggttggtttggattgcctcacatggcatgtccgtcatacggtggaggcatccgattcgcacacgacttcgacaaggagaagatcatggcacttgagaccaagccggccaaggacccggcagctgaggacaagcacgagctcgatcccaagcgcaaggcggcgctggacaccgcgctggcgcaggtcgagaagagttttggcaaaggttccgcaatgcgactgggcgaccagcccgagcagaacgtcgaggtgattcccaccggttcgttggctctcgatatggcgctcggcatcggcggcctacccaagggccgcatcgtggagatctacggccccgaatcatccggtaagaccacgctcgcattgcatgtggtggccaatgcccagaagaagggcggtgtggcggcctacatcgatgccgaacacgcgctcgacccggcctacgcccgcaagctcggcgtggacaccgactcactcatcgtctcccagccggataacggcgagcaggccctcgaaatcgctgacatgctgattcgctccggtgcgcttgacgtcatcgtcatcgactcggtcgccgctttggtgccgaaggccgaaatcgaaggcgaaatgggagacagccatgttggtttgcaggcccgactcatgagtcaggcgctgcgcaagatgaccggcgcgttggctcaggccggcaccaccgccatcttcatcaaccagctgcgtgagaagatcggcgtgttcttcggcaaccctgaaaccaccaccggtggtaaagctctgaagttctacgcctccgtgcgtctcgacatccgccgcatccagaccttgaagaacggcgacgaagcggtgggcaaccgcacgcgcgtcaaggtggtcaagaacaagatggccccgcctttcaagtccgccgaattcgacatgctctacggtgaaggcatttcccgtgagggctcggtgatcgacatggcccagcaggttggtgtggtcaagaagtccggttcgtggttcacctatgagggtgatcagctcggtcagggacgagagaaggtccgtcagttccttaaggacaacccggccatcaccgaggagattgagaacaaggtcaaggccgagttcggtctgatcggttccgccgatcagttcgcggaagatggcgaagccgcagcagcggccgccgtcagcgaggctgctgcggccgacgtggccaaggacagcaaggccgcagcggcgcctgctgccaaaacgacccgtgccaaggccggcacagctaaggcctgaacatgattagtgccgaagcgttcttgcggcgcaatcctgttgcgtcgcaagacatgcccattgccgagcagcatgttcagtcgaaaccgtcgggacgtttttctcgatgggggagagacgctgccgttgtcgaagatcccaatgatttggacgcttgccgcgaggctgcattgcgtttgctggacgcggccccgcgtgcatccggtgcgttacgcgaacgattgcttgccaaagggtacggcgaggcgatcgtggacgaggtcatcgaacggctgattcgcgtgcaactgattgacgacagcgcttatgccgaatcggccgtacgctattgtgccggtcgcatgatgggccgtcgtggtacggtcatggaacttgctcgcaaaggtgtggaccgcaagctggctgaacaggtgtgtgacgaagctgagcaaaatggcatctttgaagatgccgcatgggaattgggccgccaaatagcccgcaaaacccatggcctcgatcgtcgggtccgtcagcgtcggctttggtccgccggcggccgcaaaggccacagccccgaaaccctccgtcgagtcgccgccgaattgttggtgtagccaagaaaaaaatgagacctcttataccccgggttctgtcgtgccgtgcgcgaacgcacggcacggatggccatccatctcgacctgacgttaccgccaggctctagcagcctacccgatgacacgggcgagcagcccttaccgccatctgcttggccttgctcccgatgaggcttgccatgcgacctactgttaccagaggcccggtggtctcttacaccgccgtttcacccttacccgtcgaggacgggcggtctgttctctgttgcgctatctctcaggtcaccctgggcggacgttatccgccatcgtgctctatggagcccggaagttcctcagccgatcccaatgaagatcacggccgcggccatcaagaggtctcaagcttgcaattatacataaggtgcggaaaaggcggcatcccgccctgcggtgaggccatgacgttgcccggttatcctgttttctccatggttgggcatagttgggcgattcgtgaacgacgcgccgaatatcggatggggcgtgtcgggcgtgttgtggcgtgtcgtatggagacgaatcaaatctgtaagagcttggtatgtgcgagaaagagcaagaaaacgctgcctatccattgcagtatttaccatgatgaacaaacgagccggcctgataaaccggtatcaaatcttcttataggagacttctgccaaagccccagtgtatacatcgtttcattgcagagaaaagcccgggaacaaacatatattctctgggcgagtttccggccgttcacccattgttcgtctacaatgaaacatacccggtcggtgatgatgccgttcggaacacatatagcgggttacaccgcttgagttagaggaggtcaacatggaaatcgtcgttaccggacgccacacgcaggtcaagcaaaggttccgtgatgtggtcgagaccaagatgaatcgtgtgaccgctatcgccccggatgctcagcgcgcgcagattgtgctgacccatgagggcaacccgcgtcaggccgataccgccaagcgcgtggaaatcaccgttatcgccggacgtaccgtggtgcgtgcggaggcttccagcaccgatgaattcagcgcgctggacatggcgctggataagttgacgctgcgtctgcgtcgtactcgtgaccgtcgcaaggatcaccgtcgtggttacgcgaacccggtcccggtggatctgggtgttatcgccccggaacccgagacggaggagctggaggaagagccgaacaacagcccacaggctgcggtcgcctccgatcttggccctggcgaatccgtggaggtccaggttggggatacgccgattgtcatccgtcgcaagctgcacatcgccgagcctatgagcatcgacgaggcgctgtacgagatggaactgatcggacacgacttcttcctgttcgtgaacaaggagaccggacgcccgtccgtcgtctaccaccgtcacggttggagctacggcgtgttcgaaatcgatactccggagaacgtcaagaaggcctgaaggtaaggcctgctgacacgatcagctgataccgcatggaccgcttccaatatggaggcggtccatttttttcgtaagaaggtcgaaaaattcgactgctgacggtgcgaggcgctattctggtacgcggacaccaccacttatcagtcaagggagaacccagtggtcgatattgttgacaaagccctgcgaatgggtgaaggccaccagctcaagaagctggagaacgtggccaaggccgtgaacgctcttgaggacgagatctccgccctctctgacgaggatctgaaggcccaaaccccgaagttcaagcaggaaatcgaaaacggcaagagcctggacgagatcatgcccgaggcgttcgccaccgtgcgcgaggtctccaagcgcacccttggccagcgtcacttcgacgtgcagctcatgggcggtgctgccctgcactggggcaacatcgccgaaatgaagaccggtgaaggcaagaccctggtcgccaccctgcccacctatctgaacgctctcgaaggcaagggcgtgcacgtggtcaccgtcaacgactacctcgccagctaccagagcgagctgatgggccgtatctaccgtttcctcggcatgaacgtcggctgcatcatcaccgagcagaagccgccggagcgccgcaagcagtacaacgctgacatcacctacggcaccaacaacgagttcggcttcgactacctgcgtgacaacatggcatgggagaaggccgacctcgtgcagcgcggtcaccactacgccatcgtcgatgaggtcgattccatcctcatcgatgaggcccgtaccccgcttatcatctccggcccggccgaaggcgacgtgacccgctggtaccgtcagttcgccaagctggtgctgaagctcacccgcgacgaggactacgacgtcgacgagaagaagaaggtcgtcggcatcctggacccgggcatcaccaaggtcgaggacttcctcggcatcgacaacctgtatgagccggccaacaccgccctgatcggctacctcaacaacgccatcaaggccaaggaactgttcctgcgtgacaaggactacgtcgtcacccagggcgaggtgctcatcgtcgacgagcacaccggccgtatcctgccgggccgccgctacaacgagggtctgcaccaggccatcgaggccaaggaaggcgtggaggtcaaggccgagaaccagaccttcgccaccatcaccctgcagaactacttccgtatgtacgacaagctcgcgggcatgaccggtacggccgaaaccgaggccgccgagttcatgaacacctacaagctgggcgtgctgccgatcaagaccaacaagccgatgatccgcaaggaccaggacgacctcatctaccgcaccaagaaggagaagctggccgccatcgtcaaggacgtggccaagcgtcacgccaagggccagccggtgctgctcggtaccgcttccgtggaaagctccgaagtggtctccaccctgctcgacgtggccaagatccctcaccaggtcctgaacgccaagcagcatgagaaggaagccgccgtggtcgccgtcgccggccgcaagggagccgtcaccgtggccaccaacatggccggccgtggtaccgacatcatgctcggcggtaacgtcgagttccttgccgacgccaagctgaagtccgagggctactctccggaggacaccccggaagagtatgagaagcgttggccgggcaccctgaacgagatcaaggcccaggtcaaggacgagcatgaggaggtcaaggagctgggcggcctgtacgtgctcggcaccgagcgccacgagtcccgtcgaatcgacaaccagctgcgcggtcgttccggccgtcagggcgatccaggcgagtcccgcttctacctgtcgctggaagacgatctgatgcgtctgttcaacacccagctggtggcccaggtcatggccaagggcatggaggaaggccagccgatcgaggccaagtccgtgaccaagggcgtgcgcaccgcacagaaggccgtcgaatcccgcaactacgagattcgtaagaacgtgctgaagtacgacgacgtgatgaacaagcagcgtaccgtcatctactccgagcgtcaggccgtgctcaagggcgaagacatccacaaggacatcctgcgtttcatttccgacaccgtcgagtcctacatcaagggtgccaacaagggatccgagaaaccgaaggactgggattgggagggcctgttcaaggcgctcaacaccgtgatccccaccaaggtcgacgaagacgaggtcaggaagatcgtcggcggcctcaagggtgcgaaggccgtcgaggccgtgcgcgacctgatcgtcgaggacgccaggcagcagtacggcgaaatggaggagaccatcggcgagaccggcttgcgtgatctcgaacgccgcgtggtgctcgccgtgctcgaccgcaagtggcgcgagcacctttacgagatggattacctcaaggacggcatcggcctgcgtggcatgggccagcgcgacccgctggtcgaataccagcgcgaaggctaccagatgtacaactccatgatcgaggccattaaggaggagaccgtccagctgctgttccacatcgacatcaagcaggtcgccaccaccgacgaggccgttgacgaggtcgaggagaccgccgaaagcgccgacaccatcgccgtggcctccggccccgacgagaacggcgaatccgtggtcgaggccgccgagggcgaagtcgaggaagaggacgaggatacggacgccaagcaggcgatcgccgaatccgcagccgcctccggggccggcgagtccacgctgcctgttgccggaccggctccgatcagccacgccgaaggcaaggtcccggtttccaagcgtccgaagagcgaagagctcaagacgccgtgggccgacggccgcaccttccctggcactggcaagaacgccccgtgcccgtgcggttccggccgcaagtacaagatgtgccacggccagaacgagaagtgacgcatcgctagttagtaactagctcatggctccccacacggggagccattttctatgcggttcatcagcatgtattcgtgcggtgccgtacgcgcgggacggcacgagtgtcaatcgattgactagcgtggcgtcccgcagtacgaattacggaatcgttgaaattccgccattctcggtgttatggtgtcacggtccgcaaagggtgatgtgggacggcacggctcaaacggcgaaaatgagctgccgtcccgcagttttacgggatagcacaaaaaagaggcttctgctgttttcgtgggttgtcgggcgcgccgctcgtccaactgacgatgtggaacccgtcgggcgcgcgttcggcgttcgggcaccactcatgcacgcatgagtcgatccaccgggccccgtccccggcgacgaccctgatggaggcgcgctgttcgggcgtcaacgtttggaagaacaggccgaacacgtccctgccgtacccgtcgtgcgcccatatcgcccgatgccgttcgtggtcgacgaccacggtgatgcacgtgtggcctttgcggtagccggtctcgtccacgccgatcgacgtgaggccgccgaacggagacggcatcgacgctttcaaccgttcagcgaccctatgggcggcgtcttccggcggcgcgccacgcgacgtgcggaaaaccgcttacggtcttctggttcgcgacgctcatcggccacgcgcgttccgattcgaaatcgcgtgtggaccggctgcccggctcggcccacggcacggaagcgaccacgacgccgcacgccgccgccctggtcatgcccgcggcacctccttccgcatcgggagcatcggagcatacccgcacgtggacgcacccggatctcgagcacgggttcggaacgcggcggcgaatccgtgatccgcgcatcctctgcaaccgtgcctttgacgttcggcaatccggtgaatgggcttttgcccaggcgttcttcgtgattcatttctttggtcggaaaacagaatacgcgggaacgcccctcacgtttacgaaaccaacggctcgacgacgaaccgacatccacgaaaacagcaatagcgccatattttgcaatatggaagattcagggccttgaaatgacgaaccattacaatgagcggcgaacatacatcacacggcgtaggaaacgccaaggagggcatcatggccgagatcacatggaagtcgattctcaccaagctggtcgggggagaccaccttactgctgaggaatcggagtggttcgtggacgacctgatgcaaggtaacgccaatccggccgccgtgggtgccgcgctcgctatgcagcagcagctgggactgaccgccgacgaggtgcgtggtgccgccaaggccatggtctcccacgccgtgccgctgaacgtttccggtgggaccaccgacatcgtgggcaccggtggtgacggcttcgccaccgtgaacctgtccaccatgggctccgtggccgccgctgcagccggcgtgaagatcgtcaagcacggcaaccgcgctgcatcctcgaagtgcggtgccgccgatgtgctcgaagacctcggcctgccgctggatttgaagccggaggccgtcggcgaagtgggcgacgaggtgggcatcaccttcgcgttcgcccgcaccttccacccggccatgcgcttcgtgggcccgattcgtgccgcgctcggcattccgtgcgtcttcaacatcctgggaccgttgaccaaccccgccaacccggcacacgtggccatcggctgcgccaaccgcaaggtgagcccgatcatggctgccgtctacgccagccgtggtcagtccggcttggtctacacttcgcatgagggcatggatgagctcgcccccaccggcccggtttccgtctgggagattcgcgacggcaaggtcaccgaaaccgagttcgacccgaccgtggatctgggtctcgccaagattaccgtcgaccagctcaagggcggcgtgccggacgtcaacgccaacgcattcaaggacttcctggccggcaaggacattacgtcccgcaccaccgcgctgctcaacgctgcctccgccatcgtggctgacggcaatctggtcggcaacggcacactggccgagcgcttcgccgaggcctacaagctggccgaggatgctgtcgactccggcaaggctgaagccctgttcaacaagtggatcgaaaccgccaagtccaaggcgtgatatggaatgggtttgctcgaatatatttacctttccttcattatcaactatttcgagttgcaggagtccatcgacttcaattcgtgacctatcttggctcggccgcaattacggacgagctacgcctgtgatacattggttcgctatcgctcacacctcgcctacaaacagcccactgggctgtttgcttaacggctcggcctcagagaggggagccaaggactacacaacctacgcgaactacaccctcgcgccgtcgtcgtattagccaccctgatcaccggggcggtctttgcggttgaggattttggccaccaatccgcccagacccaaaatgacgcccagcccgaagagaatattgagcagcgcgcctaagagaggaatcgcgttcaagccgggaacgaatatcatcaccgtttcgcctgcgagaccgatgatgagcaacgccgtcagcagtaccgtagatgctttgaccggaccaagatcagggttcgggggagtgaagccgccatcatcataggcgtccatcacattatcggtatccagccagctagagccggtgaaatcacgggggcctggctgcttgccttttttgccgccacggctcgggcgagcatcatcggtgaacgagccgatatccaagtcatctacggaaagcagtgcttccttctcgcgtttcttggcctgcttctcgaactttttggcctgcctggaggaagccacgtcatgcaagtcggcctgatgctcggcttcgaacgcggcccacgccgcatccaaatcgttcatgtcatgcgattgcggtgtatcggcaccattcgtggccggtccggcggcaccgggagtcgacgacttggacgaagtatcggaatcctgtccgttgcccggcgtgggggttggccgctctccgtcggcattgctattctggttctcagtcataactgtcactctaatcaggcgaccggccaatggctagttcgtctgcgggaggaatgccaagtgctctactggttcttcgtcaaaggtctcggccctattgctcatcatcgtttgagccctgctgtcagcggactgaataacgtgcctcgagagggtggcgcgattatcgcagccaaccatctggcggtgattgacgatgctttgattccgattacctgcccgcgcatggtgcacttcatgggcaaagccgaatacttcgagggcaagggattgaagggcaagttcaagaagtggtggttcacgtccgtgggcgtgttcccggttgatcgttccggtggcagcaagtcgcttggcgcactcgagcatgcacgcgagattatcgaggatgggcacctgttcggtatccacattgaaggcacgcgcagcccggacggtcgactgtacaagggacacaccggtgccgcacgacttgcgctcgagaccggttgcccgattgttccgaccgccatcatcggctcggacaagctgcagccgattggcacgtcgattcccaagaagggcaagaccaaggtgttgtatggcaagccgattgaggttgcgaagaagccggctgatgaaattacacatgatgatttgcgttcgctgaccgatcgtgtttccaccgcaatccagaaaatgagcggtcaggaattcgtgaacgaatacgcccagaaggtcaaggccgagctcaaggcccagcaggccgctgaagaagccgaaaagtaattaacaaatgaggctccctcgtctgaagacagagggagcctcattcaaatctcacacgatggtgagggtgatgacggtggggttgccgttggcatcgcgcaagcgaatcttgccgccgttggataggtccgtatcgccacttttcacggtacgtaccgtgccgaacaggccaccgagcaccttgtcggttttcacctcgaacccgagaccttcaagtgtcttggttacggcgctttcctgtttgccgacaaggccggacggtatcgtcgccatctccggacccttggaaatcaccacgtccacgctatcgccccacttcagctgggctccggcttcctgagacgcggaaatgacttgaccggcctcgaccttgtcatcgtactgttcggtgacattggccgtgagcttcaactcgccgagcgcggcttgcatctcatcctgggtcttaccgacgatgttaggcatggtcaccggcatcggtcccttgctcaaagtaaccgtcacctcatcgttgtgcttggccgtggtaccgggatcaggggagatcgtcaatgccacaccctgcggcgtgtccatcgaatactcatccttcgactcgtcatgcttgacattatcgaagccggccttcttgagcgcgttcaacgggtccttgccattggccgaattcgcgtcgagaatatccttcgggatggtggtcatccgcacgcccttggacaccaccaccgtaagctcctgattggctcgcttgcttatgcggctgttcacaacggccttggtcttgttcacggaagaagagatgatcttgccttccgccacgtcgtcgctgtattccttgtgcgtcttgtaggggatgccgagagccttcaacgtgctctcatacgtggcccaatccgcgccggccaacgagcattcggtgcttgcattcgcatcgcaggtcacgtcatccggcttgggcacactccaatagctgcccggtccggcaaaccaccaccagccggcggttccgccgattgcagccagtaccagcacgatcaccagtacgatgatgagcggttttttgctgcgctgcttctttggcccggtgccgttggaagcgacgtccggctcatcggaaaaggcaagcgctcgggtgaaggcatcgccggcctgaggcagcacttgtgtctcgctgccggactgtgccatgatttgcgtcttatggggagccgaagcatcggctggcgtcgacgaatcaagtgccgtggtgggggcgaccggaggagccggaggattgacgtctgcggcgccaccggtatcgacggtattgcttgcgacatcatcggccaaaaacgctggtacggacggcttgaacgttgctgcaccggcaggtacgccggtcagcggggcctgctcggcgatattgcctaccagcgctgcagcggtggcatcggtatgatcacctccgatgggttcggcatgcaaacggtattgccacgcctccagcggcaatttggcggccaactggctcaattcctcagctgctgccgcgccatcggtggggcgggcatccacctgacgcgcggtcagatgggcgatgaacgccgccacggacggatcaatgccctgacagaccgtggccacggacggcacgtcctcatgaacatgcttgaagacaagcgtcaccggattatccgaatcgaacggcaccttgccggtcagcatctcccatgccatgatgcccaccgaatacaggtcgccttgcgcggtggcctgattgttctcgatcatttcgggagccagataagcggcggtgcccaatagcatgccggtggagctcaatgtggcctggctggcggccttggccagaccgaaatcagtgatctgcacatggccgcgatcattgatcaaaatgttctcgggcttgatgtcacggtgaaccacgccggcgcgatgtgcggaagccagaccatccagcgtctccgcgaccacgcgcagcgtctcacgtacggagaatgtgccttgggcgttcatctcatgccgcagattgacgccatgcacatattccatgaccagaaaatcaagtccattgaactcgccggtgtcatacacctgaacgatgtgcgggttggcgatggacgcggccgaattggcctcgcggcggaaccgttcgacgaactgctcccgatgcgggcctttggcgagttgtgtgtgcatgaccttaatcgccacggtgcgccccagacgctcatcgatggcctcatacacggtggccataccaccctcggcgatattgcgcacgatgcggtagcgtccctcaatcatctgtgcgggctcgttctcactcatgttgtatcgtacggttcctttaatcacgactaaacatgttcagtgtacatggccccggttacgcggccggagcatcagcgcatagttttcacgggttttcaccggtgttcatggtctcatggtccggcggctcgcattgtggactatcgcaaggattcggggacgaatcgcgcacaagcctcggtcagacggcgttgcgcttcggaattcagctcaagaccggcaatcgccttacgggactcaccccatagggcagcgatgcgctcgcgggatcgatcaagagcaccggtcgacgtgaacagttcaatggtgcgggccacctggttgtcattgcgacaatcttcttcgaagatggcaatcagatcggccttatccgccgtatctgccgcagacagagcatcagccaacagcactgtgcgtttgccttctcggatgtctccgccaattggttttccggtattgcggcttgatccgacgacatccaacaggtcatccgccagttggaacgccagtccgagcggccggccgacggccaacgcgcaatgcctggcctgatccgggctctctcctgcggccagcagtgcaagcagcagtggagcgatggtggtgtaactggctgtcttccagcggaatacgttcaatgaggcgttcgccagagcttcgggattggacagtggggtcatctcgacggccaagtccagtacctggccgatttccacctcgcgttgcatggtaagaaacgcctcgttcagggcatcggtgttgggaagacggctggcggaccggcgtgtgatttcaatgcaggcggtggccagaatgtcgccgagcatcaggcccaagccacggcctatggcaccgctgtgtacggcctgttccaaggcacgatgtgcggaaggcctgccccggcgcagatcggattcgtcgatgatgtcgtcatgcaccagtgcggccgtctgaaacacttcaatggcgcaggccaggtcgatcatggcgtcacgccgatcaggcgtcacgtcgccggcaagaatatcgaaggcgtccaatgcgagcagcgcacgcagtcgtttgcctccttggctggaggaggcggcttggtccacaacctgttccatcaccggtttcagggcgtcggcaacctcgtcggtggcgggggcggcagtcagttcccgcaccaactgaatgatgcgtggctcgatgatttcgcggttgttagcagttgtgcacatgcctaataacttatccacagggtttgaagaacacaagaacgttgggaatcaagggttttgaagctagaaccacaatggtcgttttttcctgcgtcatacggcgttttcagccatagtgggcacacaccccctcggcgcatgagctatccggctcggcgcgcaccacaacaccaatagattgcacaccattagtcaaggaggacatgatgaacaacaacacgccgcacaagccgcgtaagagccgacacgccaaacggcacgccgccgaacagacggagccctttggctttgacgagttggagacgagatcacaggaatttcgcaatgatcgacgacttcgaggcgtgcaacaggctaatgccgactgggtggccgaaccattggacgaatggctgtcttgtcttgatgccgggaacaccgacctaggccgagagacgatggccgcgtttgcggtgggcatgcgtgagaccttatcgattcgtgatgcgctgattctctcgttggttattgatgaaagccgttgccccaagtcatggctcatggaattcgcggcgcgaccgcatctggcgcgtacgagaacacgaatgggcgagctgctgacctgcgcattcgaggatgaaggcatgatgccggataaggagcgttgccatgccggcatcggtatgttgctcgatatcgccgaagcctcaccggtgccgtactgcatacaaccattggccgtaatcgcctacaccttatggtggctgggcgatccgcgagcaatggtgttcgccttgcgatgcctgctgctcgatgaggattgttcgctggcggcgatgatattctcagccgccgatcgaggcgtggcaccggcatggtgctcgggctgaatgaacagaaacggcggatttccgaggttttatgcgcgatgcgcggaaggaaagcgtgtggtgatcggcaacacgtcgggcaacgatgtgggaataatcgtccgtggagggtggtttactcacatagttgacgatttgcccttgccagaagtgggcccgtgtggtatatgcacttcacggcgagagatcagaaggagcagttttggccacgaaggaaacgacggcaaccaagcagacagccgagtccagcgaggagaccgagaccaagaagaaggccagctctacgaccaccgcgcgcaagacttctaccaagaagtccaagtccgcagagccctcgaaaaagaccacgcgcaagtccgctgcgaagaaaaccgcgaagaaggccaaggacgatgagctcgtcaaagacgaggacactcaggtcgatgacgagcttgatgacgatgccgaggtcaacgacgacgatttggatgttgacgacctcggcgaggatcttgacgacgttgacgaaggcgatgccgacgacgaagacctcgatgaggacgatgccgacgacgacgatgtggaagacgacgaggacgaggaagaagccaagtccaaggcacccgagcagcccaaggaaaagggtgcctacgtggtctccgacacggatgatgaggaagagaacatcatcccttcgggcaatccgaagcgtcgtgtgatcgcggccggcgcaaccgccgacccggtcaaggactacctgaagcagatcggccgtgtgagcctgctgaatgccgagcaggaagttgacctgtccgagcgcatcgaggccggcctgtacgcccagcacctgctcgacaccgaaagtgaaggcatggagttcaagcgcaagcgtgaactcaagtgggccgctgccgacggcaagaaggctaaggaccatctgctggaagccaacctgcgacttgtggtctcgctcgccaagcgttacacgggtcgtggcatgctcttccttgatttgatccaggaaggcaaccttggtctgattcgtgccgtcgagaagttcgattggaagaagggcttcaagttctccacctacgccacgtggtggattcgtcaggccatcacccgtgccatggctgatcaggcccgcaccattcgcgtgcctgtgcacatggttgaagtgattaacaagctgtcccgtgtacagcgccagatgctgcaggatctggggcgtgaacctacgccggacgagctggcccgcgagctggatatgccggttgagaaggtgcaggaagtgcagaagtacggccgcgaaccgatttccctgcacaccccgcttggcgaggatggcgattccgagttcggtgacctcattgaggataccgacgccatcgctccgtccgacgccgtggccttctccctgctgcaggaacagttcaagcaggtgctggaaaccctgtctccgcgtgaggccggcgtcatcaagatgcgctatggccttgaagacggccagccgaagacgctggacgacatcggccgtgtgtatggcgtgacccgtgaacgcatccgtcagatcgagtccaagaccatgtccaagctgcgccacccgtcccgttcgcagaccctgcgcgacttcctggatcaatgatcatctggctcccctctgtgaggggagccaagcatttgaagagaaaaataggactgtatgcccaaagaagaatacggcgccaaggacctagctgttcttgagggcttggatgcggtgcgcaagcgtccgggcatgtacatcggcaccaccgactcgcagggtcttatgcactgcctgtgggagatcatcgataactccgtggatgaggccttggccggcttctgcaacgacattgtggtcaccctgcacaccgacggttccgtggaagtcgcggacaatggccgaggcattccggtggataaggaaccgaaaaccggcctgtccggcgtggaggtcgtactgaccaaactgcatgccggtgccaagttcggcaactcgtcttataacgccgtcggtggcctgcacggcgtgggctcctccgtggtcaatgccctgagctcccgactggacgtcgaagtggatcgtgacggcaagacgcaccacatgaccttccaccaaggtcaccctggcgtatacacggatgccgacccggccaatccgtctcccgattccccgttcaagcgcactcgcaagaaccgacccaccgagctggaaatcatcggcaaggtatctcccaaaaccactggtacccgtattcgctactggtatgatccggagatcttcaacaaaaccgccgagttctcatacgaacagctcatcgaccgcgtgcgtcagaccagcttcctggtgcccggcctcaaaatcaccatcatcgacgaaaacgtaccggaaacggcggcgactgacaccgtcgaggccactgatgacacaacagtcgaacctgcgcaagaccaggcaccggccttggatgtctcgtccagcgatgccgaactcttcgacgactccgccgaatcccagtccgacgatgccgagagcccggccgaggaggacttctcgctgacggccggcgaccaggtcgtcgatggcgcgttcggcgaacagcccgcgcacccgcgcgtcgtggaattcctgcacacaggcggcgtcaaggacttcgtcgacttcctgtccaaaggcgagccgatctccgacatctggcgcatccaaggcgagggcacctataaggaggagacccaggccgtgggcaagggcggtgaactgcacgcccaggaaatcgaacgcacctgcggcgtggatatcgccctgcgatgggtcaacggctatgacaccacaatcatgagcttcgtgaacatcgtggagacgcccggcggcggtactcacgtggacggtttcatgaacgccatcaccaagcagattcgcaaggcggtggaagacaacgcccgcaagctcaaggtgaacatgaaggactccgccatgaaggtggagcgcgacgatatccaagccggactcgtggccgtggtcaccgcacgcgtggccgaacctcagttccaaggccagaccaaggacgtgcttggcaccgcgcaggtcaagccgatcgtcacccggctcaccgacaagcaattcggcgagatgatcaccggctccaagcgcgggtacaaggaacaatccggccgcgtgctggagaagatcgtcggcgaaatgcacgcacgcatccagtcgcgcaaggccaaggaggtcacgcgccgcaagaacgcgctcgaatccgcctcgatgccggccaaactctccgactgccagccgggcaatgacgacgtggccgaactgttcatcgtcgagggtgattccgcactcggtaccgccaaggccgcccgcaacgccggtttccaggcactgctgccgattcgaggcaagattctgaacgtgcagaaggcgtcgatcacgcagatgctctccaacaaggagtgcgcggccatcatccaagtggtgggtgccggctccggccagagcttcgacatcgaacagtcgcgctatcacaagatcatcatgatgaccgatgctgatgtggacggtgctcatatccgtatcctgctgctgacgctgttctaccggtacatgcggccgcttatcgaacacggctacgtgtatgccgccgtgccgccgctgcaccgcatcgcgttgacaggctcgcacaagggcgaatatatctacacgtattccgatgacgagctggccggcaaactggccgacctcgacaagaagcgcatcggatacaacgacgacatccagcgatacaagggtctgggcgagatggacgccgaccagttggcggacaccaccatggacccgcgcacgcgtatgctgcgccgcatccgcatggaggacgccgcccaggcatccgagatcttcagcctgctgatgggcgacgacgtgccgccgcgcaagcagttcatcgtcgacaacgccgacgatttcgaccgctccaagatcgatacctgaccgtcctatctcaagctccctctgatgagggggtgtcagcgaagctgactgggggagaggcctcgggtggtagcgggctactcgtatttctctcccctcagtccgtctttggcggacagctatttcgtcagagggtgctgcggtatatcatcaggatttcatcgagtgcaccgccgccgattatctcaaggacaactacgacatcatcggctttgacccgcgcggcgtagccgattccacgccggtgtactgcgggcaagactccaaactgtgatgtttgcgtgttgctgaagcgctattcgatagactgatgacatcgttatcacaaccggtgccgtactgtgaatgggagatgggacatggccagtctgttgcttgccgtcatctatgtggcgtttatcagtctgggattgccggattcgctactcggatccgcatggcccaccatgagccaggatctgaacgtgccggtggcgtgggccggcggcatctccgcggtgatttccatgttcacgatcgtctcggcgctgctttcggaccgaatgacattgaaattcggggcaggcaaggtcaccgccgtttcggtggcgttgactgcggcggccttggccggtttctccgttacctcgaattactgggtgctgttggccatcgccataccatacggccttggcgcgggcggagtggatgcggcgctcaataactacgtagccattcactacgaaagccggcatatgagctggctgcactgcatgtggggcgtcggcgcatcggtcggcccctacatcatgggctatgcgctctctcaaggccaaggttggccgtggggctatcggtacatcgcgatcctgcaggtgatgctgaccgtcatcctggtgctgagcctgccgctgtggaagaaacgtggcgcaattgcggtcggcgaatcgaccgatgacaccgcatcatctgacggcaatgccgagagatttggcactgctgaaggggtgtctgttgccgaacgcaaaccgctcggcgtggccggcgtgctcgccattcgcggtgccaaggaaatcctcgtgatgttcttctgctactgcgccgtcgaatctacggcgggcctgtgggcctccagctatatggtgatgcacagcggcatcgacaagatcaccgccgccagctgggccagcctattctacgtaggcatcaccgtgggtcgtgcgctttccggctttctgaccatgcgattcaaggacccggtcatgattcgcctcggccaagtgctggtgttcgccggcatcctcaccatgttcgtgccattgcctcaccaccttggcgtggtcgttgggctggtggtcatcggcttcgggtgcgcgccgatttatccgtgcgtcatccactcgacgccggcctacttcggcgaagacaaatcgcaggccatcgtcggcgtgcagatggcctgcgcctatgtgggctcactgctcatgccgccactgttcggcatcatcgcgcaatatgtgacaatcagtctctacccgtggtatttgctggtgctcttggtgctgatggtggccatgcacgagcgtcttcgcaagttgcgcggctgatcatatgcgcatttgggcccgtcgcctactatgcttggagcccatggtgataagtggagaagaacatgaacagatgcccgagcccgtacgggagcgattgagagcgctgaaggatgcgccgggctcggtaatcgtggtcggctcgatgaacgccgattacaccgtaaccactaaacgactacccaagccaggtgaaaccgtcaatggtggtgccatgaaagtgctgccgggcggcaagggcgcgaatcaggcatctgccgcctctcgtctcggtgtcaatgtccagttgctgggcgcggtgggcgaggactccaacgcggacttcctattaagcaagctggatgaggccggcgtcgacaccgccgatatcctgcatgtcgaaggccccagcggcgccacggtaatcaccgtgagcgctgagggcgagaacaccatcgtctattcgccgggttccaatgccaaggcaagtgccggctatgtgcaatcacatcgcacgaccatcgccgaatgcgcggtattgggactgtgtctggagagcccgattgccaccgttatcgccgccgcgcagaccgcgcatgacgctggcgtgaccgtgctgctcaacgactcgccatttatggacgagctgcctcacgaactggtggaagccacggatattctgctggtcaaccagcatgaagtggctcaactgctgggcctgccggatgatgacgtggaatcactcgactggtatgaggtcgccgaacgattcaccgattacggattcgaccgggcgatagtgacgcttggtgcgtcgggatcggtggtgatcgagaacggacgttggcatcgcgtatccgccgcgcaagtcaatgcagtggacaccaccggttgcggcgactcgttcatggggaccgtgctggctggcttggccgccggtcatacgctgctgcaatccgcgcaaatcggctcctacgtctccgcctatgcggccaccaagtttggcgcccaaagtgcctacggtaccgccgaagaagtcatcgcctacttcagctgacctataatcgtacatatgtacgaaagcctgagcctgttttccgaacccaccaagatgtggttcgagcatgccttcggtcagccgaccgaggcacaggctcagacatggccggcaatccattccggtcgcaatgtcttggtcatcgcccctaccggttccggcaaaacattggctgcgtttctctcagccatcgaccgattgatgaccgtgccacgcacgcggcgtgccggtgtgcgtgtgctgtatatctcgccgttaaaggcgctcgcggccgatgtggccaagaacctagaacagcctttggagggcattgctgcacaatgcgaggcgcaagggctgcccgtgccgaagatcgcggtcgccactcgttcaggcgacaccaccgcacaggagcggcggcgcatagcctcccatccaccggatatcctcgttaccacgccagaatcgttgtatttgttgctcacttcgaaggcagggcggattctcggcactgtcgatacggtgatcgtcgatgagattcatgcagtggcgggcaccaagcgcggcgcacatttggcggtaagtctggaacggctggagaaccttgtcacagaatcgcgcaagcgagatgcaatcgatgcagatgctgatgagggcggtgatgccgccgtcgatgctggccgtggcgatcgtcatatgcagcgcattggtctatccgctacggtgaatccgcctgaaaaggcggcgcgattcctgggcggcgggcaaccggttaccatcgtgaatcccggtgggcggcctgcaatggatttgcgcatgattgagccgttagaaaacatgcgtgatttgcagtccgtgaatgccaagcagcgtgtcggtggcgtggatgctgaacggtccgctccgcatatcagtggtgtcacgccggccatgcagcgacttgctgaacgcaggggcattgtgccggtggatgatagagatgtttcttccacttctggggacgattctgatgcgagtgatgcgttcgattcctccgcgttggttggagcggcgggcgaccgtacctccggttccatttggcccgtggtggaacgcagtattttggatgagattctcgcgcaccgcactacattggtgttcgttaattcgcgtggtgtggctgagaaactcactgcgcgcttgaacgatctgtatgcgcagacccggcatggcaccaatcccgacactgtgcgggatctgggctctccggaaggccgcgaagggttctccacgcattacgatgctgtggtcggctccaccaccatgcttgtcggctcacatgagggcgatgatgtcatcgccatggctcatcatgggtcggtttccaaagaccgtcgcaaaatgattgaggaacggcttaaacgtggtgaattgcgttgcgtggtggccacctccagtttggagctcggcattgatatgggctcggtcgacttggtgattcaagtcgatacgccgttgtcggtctcctccggattgcagcgtgtaggccgtgccgatcatcaggtcggtggcgtctctcacgcattgttctacccgctcacccgtcagcagattgtcactggggccgcaagtctggaagccatgattgccggcgatatagaaccattggccgtgccgcgcaatccgctcgatattcttgcccagcagaccgtggccgctgccgcgatgcacgatttgaacgctgatgactggtatgccacagtgcgtcgtgctgcgccgtttgccgaactgccacgtgacatgttcgatgcggtaatcggcatgatgtccggcgaatacaacagcgaggaattctcggccttccggccgcgactggtatggaatcgggataatggcctgatttccgcccgtcccggttcgcagaaagtggccgttacctctggcggtacgattcccgatcgagggctgtacaccgtggtcctgcctgaggcggacgccggcaaaggccagcgtcgcgtcggcgagttggatgaggagatggtctatgagtcgcgtgtgggcgatgtcattacactgggtacctccacatggcagattcaggacatcacccgcgaccgtgtggtggtgacgccggctcccgggcgcaccgcacgtctaccgttctggcacggcgaaggttccggccgtgactacggtttcagccgtaccatagcccgcttcacccgagaaatcgccgccggattagacgtgaagcggactgaggggaggtctgccgcagaaggtccagctgtcccaaccttcatcccaacaatcctcacccgtctccaccacgatggcctagatgccaacgccatcaccaacttggcccgcctactctccgagcaacaagccgccactggtgcagtccccagcgaccaaacccttatcgtggagcgcacacgcgatgaagacggcggatggcgcatcgtgctgttaagccccttcggccgccgcgttcacgaaccgtggtccatggccatcagccgcagactgcgccaacgctacggtttcgacgggcaggtatatgccgccgatgacggtatcgtcattcagctaccggacggtgacggacatattcctgctcaagacctgttccttttcgacccagaagacctcaaagcagatgtagagcgtcaagtgggcgagtccgtgctatttgccgcacgattccgcgaatgcgccgcccgatcactgttcatgccgcgatccgacccgggccgtcgcgtgcccctatggcagcagcgactgcgcgccgcacagctcctgcaatccgcacgtatggccaagaactttccgctgctgctggaaaccgcgcgcgaatgtttgcaagacgtatacgacatgcccgccctgaacgaggtgatgaccggattgcaagccggcaccattaccgtgaaggacgtggaaaccgagtcgccatcgcctttcgccgagaacattctctttggcttcgtcggcgtggtgatgtaccagtatgaccaacctcaggccgagcgtagcgcgcaactgctgtctctcgatccgcacgtgctcgaacgcttgctcggcaccaccgatatggcacaagtgctcaacccggacgtgattcgcgaagtcgaacaggaactgggggagcacactttctggaatgagcttgccgacgatgatgtgactggtcgcgtgacccgttacgccaaaacccatggtcctttcaccgccgatcagctcatagccgatctacacctcgatgctacggatgccgtgcacactctggatgtgctggctgccaaaggcgagttgctgcaaggccactttgtagatgatgacgagcaaggccaacagtggctccataaggacgtattccgccgtattcggtctcgctcattggccaaggcgcgtaaagcagtcaagccagtagaatcagaggcgttccagatgtttcttatcgaccgacaaggtatcgggccggtcggcggcgaacgatatgaaggtgctgacgggctcatgcgcgttatcgagcagctggagggcatagcactgcccactgcactctgggagtcggcggtattccccgcacgagtacgagactaccaacctgcattgctggatgagttgctgaccagcggcgatgtggtctgggtcggctcaaaaaccgggggaaccagtgcgatggaccccggtgaggttgctttctatccggcggattcaatattgttcagcggtgtggaacatggtacgacatcgaacgcctcagacgccaccatgccggaagcgattctgaccgcactggactcagggggagcgttccatgcccgtcaactgatggatgccgccaaacgtgcgtggaatgagaccgcggagccggacatcaatccaaacaccggcgaaatcattccgcaagagtggagcgaacagcagttcaaggatgccttgtggagcttggtctggcaaggtaaggtcaccaattccagcttcgcgccggtgcgtgcattaaccgcaggcgcagcaagcccgcgtaaatccactacatcacgtcgtcgtgggcgtgtcgctccgattcgccgagccactacggatatgacgttaggaggtttgtggtccgccgtaatcgggcaagctgaagccgaagacaccgaccagaccgaacgggcactcgcactggtcgagacgttgctggacaggtatggcgtcatcgcgcagccggtgattgacaaggaaaatatcccgggtggctactcagcgttgtatccgatattgcagcgcatggaggagcatggtcgactggtacgaggcatgttcgtccgtggtttcggcgcggcccaatttgccgagcgcgacaccgtggatgcgttgcgtcatccgtcagagcatcgcggccagtccgtggtggcattgagtgtgctcgaccccgcaaatctcagtggctccgccatcgcgtggccggacgcgcctgccggtgcgggtaaaccggcacgccgtatcggagccacggtcgtgctcaatgcgcaaggcgcgctactatacgcggccgccaaagccaagcacctgacagcgttcgatcaatcggtcggccatgaagccgctgtcaatgattccgacgaacaaatgcgcaaggccgccacagaactggcctacgccctcaaacgcaatggcaccggctccgtgacattcagcgacatcaatggcgaacccctcaacgcccgtcaccccttcgcccgcatcctccaccagtccggcttcacccccgttccccaaggcatgcggctgtactgattgagcccagctatcgaatgcggtagttggagcctcgttgggtcatgatgaggccggcgcgggtgagcttcttatccagtgtgtagagggcgttcttgagtaagccctgttgctcgaagaatgggccgccgataagtttgaccaactcgctggtgttgacgaactggccatcagccttgaccagcgcttcaagcaaactgtattccagacgggacagtgagattgcgctgtgagtggatgcgtagtaggccttgtgattcgtggtgtccaacgtgagattgccacgaatgatcatggcgggggagtcggtggcaagcgagccgacgtatgagagcagttcgccatcggagaatggtttgctcagcgcggcatctgggcgtcgtacgttagcttgtgcgctagaggcagcattgtccgagcgttgttcggcttcggcatctgagttgtttgcgcgtgaattcgcgctgaaggagctgtagggcgtctcttcgataggggcgtactcgtcaggcagcgctcgccagcggctgccttcaccaatggttttgctgagtggcgtcgaagtcagcagcagaatcttgacggaggcacgggcattgcgtagggattcgatgagctgctcggtggaaatgccgagcagggattcatcaagaatcactgcgtcaaatgactccttggcgacagcggcgagcgcgatactaccggtgcttgccaaagacacctcatgacgaccggcaagcagggcaccatgaatggcgtgggccaacggttcattggatacggcaaccagtagtctcatcgccacctccttaatgcttagtgtaggccgggtttagggtctcttctctattgtttggctcactatcgttcgctcctcgcctacaaacaccccactggggtgtttgctttacggctcggcccatcagagggagcttaattgaggttacgcaatgaaggcgatgggggaggcgaggtctactccggaaccgtctcggcgcatatcgggcttgggaagctcgaccggagagcctgcggatgtagaggcgtgcaacgggtagaggcccacccaggcaagaatcagcgtgttctggcccttcaggaatcgctgggaacgcacgccgccggtagcgcgacccttggtggggtacatttccagcggagtgaccttcgccgcgccgttttcggtgccgggcagtgcatcggaatcgccggccacggtgagcaccactgcaccggatccggaagtcaagccgttctcgccctcttcataggtccatgccaccttgccggcgggaaccacgttgaaggccgccacacgggcgccctcggccagcttgatgccggccataccgcccgcagtacgaccctgcgggcgcacgttcttcgcctcaaaggtcagtagcgaggaatcggaggagatgaacaccagacggtcgtcatcctcggccacggcggcgaataccacttcgtcgccatctttcagatcaatgacgggccaagaatccatggtggtgggtgcctcacgattccaacgcttgatgacaccgttacgggtaccgatagccagcgacggcaacggcttggcctcggcggccccgccatcctcgctctcgtccttggcactggtcttgccggacgtcggctgctccatggcaatcgccgtaatcacacgctcaccgcgaatcggatcggtggattcggtcatgccgatcagttcgtcggcctgaactcctcccttcagcgacaatgtggcggtagcgggcaaggcaggcaaatcaaccacatgcgcgagcaccaggcggccggccgacgtgaccagcccatacgtagcgcgcgtggaagtctcgaagattgtggtgatctgatcgtctctcaaacgctcatcggaagtggatcgtgcattgaacacgtccatcgcgcttggcgtggtacgggcaatcaaaccggtagcgctcatcatcaccacgcacggctcgtcctcgatcttcaaggctccggtcagcgtggactgttcgccggtcttcttggccgcagctgcggctgcggccacatcggcttcggcggaggagatcgtagtggcggccttcaccgcttcgagcgcggacttggacacgcccgaagccccggcaccctgcgccacgaccggcgtcaacgtgccatccgggtcggcatccagcagcacggtacggcgcggcgagccccacttggcgaccgcttcgtccatctcgtcggtgaccacctggtcgagcgcctcggcggaggccaggatccgggtcagctcctcgatacgcttcttcagatcatcgcgttcggcctcaagctcgatacggttcatcttggtcagtcggcgcagacgcaggtcgaggatgtactgagcctggacctcgtccaaatcgaaaacgaccatcaaacggctcttcgcggcatccgcatcatccgaggtgcggattacctgaatcacctcgtcgatgtccaacatggccagcagcaggccctcgaccaggtgcaggcgctccagcgccttcttcttgcgatattcactgcggcggcgaatcaccacacggcggtggtccacccacacctgaagcatctccttcagacccatcgtgtgcgggcggccctccaccaacgccacgttgttcatggcgaagttgtcttgcaacggtgtgtgcttgaacaactgcaccagaaccgcatgcgggtcgaaaccagtcttgatctcgatgacgatacgcgtgccgttatgacgatcggtcagatcgaacgcgccggaaatcccctccagcttgcggttcttcacaccgtcggaaatacgttcgattaccttctccgggcccaccatgtacggcagctcggtgaccacgatggcctgcttgcgggccgtgacatgctcgatatgcgtggcggcgcgcgtggtgagcgtaccacggccagtggcataggcctcacggatgccgtcgcggccgatgatcgtgccgccggtgggccagtcggggccgggcacgtaacgcatcagctgttccagggtggcgtccgaatgcgccatgaggaacttggcggcgtttaccacctcgcccagattgtgggtggccaggttcgtggccatgcccacggcgatgcccgagccgccgttgaccagcagattcgggatggcggccggcagcacggtcggttccttgagcttgttgtcatagttcggcgtgaagtcgacggtgtcctcatcgatatccgcgttcatgccgagagcggccgggccaagcctggcctcggtgtaacgggaggccgcagggccgtcatccagcgagccgaagttgccgtggccgtctaccagcggcagacgcatcgcgaacggctgtgccaaacgcaccatggcctcgtagatcgcggaatcaccgtgcgggtggagcttgcccatcacctcgcccaccacgcgggcggacttcatatacgggcggtcgggagtcagattcatctcgcccatctggtagacgatgcggcgctgcaccggcttcaagccatcgcgcgcatcgggcagtgcgcgtgcgtaaatcaccgaatacgcatactcgaggaaggacttgctcatctcctcgttcagcggcgtctcgacgatatgctccttgaccgtgcgcggatcataggtttgcgcggacggtttgcggtgtgatgccatgaaactccctttcgaacgcccccatattagcgggagggcgcgaaacagtgcgcagagaacggttctcgataacaactgtgcgctggtttcggtgcgccaatcgcacatgtttgccgataaaacggcgtgattccagtgtttcagtcgatgtgcgtttgtttgattatgtgcgttggagcgcacagttgttattgagaaccgttctctgcgcactgagccaaggggaggggtgctacttgaatgggcaactatgagtgttgagacgccggatatggacgagttgctgcggctggtgcccacagtgggctatggggatgacgccccggccgatcggcgtgggggagcactgcacctgtccgccgtgctgcccgccttgtccgccgccatcggacatccggcccccaccaaggtccacgccgatcccaaggcatgccagcgcgcgttggggctgcccgatgccgaatcggccatcgtggtgctcgtggacggcctgggctactggaacctcgccatgcgcctcggccacgcgccctatctgcgttcgctgatgaacgaaagcgccaatcagcgtcccatcgctacctgcgctccaagcaccactgtggcggccatggccgcattcggtaccggaacctgcccgggactgaccgcaatggcgggctatacgcagctcgaacccgccagccataagctcatccaactcatccagttcaaagacgcgctggcacccaaaccagccaatccgcacattcctgtgccgcccatggtcgatccgctcgacctgcagcgcgaggagacggtgttcgagaaacttgcggctcaagaggtgcgcgtcacgagctcggggttgcccaagttctccaaatcgccattgaccgaagccgcattgcgaggcaccgactatcaaggcaacgtcaccccacgcgatcgtgtgctggccgccgcacgcgcctcccgcacccccggcctgacctacctgtacatccgtgacgccgacaaagtcggccacaattacgggtgggattccgaacactgggtggccgcattcgaacatatcgacgcccagctcgcgctcctgaaacgcagcgcacccaaaggcacgctgatcgtcatcgtagccgaccacggcatggtgcaaaccgacatggaccagcggattgacatcgccgttgaaccgcagctcacccgaggcgtgtcactggtcgggggggagccgcgctcgctgatgctgtatgccgagccggatgaacgacctgaggatatagcttgccggtggcgcgattgtctgcaagaccgagccttggtgcggaccaaggatgaggccatcgcggacggattgtttggaccggtctgcgagcgagtccggccaatgctcggcgatgtggtcgtgcaggcagcgggagccgtgaccctcgtcgattcgcgtacgcaaggagacaaggccacccacctgccgagcgtgcatggctcccaaacagcattggaaatggatattccctgcctgatcgatatggcctgattcggaaattcagtctccgaacagaatctcgtcccagcttggtacggccgaacgtcctgatttacgcttggccggtttggctggtgcctcatgttcggtggcggcggattcggccgcccgctcctgctcggtggctactagctgtgcattggggccactccgtatggtcttgtccgaaacattgtcagagccctgctctggtgccgtggcaggcgattgctgtaatcctgcggcagatggcgaaacagatccggcggtctgcgaagagaccggactgggggccgtagtgccatgagcctgggtcgtggccggtgagatggacgtggatagatccactgggggcatggaacctgtggaagtgacagagggccggattgcggcaggccgtgcggccggaatcgaaggcgtaggagccgcccaagcagacacggcgcgctcgatacgcgcggagcgtacggagtcgccgggcagttcgggaatcgtcggcttgagtttggaatccgtggctgattccggattctgttcgccgagcagttttcgagcggcattgttcaggctcatcacggaattgtcgtgcatattccacgtccattcggcatggatctcacggcccgcggaagtgaatatcgccacgatgcgccaaggctcaagtccacgtcgggtggatttccaggtcactgattccatgccgattcccgcagaggccagcgtgcgttccaccagttcgctgatggtgcgcaccctgctgtctttgggtgccgccacggcaaggaactgttcgatggcatactgtttctcggtctccacagccatggagaaacgacgtaccagcatttcgctcagatgatatttctccgcgacacgggccggatcggcaccggcgcgaatcagcgactgtatctgggaaatcggcaaagtggactgctgatgcggctggggagcctgtcgcatctcgcttctgacctgcttggcctcaagaatcgcccgttcgagcgtgtcgtccacgctcacagccatttccctgccgccaagggagaatacgaggtcccccgtcttgctcacgcgcacgaaacgggctttttcaagccgatcatctggcatattcgcaccactttccgtcgcaaagacattacttcttttaagtatgccccacgtgtcgaactttacgagtatttcaaatcgtgtatcctatgggcgagtacggcgctgaccgtgctatatatatcgacttacgaaccaaagacgacgaaaggaccatgatggctcaggattatgattccccccgcaacaaggatgaggacgaggaatcgctgcaggcgctggggaagtcctcgcagaacgcctcgagcgacatcgacgacgatgagaacgccatcgccgaagactacgaactgccgggcgccgatttgagcaacgaggattcctcggtgaccgtcatccccatgcagggtgacgagttcatctgctcgcagtgcttcctggtcaagcatcgcagccagctcgcctacacggacgaggatggccagccggtgtgtgaggagtgcgccgcctgatggcgttcgacgagacctacaacgagcccgaatccaccgaggtcctggtcaagagcctcgaccccgaacatccggcccagctgcactatgcccacgcgggcgatgccggtgccgacctcatcaccaccgtcgatgtgacgctgaagccttttgaacgggcactggttcccaccggcgtggccatcgccctacctgcgggctacgtggcgttggtgcatccgcgttccgggctggccgccaagcagggcgtcaccgtgctcaacgcgcctggcaccgttgatgccggctaccgtggcgagatcaaggtgcctctgatcaacctcgatccgaagcacaccgccgtcttccatccgggcgatcgcatcgctcaattggtgattcagcggtatgttgaggctcggttcatcccggccgagacactgcccggatccgatcgcgccgaacgcgggttcggttcgacgggagtggcgtcctgaccggattaggccggttgaatgactaaggtgatgacggcaacaacggttgtggaaccaatgatggcgaacaggtgaatgcacaaggctccggttcgcggctacaatgaacttcatgacgagggaggtgactggcatggcagagattgatggcgagcagtacgccgcccgtaagttgggttgtgagatcagtgccgatccgctcaatccgctggatccaatcaaaaaggtgtgcaagtcccatcaccccgatgaggatttgtccattcttgaccgtgcctaccggcgtgccgtcatccagcactccgcccagcgccgcaagtctggcgagccgtacatcatccacccgctggccgtttcccagattctcgcggatctgggcatgggcccgatcgtggtggcagccggcctgttgcacgacacggtggaagacaccgactatacgttggatcaatgccgcgccgaattcggcgacaccgtggccggtctggtcgatggcgttaccaagctgagtcagcttgaagtgggtgattccgcccaagccgaaaccattcgcaaactcgtggtggccatgagccgcgacgtgcgtaccttggtggtcaagctcgccgaccgcgtacacaacgctcgcacctggcgctatgtgaagaccacgtccgcccagaagaaggcgcgtgaaacccttgacgtgtacgcacctttggccaaccgactcggtatgaacgccatcaagacggagctcgaggaactgagcttcaaggtgctctacccgaagatctacaacgagatcgtggtgctggtggctcgccgagccggccagcgcgatgtgtacctgaagcagattctggcggagatcaacgaggatctcgacgagcagaacatcaaggcatacgtcaccggacgcccgaaggattacttctccatctaccagaagatgatcgtgcgcggccatgatttcgcgaacatctacgatttggtcggtgtgcgcatcatcgtcgacaccattcaggactgctatgcggcgcttggtgccgtgcatgcgcggtggaacccggttcccggccgattcaaggactacatcgccatgccgaagctcaacatgtaccagtcgctgcacaccacggtggtgggccccggtggcaagccggtcgaaatccagattcgcacttgggacatgcaccgccgcgccgaattcggcatcgccgcgcactggaaatacaaggaaaacggccaggccggccgcgccctgagcttgccggacaagtccgatcgaaagcgtgatgaaaacaatcaggagctttccgaggtcgataacctcaaatggattcagcagctcgccgactggaccagcgaaacccctgattccaacgaattcttgggctcgctcaaggaagaccttggctcgtccgaagtctacgtgttcacgccgaaaggcaaaatcgtatccctgcccgctcacgccacgccggtcgacttcgcgtacgccgtgcacaccgaagtgggccaccgtacgatgggcgcgcgcgtcaacggtcgtttggtgccgctcgacaccacgctcgataatggcgataccgtcgaaattctgacgtccaaatccgatacagccggcccgtcacgcgattggctgagcttcgtcaagagcccgaaggcccgcaacaagattcgtcagtggttctccaaggagcgtcgtactgaagccatcgaggagggccgcgacgagctgacccgcgcgatgcgcaagcgcaatctgccggtcaacacattgcttacgcccgaagcactggtgggtgtggccgacgaccttaacttcccgaacgcggacgccgtgttcgccgccattggtgacggacaggtctccacgcagaacgtcatctcgcatctggtcaaggatgcgggtgccgacgaggtcgatgaggaagtcgagcaggaagtcctgccgctgaagcccatggaacgcaaggcctccagcagctccaccggcgtgtccgtcaagggcgtgggcgatgtgtggatcaagctggcccgttgctgcatgccggtgcccggtgacaatatcatcggcttcatcacccgtaatcagggcgtatccgtgcaccgcaccgactgccagaacatgatcgatctgaaaaacaagcagcctgagcgtgtggtcgaagtcgaatggaccagcaccaagggcctgttcatggtcaagattcaggtcgaggcgctggatcgacgaaacctgctttcggacgtgacacgtgtgctttccgaccatggcgtgaacatcatttccggtacgatcgccaccggttccgatcgcgtggccaccagccagttcagcttcgaaatggccgatccgcagcatctcaactcgttgctggcagccgtgcgcaagattgatggcgtgttcgacgtgtaccgcatcactggtgccaaggaatccgccgaacctcgactgcgcaagatgaagtaggccgttgcttggctcccctccgggaggggctgtcagcgaagctgactgaggggagcagcgcgggcttgcggaactcccctcagacgtctgcggcgccagctcccctcagagagggagccaagaatacgaaaaggtcctgactggaataccaatcaggacctttgctgtatatgtgtcggtcttactcggccacgttcacggacaaaattacggccggctcgagcgggcgatccatcggatcggtgtccagtgcttcgagcttatcgacgaccttcttggagtcgtcatcggcgacctcgccgaagatggtgtggtgaccgtccagccacggggtcggcacggtggtgatgaagaactgggagccattggtgccatggaccttgccgtccatgccgcgacgcagaccggcgttggccatagccagcaggtatggcttgtcgaacttcaggctcgggtcgatctcatcgtcgaactcgtagccagggccgccggtaccggtgcccagcgggcaaccgccctgaatcatgaactgcttgatgatacggtggaaggtcaggccgttgtagaacttgccatgggaaggctggccggtgtacgggtccgcccattccttctcgccggtggcgaggcccaggaagttggccacggtgttcggggccttgtcgtcgaacagatttatggtgatgtcgccctcggaggtatgcatgattacggtagtcatggtccccagtgtctcatgggcttgagaccggccggaaaccccaatcccgtcatgcttcgaggggctggacggggaacccgagccggacgggaccccgaacggcacgaaaccggccaaggcacctttagctgcacctgagattccaccctcgaccggggcgtcggggttgaagggactgacaaggaacctgggggagccggcacctaccagagcacctggtttctcggtaaacactccatacttaggcttggtcgattcggtatatccagtttttaattgcgacatcaatgaatcatccatgagtgcctcggcggtggttccgagaaaatcggcagatttgaccaaatccgccactgaccatgcaattcgccccttcattttgttagtcatggtcggccgctgtatgcctagaaaagcggcaagagcactctgtgatttgttttgtgcagtcaaaagcattttgacgttccaggcaattacagactctgcatattgcacttcagtgtcgacgtttttcttggctgttgctggggctgatgtggtcattgttagtcctctgttatgcgtgtttcttaatagataacaacaagtgtatccatcgatttgcgtttcgtcaaaggaaacgctatattgttagttatgaagaaacaacaggacgcgaaaggaacatccgacatgaaggaatggctaaaagcacaggggatttcctatcgcaaacttgccgcctccatggggtcatcggctgcgactgtttgtaaaaagttgaatggtgagactccctggcagcagcgggatttgctgttcttccatgacaagttcggcttgtcgtctgattttgttcttggcatttcgtctgatgccgatcgtgaggaggttgcgtgatggctggtggaatctacgaacagtccgaatggccggacagccggtgggattgcgtcacggtgtgcgatggatgccacacagtggtctggggcacgttctgggatgactacgattcggccgcccgcgacgcttatttcgcccgtaacggctggcgcaactactgcgtcccgggcgacacggagattttggagctctgcccggcctgcgccgtgcgcgccctgcgccgcggcgagacccgcggcctggccgacacctggctccgccccacgcatgcctacacgcatgccttccgggaggtcgatgcacagctctccgcccgcgaacgggtggtggcaaacctgctgctgaccgaggggaggacagcatgagcgacgaagccggaagactcgtcttctcccgcgacccgtcgggaacattcatcgacggtatggtcttcggaacttcaggaggcggcgagaacgccaatctcgaagtgctgtgtgcgttgccctacgagcttgtacgcccacatgctagtgcctctgtcctgggtccgctggtcggcgtagggaatgtgaagaggctgtccctgagcgtcaaataccttgatggtgagatatccgtcgggcggtacgaccgtgtatccggctttctcgttgagcaggcgcgcgccctcattggtggggatactgagtatcagctcagcgtcgtggtctgccgcccaggagtcgcagaacgccttgatctgcgatccgaagccttcgcgccgatgctttctgacgaccgcgatcccttcgatgatggctgcatgctcggcgaaagcctctcgtatctgtgcggcatggaccccgctcgtcccggtgcggtatatgagcgtctcggctacgcaaagggctggctggatgagggccgcgcctatcagacggtcctgtccccatacgcctatgtacgtaggcctgatcgttccatcgtcgtgtctgacgactgctgggacgctttgatcgaagtctttgatgtccctgatgagcaggctcttgattgcctttgcctcgccatccgttgcggcggcgcgtggcccgtcgacggcgagggaggtggtgcgatggtctgatcccattcgattctctctctttctctgcagctaaaagaaaaaacgcccgttcccgatgctggaacgtcggggacgggcggtgcaaccaatattccgagcggccgcggatcccgtatcttgccggatcccggtccgtggccgcccaatgcattgtcttggagtagtgatcacacatgaacgactttactaaagcattccgcatgtcttgctctgtgtttcccgagtgtaaccgggatttccaggcgtcggtttggacgttcccggtcgtggtggcattcgcccgccacaacggtccgggctccgtcgattcccgccgcctggcgtcgatgatggcgcacccgtccatggaagggagactcgcgtgaactggcttgcaatcgtattgatcgtgttcgtcgcgttctcatggctgatgacgctggccctgtgccgggcggcacgtctcggcgacgagatgtccgccagattggccgacgaacgccgtgccgcccagcagcgtgaggaggagcgtccgtgagcaacatcgcactgtcatgggccttcaaatgccatgtgggcaacgccagcgcgaaggccgtgctcgtctacctcgcggaccgcgcggacgacgatggcaccgcagcctatccgaagatcgcgaccatcgtcaacgtcaccgaactctcggaacggaccgtgcgcaccgcgttgaagactctccaggaacgcggcttcattcgccgtggcgaccaacggtacgcgcgcctcggcaagggcggcaggaaccgtctgccccagtactgtcagatcgtgtgggacctcgcggtcgaatccgacccgtcgaccctcgaatggatcaaggagacgcacacggcggaacacgacccgaagaccatgggcaataccgtggaccccgccgcctccaccatcatggaaaacggcgaatccaaggacgtgctgccggaaaacgctggaacgaagccgattcccagcactgcaaatctcgcagggctggaaaaagggccggaaccggcactgcaaatcccgcagggccagcactgcgagagctgcacccccagcactgcaaatgccgcacccccagcactgcaaatctcgcagagctgtatatataaggataaaaccctccaggtaaaccctcctagtaaaccctccttcccctctgcccctacggggcatctccccgcaagcggggcggccgccgccgaaaagaataaaaacgaacaactcgacgaggacgacaccgagatcgccgaagcggccggacgggtcctcgcctcgctcggcgagcagcgctcgatgctcggcctggccacgccctcaccgaccaaagccgaccgcaaggccatcatcggcctgtaccgcaggctcgtcgaccagggagcgcaatggcccaccctcgtgatggtcgacgcgatcggctttgccatgaacggcgattggtggcccaaacgcatccgcaccggccgggccctcgccagacactgggacgaactcaacgacgacatgatcctcgcagccggccgcacagacggcgacgcacacgcgcagacggttccgccggccgagtccacggagccggatgctgcgccatggctgcccgactgggccgtgaagacgctggccgaattggacggccaggacgcgacggccggaggggaggcgacggcatgatcacgcgcatcgactgttccgaggtgggtttcaacgaattcctcctcgccaacccgcagctcgacgggcacgcggacctgatctggcagctgcatgccgtctactggcgcaacaagcgcctcggccatcccaaggccgtcggtctgctgatccaatacgcccgggcatgggccgcccgcaatcccggcgaaaccgccataggacgcctccatgcccgcaagacgccgatgacgcaaggacggcggccatgaacgggcgggacatgatgccggcctgcgcgagaatcgccgcggccgacccggccatggcggatcgcatgtggaacacgacgaccgacgacgatggccgggacctggtcgacgaacggatgcgcggcaagggccgcatgctgtgtgccgcgtgccccatgcgcctcgactgcatcagccgcgctctcgtcaacggctggaaggacaaggccgtgtacggcgggctcgactatccgagccgctggaccctcgcccgactgatcgcccgtgacctccacatcgccgacggcggcctgcaccggatcccacggagtcgggtccgtgactggctggccgaacatccggactgggccgaacgcatgcgccgtgatggccgcgactactggcgacgggccaaacgccgccaacgctcgcgccgcgaatacgcgaccaacgatccgctgttccttccgaccgaacccgtgccgaagggcctggtccagggcagcctcttctgaccgcttcccgtcgcgatccgcgtgggacgcggcataaaccgaaataccgaaaaaccaactaaccagaatgccgaaaaaccggataccgacataccgaaataaggagaaaccgatgaacgacaagaagaaccgcgagccgatggtgatcgcgttggcgaccggcaagggcggcagcatgaagaccaccagcgccgtgttcctggcctgcgccctcgtggaccagtcccggggcgagcagcatgtgctcgtcgccgacgcggacgtgcagggcgacgcgaaggactggtggtacagggccgccgagctggacgacccgctgccgttcgacgtgatgtccgccgcgccggccgacatcgcgcacctgcacgggatcaacggccgtctcgacgaccccgtcgactgggtgctgatcgactccgccccatacggccgcgcattggacgaatcggtgaacaacgcggacctcgtggtcatcccgtcgagccccagccgcatcgacctcgaccaggccgccggggtgaaggacctgtgcgaccgtcgcggcgtccccgccgcgatcctcctgtgccgcaccgaggccaacacgaccgccctccgcgacgccctagcctggatcgacgccgcggacatcgcgtgcttcgagacgctgatcccgaaacgccaggacatcctcaacgcgaaatccacccgcccccgcgggtcccgcctgcacgaataccgcgacctgtccggcgaactcaagcagaccatgcgacagctcaaggaggaggacctgtgaggaacatgaacctgacgccccgtccgcgcgacctgaccgcgctgctcaacagcgaccggacggacccggcggaaaccggaaaaccggaatcggtggaaaccgaaataccgaaaaaccggaagaccgtgaaaccgaacgacgcggagggctgggtgaagaccagcgtgagcctgcgcgcctcgacccggcgcaggctcaagaccttcgccgccgagcacgacacgcggatccaggaagtgatcgacgccgccctcgaaacgtacctgggctttggaggggaacgatgaaccgcatcatgctcctcggactgctggtctgcatctctcgcgtggcattgtgcggagtgatgggcgtgatggccgaaaccgtcgcccggcgcgctggatccagcagccttcgcggcctgtgccgcctgtgcgtcgtcgcctacgctctcgtcctcgtggcgtccttcgctccgatggactcggcccagaccgtcgtccatcgggccgtcccgctgcttttcctcgtcccgaatcttttcatttggatctcgatgcggccctccggcgcgtccatgcgcggcacgcgccggaggaacgatgcagacggctccgccgattcgataagctgtgaacctatgaacaaggagaacaaatgacagaaaaagaaaaggccatcgaagatgagaccatcgaagtttcggccgagtccacggaaaagaaaacaaagaagccgcatcgcagaagggccatcgtcatcaccgtcgtcgtactcgcactgctcacggcgggaggcatcgcctggaaggcgcacgcggaccgcctcatggccgaggccagggcggattgcgcggccgcatccgaacgcctgcgcaccgcgacgaacgactggaacacgcttctgaacgggtccgcggcggacgcggcgaagaccgataggaaaagcgtgaaggacgcgaagatgctggacgccctgtccaagacgatgaaggccacgattccgaagaccgtttcctgcaaggcggattcgaggaccggcgtgcaggaggccgcaaaggccatcacggcgaacgcggcatggtataagacgcatgcgaagacgctgtccaaggccgtgaaggcggtcgaatcgtccaaactcgacaagaccgtggacgacgcgcaggcgctctacgacgcgacctccgggaaggtgcaggacgacaagacccgcgcaagcctgctggacgccatcaaaaagcgtgacgcggatgccatcggcaaggccgtgaagacggtgaacgaatcgaaggcggcgaaggagaaggccgacgcggaggcgaaggccaaggccgaacaggaggccgcggcccaggccgccgctgcggccgcacagtcgcaacggcaggcccagtcgtacacgccgtcctatacgaacaccggcacgagttcgggccgctcctacacaaacgtcggttcggcgggcgcatcctcgggatcggctggctcatcgtccggttcggccggtggttccagcggttcgggtccaatcagcggcggatggggcgatccaggtgcctgtagtttggaggattgttccatcccaatccaacattaagccggtcgactccgtttctctttcagggccgttccacgaacatccgtgggacggccctttcctgtctcctgcgcgaatgtccaaaccggagtccgtgaaaccgggttgcaatggtatcggtcggggatcgcgatccccgacccgacacagtcaagtgcagagtctctgaaaggagaggaacattgggttacaccaataataaacggaagacgttggcgttgctgacggccgttgccaccttggccggcggcctgaccgcgggcaccgcatacgccggtggcgagggtggcaataggcccggcaccggcggcagcggcgcggcaacgcagttctgggcatacaaggacacggcagacggctcatggggcagttcgaccgacttgaacagcgtggcccgggccatgaaggccgtgggtgtgacgatggacgactcgtccggcaaggccgccgccgcgctggccgacgcgaacagccggtgcgtcgccggtttccaccagcgccatccgggcgagggcgacggcgactgccgcgtcgtcgcggtcggcgcggtctccggcaacgggtccaccaccagcgtatggaacggatccggcatcgccgacgtgagtatatggttggacaactggaacaagtacgtcgcaccaggcgattacaactacgctggaactcgtcactataagacctctaccgcgtttgatgacgatccgtccatgagtgtggacaagctcatggaacggtacgtgtccagcacggccagcatcgtcatcatcgcgctcgacaaataccagcccgccccaccgaactacgacctgaccgtcaccaccacgcacaagcagaggaccgacctgaaggtcggctccaccgacccgatcggcgacaccctgcacgcgagcaacaacggcagcagcatcaaagagagcctgaacggcacggccatcatccactacgagggccagaagaacggctacgtcgccgccaagacggtcagcaagccgatcaccttcgccaacaacggcgacacccagctcgagaacctcgccacgccagccgacttcggcatgagccactggcaggaaggccagtactggatcgatatccaggtcgccaagcagggcaggatgaaatcggccgtcgacacgaccgacaaggacccgtccgagacctggaccgtgagcgccgaaccgccgaccccgccgaccaagaccatcgacgagggcgtgagcgccgacagcatgaccaaccgcaccgtcatcacctacggcaccggcaagggcggctacgagatgacgctcaaggacaagatcacggccaacggcgtcgactacaccgtcgacgactacaagctcgtcgacaagaccgacaacgaccgcgacgtgtccaacgagttcaccatcacctgggaccgcaagacggacaccgtctcggccgtgcgcacggccgacaagggcgagatgcccttggaccaccagtacgaattcagcttcaatgtcaccgtcagcaagccgaaggacttccggaaggtcaaggaccacgcgaccggcaagtggaaccaggaacccgaggccgacgccggcagcaaggaattcgacacctggcagtccaaccccgacaagagctggatcttcgagcaggacggcgaatggcaggccgtcatcgacccgcaggagaccaacaagaccggcggcgactcccacacctacctcgacggcgacaaggtcggcagcgtcgtcaacggcaccgtcggcaggaacctgatccaggcgccgaaacagttcaccctcaccgatgactggacggccgccgactacatcttcgacgccgacaccaagaacatccgcgtgtacgaggccacggccggcaccgaccgcgaaagcagcgtgagcgacatcgtcaacaccggcaaggacgtgaccgaccagttcgacatcaccgtccagggcaccaaggccaccgccaccgctaaggcatcctacctcaagggattgaagaaactgaagaacccgaagcaggtcacgctcctcatccccggcaggatcaacttcgcggacggcaagggcgcggcccaggtgcgcgacgacttcggcaagcaggcgggcgacgaactcaccttctgcaccgccccgaacggcaagaacctgaccaacggcggctccgagaccgtgaacaatcacaccgagccgaccaacgaaccgcagatctgcggctacatcccgccggtcaagaaggacgtcgtgtccgaggcgagccagggcggcgaccaggagagcgtggacggcaaggtcgtccagcccggccagaaggtcgaataccagctcaacacccagccgcaactgccggccgacctcgcctacgaggtcaagtccgtgagcttcaccgactcctacgacgcctatctgaagccggacaagcagaccctggagatgatggacctgaacaccggcaagccggtgtccaagaagaagtacacgaccacgtgggatgattccaagcacatgttcaccctgaccgtcaccgaccaggagacgatcagccagtggcgcgccggcaccagcccccgcctccaggtccgcttcgagggcaccgtctccaacgacgcccccaccgaccacaagatcggcaacaagtgggtgctgaccctcaacaactcgctgaccccgagcaacgaggtgttcaacatcccgccgaagctcgacccagtcaagaaggacacgcagaaggacccgacgatcagcatcgacggcaagaccgccctgctgggcgacgagatctactaccgcgtcgacatcgacgccaggcaggacaaccaggcctacaaggtctggaggctcggcatgaccgacgactacgacgacgagtacctgaaactcgacgccaccaacgtggagatcaccgacgagaccggcaaggacgtcaccaggaagttcaacatccaggacaaggacggcgtgctctacgcctacgccaagctggtggacaccgagatccccgcgacgggcgagaccgtcaagggcgacccgcagccggaagacctcaaggcctacagcgagtccgacaagcacgacccgctcacccagcccgccatcgaccagaacctgttgggccacacgtacaccgtgaccatgccgatgaccgtcatcaaggtcaccgacggctacaccgtgaagaacaaggccacgcaggtgctcaaccggatccgcaaggacaccaacgaggtcacgaaccccctgaagcccatcaacccggccaaggacgtcaccgtgaaggtcggcggcgcatccgccaacggcaagagcatctacaagggccgcagcttcctctaccagctcgacagctccatcctgccggccaaccgcgcctatccgcaggtcgacaagtgggacatcgtcgactccctcgatccggccttcgacgaatacaccggccagtgggccgtgtacgcgacccgcgacctgctttcaggcggcgaggtcctcgcgtccaagggcgacaggatcgccggctccgacttcgactcctcgaagctcggcggcgacctcttcaccctctccgcggccaccgtcgacggccgcaacgtcgtcaccatcgaagcgaccggccgctacagggccctcgtgtccgacgactcccatgaggccggctggcgcgcctacatccagtgcaagcgcctcgccgtgaccgaccgccacgagaatcagttcacggagcactacaacggcaaggacctcgagtccaacgtcgtgtggacccgcaccccggacatggccccgagcattgacgtccagaagtgggaccgcaagtccggctggccgaacggcgaccgcgacaattcgaaggacgctttgaccgtctccggcgacacggagatcgtgttcaccatcacgaacacgagcaagaccgaccccgacacgaagcagggcgcggtgttccgcaccaaggacatcaagctcgaggactccaccatcgtcggcgacggcgaggtcgtggacctcaagtacccggccgactgggacaccaaggtgctcaagcccggcgagagcatcgaggtcaccggcacgctcaagggcgtcaccaagacccacaccgaccgagccaaggtcaccggcaccccgttgaccgaatgtccggtcgacatgtcggccccgttcggtgacggcacctcggacgacgagtccggcttcaagcccgaggccgagaccgagagcaagtccgatgacgtcgtgaccatcgacggcaaggactactgctcggacaccaaggtggagtccgccaccgacgactggaacggctaccgcaggagcctcgcccagaccggcgcgggcatcgcgctgatcgcgctggccgcggtcgtcgtgctcggcggaggcgcgggcctgctgatcgcgtcccgccgacgcgaggcgaaggccccggccgacaccgagggctcggaggagtgatccgacgaacctgaccccgggcccgcggcggaccgcccccacgatccgccgcacgggcccacgggcgcgcccagatcctttcccttcccggacgcgcccaagtccccaccggtgccgtctttgttttcttctttgtgacggcgccgggttcgactcccggcgggggcacgccgcgggaaccccttcccgcgcaccatggaaaccagaacggggtggcaggccggatccaatgaggttgggtccggccggccacccctttcccttgcgcatcggaccgtccgactccttgatgccgtccgtttccatgttccgcggcccgcggaacgccggacgggaaccatggcactcgaaacccggcgcgcggcggcgggacccggccccaccggcgaacggtcggcggggccttttccataccatcgtccgagcctcttcgggttcgtcgggaacgtccaaaccggagccttctcgacggccataccgtggtcatgtcatccaaaacatcgaaaggaaaacatcatgtacggaatcgccatcgcggcagacagcggcagcgtcgtcaccagcgcgttgcagctcttcagccagttcgccatcatcggcggcggcctgtgggccgtgtggggcgtcatcaccctggccggaggactgaaggaccagaacggccccgccacccagtcgggcgtctggcaggtcgtcggcggcggcctgatcatcgcggccgcggccctgttctccaacatcgccctgtagacgggaggccgcgcatggtcgatttcatcgtcggtatcctcaactcgatagggtccggcgtcggcgacgaccttgtggccgacctgctgaagacccccgccgaatacaacgcgggcatgtaccagctgagcctgaccgtcgcccgctcggcggtcaaacccatagccagcacggtcctggcgatcatgtgcgtcctggaactcgccagggtcagtacccgggcggacggcgaccgagagctgggcgtcaagctcgtcgccatggcgatgttcaagctcacgctcgtgttcacagcggcccagcacagcgagctcatgctccaggccatcgacgagatcggcgacagcgtgctcggcggcatccattcggcggcgcccaccaccggcgcatcgtcgggcctcggccttggcgacagcatgcgcgacgccatagactccgccggctggatgggccagataccgtgcctgatcctgctgctcatcccgttcctcgtctccaagggcgcgaccatcgtcgtcaccgtcgtcatcctcctgcgtttcgtgcagatatatatgctcacggctttcaacccgctgccgatcgctttcatcgcccaggaggagacccgccagtggggcatcaactacttcaaacagtacgcgtctctggtgttccagtgcgcgaccctgtatctggcgatcctcatgtaccgcacgctcgtgggcggcacgctcaacccgagcaagttcaaggacggcgacagcctctccggctgggtgatggacaacttcaccggcctgctcctggcgagcgtcatgctcatcggcgtcgtcatggcggccaactccgtcgccaagaagctcttcggcggcgaatgagacacaacgcaatccacgaaaggaagcaaacatcatggcgttgcagatgcccgtctacagggaactgaccaccatcgagtcgaaggtgttcatggggatgagctggcggcagtgcctcgccgccgtcatcctcgccgtcgtgtgcgggggaggatacgtcggactgtggctcgggctgggcgtggaccccaacctcgccatgtatctgatcttcccgcccggcctgcccatagccgtatgggggtgggtgaggccaaagggcctcatgcccgagaaatacctgaaatacatcctgcgccactacacgcagcgcgaggtctacctgctcgacggtccgggcagaccataccgcaccggcgcgaagccaacgatcaaggaaaggtgaggaatgttcggaaagaagaaactcccggtggccgcgccggccgaaggcggtgccgaagccagggcgaaggcgcggagaaagaaggcgacgcgtctgccgaagggcgtcaagcagctcatcggctacgacgcgatgctgcgcaacgggatcgccagcctgggcgacggacggtggagcgccaccatcctcttccaggacatcaactaccagctgagcccggaatcccatcagatggagatcatcgaccggtgggccaagctcatcaacagcttcgaggccgggcaaagcgtgcagatcgcctcctacacgcgctcacgcggcgtacgcgagatcctcgccgacgtgatgatggacgagaccggcgacagcctcgaccactacaggcttgactacaaccgcctcgcccaaggcaaactcgaatccgtcagccgcaacaccagcaccgtcaagaccctgaccgtcaccgtccgcgaaagcgacgagcaggccgccgtcgcgagcttgaacgccctgtgcaacaacctcgtcagccagatgcgctccatcgacgcatgcaaggccacccgactcgaccgcgagcaccggctgcgcctcatggccgaggtgctccggtccggcgaggagttccggttcgacgaacgctggttcgagcatcagcccggcaggcccgacaccaaggacctcgtgtgcccgtggagcatcgacgcgcgcaacccgaccatgctcgacatcgaatccctggactcgaaatacctgcaccgcaccatgtgggtgtccaacctgccgccggaactgtccgaccagctggtcaacgacctgaccggcctgcgcgcccgcgtcgacgtgagcatccacctcgcgcccatggaccgcagcgaaagcatgacgctcgtgcgccgcaagaacgccgaggtcaagatgcagatcatggaccagcggcgcaagaaccgcaaacagggcctcgaccccgacgaccttcccgacgacctcgccgaccagcaggaacagctcggccagctgcgcgacgagctgcgctccaccaaccagaggctcgtggactcgatcatcgtgatcggcgtgtccgcggcaagccaggaggagctggaggtcgcgtgcaggaacgtgaaggccaaggtcaacgcgcagtcctgcacggccgagagcctcaagttcatgcaattggagggcctgacggccgaactgccgctgggcaacaaccccctgcccatgaaacgcaccctgaccacgaacagcgcggccatcctcatcccgttcaccacgcaggaggtgttcgagccgcacggactgttctacggaagcaacgcgaggagcggcaacccgatcctcgcggaccggcgcagccacatgaactccaacggattcgtgctcggcacgtccggcggcggcaaatccttcaccgtcaaacaggagatcgccggcatgttcctcaaccgtgacgacgaggtcatcgtcatcgacccggaacgcgaatacctcgccctcgcggccgcgttcggcggacagatcatccagatcagcgccggcaccggcacgcgcgtcaacccgatggacatcgtcctggaggacgattcggcctccgaccccgtcaaggacaagaccaacaacgtggtctccatgatcggcgcgctcataggcggcatcgacggcctcgacccgctccagaagggactcgtcgaccagtgcgtcagcaacctgtacacgcgttaccgcaaccagggcgggggagtggtccagcccacattgcaggacctgcacgacgaattgcaggcgggcggcgaccaggtgagccggtaccttgccgacgcgctcaacccgtacatcaccggctccatgagcggcttcaacgggcagaccaacgtggacctgtccaaccggttcaccgtgttcgacgtgtccggcctgtccggcgagctcaggacgttcggcatgatggtcgtcatcgaccaggtgtggaaccgcgtcatccgcaacaaggccaacgggcggcgcacctggctgtacgtcgacgagttccaccgcttcttctccaaccagtacgccgccgcccagttcaaggacatctacaagcgcgcccgcaaatacgggctcggcgtcaccggcatcacgcagaacgtcgaggagatcctcgacctccaggacgcgcgcgagatgctgtccaactcggacttcctcatgctcctgagccagaacagcaccgacgcggacgccctgtgcgagctgctgaccctgagcgaggagcagcgccagtacttcaccggcgtgctgcccggccagggactcatgaagatcggcagcgcctacgtgccgttcgacgggcgcatccccgcgggcggcgacctctaccggctgtactccacgaccttccaggaaggaaagtaaacgcatgagcggaacccaagcccaccacgccggaggcacacgcgcccgcatcggacgcgcggccaccggcgtggtgtccagcgccgcgcagttcggctcggaccggaccgacatcgccgattccatgggccacaccgccgccgagatggcgggacgcgccggcatgtacggcatgtcctccaccatgcacggcgtgggctggacggccggcaaggcgcggcgcatcatgaaccgcggcaaacgcgccctgcggtcgggcaagggaatgcgcaagacggccggcaaacccaaggcgctgtccgaggcgaagcccagcgagaagatcggcaagttcgccgcgaaaggcaaagcgagcaagcggatcggcaagcacataggcacaggcattgggaaagccggccggagcgtcaaacgaatgggatccaccggcatgggctggatggacgaagccggcgcgaggctcaccgctgccgacgacgacttcgcatcgaagctgggaagcaccacacgcgacctgtccttcaaagcggcacgcgcgggcgtgaaaggcgtcaactcgtcggccaaattcatctggcggcaccgccgcgcgcccgtcaaggtggcgcgcgacgttcaagccaccggacaggccgccgtgcgtgccgcccgcgccgccgtgaacttcgtgcgcatggccacgtcccgcgtcatcgcgggagccgcctccatcagccttcccatcctgcccgtcatcgcggccatgctcgcggtgctcggcgtgctcctggccgtcatgggcgcgttcctgggatccagcgccagcgaatccacggtctcgggcgtgcccgcggaatacgagtccgacgtgatccgcgccggatccatctgccaggtcgtcacgccgagcatcatcgccgcccagatcgaccaggagtccaattggaatccgaaggccggcagctccgccggagcgcagggcatcgcacagttcatgccgtccacatgggcgtccgcgggcaaggacggcgacggagacggcaaggccgacatctggaacccgcacgacgcgatctggagccagggcaactacatgtgcaatctcgcctcgcaggtcgaaacggccaagaagtccgggaaactgaccggcgacacgttggagctgaccctcgcggcgtacaacgctggcctcggcagcgtgctcagatacggcatggtgccgcccttcgaggaaaccatcaactatgtgcggcggatcaaggaactcgcagcgaccaaatacaccgcaacggggaccgccgagggtggcacggtcggctccctcgaaccgaaactgacggtctccggcggcatcgtgtccacggccggcatcacgccggacacgagatacccatgggggcagtgcacctggtgggccgcgaccagaagagccgacataggaaaaccgataccagggtggggcaacgccgccacatgggcaggttccgcggcgtcggccggctacacggtggacggctccccatccgccggcagcgtcatcgtgttccaaccgggagtattgggcgcgtccgccgactacgggcatgtcgccatggtcgaggaggtccgcggggacgggtcgatcctgatcagcgagtccaacgcgcttggcctcggcgtcgtatccacacgcgaaatcagcgcctcccaactggccgcagccggaaatggcgtccgctacatccattgaaaggaaaaccaagcatggaaccaaagaggaacaggatcatcgccgcgacgggatttgcggtcgcgctcctcatcctgggaggaaacgtcgcggtgatatgcgccggcaacggaaccgcggaggacacgcaaagcaccgtcgcccggccgcgaacgaaaaccgaacccggacaaaaaacggctggagacgaagagaccgagccggcgacgccgacggaggatgatccgtgcgccgacctcgcgccgaaagcgctcggcgtctacatgggcggcgaacgaggccaactcgaaggcgaatacttcacgccggatgccgccggcctcgacataccggcatcatccatagccccgcagccattgcccgagaccgagttcaccggcttccccgtgtccacggggcggcgggtggcgacatgcgccgtatccaccgggctggaggcatcctgggtgcttgactacacgctcactgacgacggctggcgatgcgcggcggtcaagggcccattggaaggcggataccgggtgcatgaaggcaaaccagaggaacaaaagtgatgaaggcaaacgaacaggatcagccagtcctcatcaaagacgagggcggagaggaatgaccaggatcgacaggaagacgggtgagctgattctcagccccaagcttacggtcgaccagctgtacgccatggccaacgagcccggttggcgtccatggatgcgcctaatcgccgaacatccacacgcgtggccggagctcgccgaatggtggcataccgcgcaggagcaaggctttgacacggccggcgccgcgccgctgccgcccgcgtccatgcgcggccgccgtcgcgtcgccataccgtccgcgccgctgccgccggaagacgagccggggcaggaacccgtgtctgcgccggcggagcagtctcctcccgacgattccgcggagaaggccctgaaggacgccgacgacgattttgccgcactcgaacgaatcgccgacttggaatcggatacggcggacatccctccaataccggaagcagaatcgtcggggtcggccgtcacctactcggccgaccccgacgatctgaaggtgcgtcgcgtcttcccggtcgggaaagcgctcgtcgcgatcgtcatgaccgcgagcctcatagccgtgtcctggatgggactgcaaatcaaaaaccgccgtgccgctgccatgcggcaagaggtgcatgagaccgcaatcagcgcatgcgactcggccgaagcgacacgcaagaccgtccagtccgacctggacaggaccacggccaaagcctccagactattgaaggacaccagtcgcggccaagtcgcggatcccaagacgcttgatgcgttgaatcggctcctggacgcaaagacgtccaccatcaagggttcctgcgcgcccgacgccgtcacatccgacgtggacaggaccactgcggcgctgcgcagaacgaccaaagagctcaagaaccgtctcaccgacctcaagaccgcggccaaggccgtcaccgacagcaaacttgacaagaccgtggacgccgcgaacgcgctgtacaagcagaccgacggcaaggtggcggacgacaagacccgcgcaagcctgctggacgccatcaaaaaacgcgacgcggacgccatcgcaaaagccgtgaaagaggtcaacgaatcgaagatggcgaaggaaaaggccgacgcggaggcgaaagccaaggcagaacaggaagccgctgcggccgccgcgcagcaggcgcaggcatcgcaatcccaatcggttccacagcggcaaacaccctcatattcgggaggaagccaatcccaatcccaaggaagttccggatccggttccgaaaccgttcgacgtccgtcttcgggaggctcgtcgtcctccaccaatacgggcggagcctcgccgggatggtccgtgcccgcgccatcagacgagggcaccggcctgcccggcagcgatccggggttgtgattggcttcatgccgctgccttccattctttggaatgcctgagcgtggatttcggtctggcgatggcggttccgggccatgccttgcggctgaggaacgggtgcagtcctcgcaggttgtagatgcatttgtcgttgtccaattgcgcgagctcgtcgggtgtgaggagttcgcggccggtgcgctggtagttggtggtgtggctgccggacacgcccttggagtcgctggtggtgcggatgtcgatggtctccttgccgagcagcttgctgagccattcggtggtggactgctcgttgccgccgaggaacagcaccgagtcgcagttgcctacgatggtctcccacgagtccttgtacatcgtcttgagctgggcgatggtctggaggatgatgctgacgctgaccttgcgcgagcggattgtggcgatgagcttgtcgaagttggggatgcgtcccacgttggcgaactcgtcgaggaagcagtgcaatggcgtggcgaggcattcgccggggtaggtgcggcagcggcggatgatgctgtcgaacaggcattggtagaagatcgcggccaaaaagttgaatgtcgggtcctcgtcgggcagggcgaggaatatggccgtcttcccgttgggatgcttgtatccgcccttgtgctcgtcctggtatccgccgatccggtcgatgccgaggttgtcgtcggagaggatctcgcggaccggtccgacggtcagtggggcgaggcgcacgccgaggctgatgatgatgcccttcttggtctctccggcgccctgggtgaagggccggtactggcgggccgcgaacttcaggccctgggcgagacgccatgcctcgcgcaggtccgggtcgtcgtggtccgcgtcctcgcgttcccattcggcgcgggtctcctcgtatatttcagtggcggtccgggcgacggcgtcgacctggctttccttggtctcgtcctgttcgctggcttcgagcaggtcgcgcatgtcggcgaccgcgttgagggtctggccggcgtcgatgtgcaggcagtccttgaggatgtcgtcgggcaggtagtagacgaacgcggtgagtgcggtcaggaggctgcgttcggatttggtccagaagtcgtcggtctggtgctccttgggtgtggagccgttggtgttgtccatgatgttggtgaccaggcgcatgatcgccacgtcgggtttcgtggggtcgatgtagcgcatggggttgaatttcgtctcgctggtcaggtccaccaggtcgagttgtttgaccgtgtagcccatcgtctttagtttcccgccggtcttcgcgtagagttcgcctttcgggtcggtgcacgcgtagttcatgctgcccttgaggatgttggggatgacgtgggtggcggtcttgccggagccggagccgccgatcacggcggtgttgagattgcggcgcgtggccggggcgtcgaggctcaggccctcggtggccgtcatctggaggttctgcctggtgtcgcggtcggtatacggggccatctcccggctggtcgaccagcgtgccgacccgtactcttcgccgtccctccagttgcgtctcatgctccaccggtagaggtggaacaggccgaccgcgcacgcgccgcccagtccgcataggaggctggcccggtcgaatcccagggcgagcggatgctggagcatgatcgtcatgccgtctatgatccgttccatgctttcgccggcggcgatgccggcctggacgcgggcggccgcgaggtcggagagccagaatcccgcgaggatggtcagcgtcttgacgatgattcctcttgcttgttccatgattgttcctttctattgttttctttcggcgaggttctccttgagcctggcgcggaaccggtcgtacagcgtcttcctgctggtgatcctcccgtcggccggctccgtttcggcctgggcgtcgccgccggccgcttccgcgtccttcgggggtgggaggggcgtgacggtggtcatgccgcccggcgcggcgtcgatgctgaatggccggccgtctgccatgagcgtggacatgagtcggccgacgtggccgttgatgtcgatccattcgccgtcgccggccttgtccggtctgatgccgctgacggtggtggtccgtgtcatcgattcccgtccggttcgtcatggctgggatcgaacgcgaggcttgtggcttcgatgtcgatgcctgatccttcgtcgcccgcggtgcctttgaccatgaggcgggatcccttgcgcgcgtggtcgcggatgttctccgaatgctccctgccgctggcgtggatggtgattttcctcgtggctgttcccatggccatggtttcaagcagccagtcttccgcgcttctgttttgccgtgggctgctgatgagtgtgccctcgaaccagatgatgggttccggctggtcgtttgtttctgttgtcatgcgtgtcttctgctccttcgtatggaatgaatgcggggtggcgcggaaagcgcgccaccccgtggctggagaggactacagtcttggcccgtgacgcttcgtcgtggaatcggcctgtgcgggcgccttgtgatccggttccggccggtcacggtccaggctttgggccggctggggctccttcaactggtcaagctggtggagcgtccacgtggacagttcactgtcgtatgacgcgcgggtgaggatctcatcgcggttgtcccagacgatctggtcggcctgttgttgggtgatgcccgtccagtcgccctgcgcgttgatgcgcatgagcgggtcctttcgcgggtcccatccgcccatctcgcgtttctccgcgatgtccgcggaggtgaggccgtctccggcgatctggaccgccttgtcggatgggtaggcgaggtaggtggcgatgtcgttctcggggtcgtgcgcgttgacctcgcccacgatgccgtggaggattctgactgcgtcctggtcgggggattcgtatcgttccaggatgtggctcgcgcgcatgcaggacgccttgcggtgctgctcgtagagcacggccggatcctcatcgaccttcgtcacgacgtatccggcgttctccctcgccttcatcgcctggtcgcggtcgaaggcggtgctcaggtatgcgatgtgcctgtcggggtccccgggcttccgccaccggtaggcgtattcctccggcggctggttcgcggccagatggctcgtcccggctgcgcgggccgtgtgtaggccgcccgcgcgttcccagccctccaccgcctcggcgagtgttttcccggcggctgggtcggccgggtcgatgacggtgtgttcgcggtcggccatgtcgttgtcgtcgtattgccattccgcctgtggccggttggcgtaggacacctcgatccggccggccagacggtccgtgtctttccatgcggggttgtcgtggaagtcgatctgcacggcgcgtccgtccgtgagcctcgcttcgaggtagtggcccatggcgttgccgccctgggtgacttcggtgacgtcgtggtcctgttcgagcagtcgtctggcgttttccgttgtcaatggcattcctgcgctcctttccttggtttcctggtctctactttccgtctcccggggttcgtcgggtttggacgtcagccgttcgagttctgcctgtttttgcaggtactcgtcctcgtgggcgaatggttcggccagcgtctcctgcgcggcggcgagttccctttcggcgtccgccagccgttccgtgagcttgccggggtcggtggccatgttcttgacgatccggtcgagctggctgacgatgctggaaggtccggtcaggtagggtccgggcatctcggtaccggattcgtgctcgtggacggccttgacggccaaggtgatccgtccggtggtggccgccctgcgtgcgatgacgggcagtccgtcgtattcggcgatcgtgtccccgtcgtgcgcctggtgggcggcctggtggaggatcctgcatgcggtctgccggtcgccgaccggccggccgttgatggtcatgccctcccacttgccgttcatgcgtgcggtctggtggatgctcagggccttggacgcgagcggcttgtcgtcggtcttctcgcggatcgcctggcggatcccctcgatgcgtggctggagctgctggttgatgtccctgcgggtgtcggccttctgctgcgcccatgaggcgcgcaggagcttcagctggttgatctcgttctccaatgtcatgcggcgttggatgtcggggtcgccggtggccagcgccttgatgttggcgagggtcaccacgtcggcgtcgaggtccgcggcctcgcgggcggggctcttcgagctcatgagctggctgatgaaccgctgcttgcgttccacggtctggtagctgtacgcgtcgaacgtgccctcggtcacgtaccggtagtcgcgcacgtggtcatacgtgttgccctggcgttggattcggccgaggcgctgttccaggtcggcgggcctccatgggcagtcgaggtcgtggatcgcggcgaggcgttcctgcacgttggtgccggtgccgagcttctgggtgcttcccatcagcacgcggatctcgccggatctgactttggcgaacagttgctcgcgtctggcggggttgtcgccggcgtcgtgcacgaacgctatctgctcggcgggcacgcccaattggatgaggcggtccttgaggtcctggtaggcgttccatccgcccgacgcgggcgtgctcgagtcgcagaagacgagctgcgtgcccaggcgtggcgtctcctcctgccagatccgggcgacgttctcggcgcatgcctggatcttgccgttctccagggggcggtcgttctcgtggcctttgaggagcttggggtcgagggcgatctttcgcccgtcgccagtgatccgcaggaggttgtcgacctccgacggcacgtcgccgtcgcgcacgaggtcggccctgtcggacagttcctccatctccttcttctggcggtcggtgatgggcacggggacgggcacctgctccagttcgggcagcggcagctggatgtcgtcgttggtgatcatgtcggtgaactgcttcaccgcgttcatcagttcgggcaggttctggaagcgcgcgaacctttgcttgacctggaatccgttgccttcgggcttcagttccacggtgggtactacctggccgtaggcgccagcccatgcggcgaacgtgtcgaggccctgggccttgagggttccgggcgcgaggtagcgctgcatgttgtacagctcgctcatggagttggagaccggcgtgccggtcatgaacgcgatgttgcctccgtgcccggcctcgcgcagccattcgcatttgtcgagcaggtcctcgcatttcgcggcggacgacagttgcatgcccaggtcggcggaggcgacgggcacgccgaggttcttgaagtggtgggcctcgtcgacgatgagcatgtccacgccaagcgattcgaactcgatgcccgccagtgccttgtcgtcgcgcgactccttgccgtctcgcaggcgctgcatggcggtctcggcgcttttgcgcgccgcctccagccgtttgacggtggggtccttgtcgcccctggccttggcggcggcctcgacggcctgggcgaactcgtcgacgcgggcgcgcatgttcctcagccgtcgttccttgctgacgtgcagctggctgaaccggctctccggcacgatcaccgcatcccagtcgccgttggcgacccggccccagaagcgtctcaccgattcggggttgcgttgcgcgtccttgtccatgacgaggacccgtccggccggatagagcctgagcacgtcgccggcccactggtccacgaggtggttggggaccacgagcatcggcttggacgccttgccgagacgtttcgcctcgtgggagagggcaacgccctcgaacgtcttgccggctccgacgacgtgcgcgatgagggtcccctcgtcgctgcgcagggcgcgggccaccgcgtccttctgatgcggacgcagggcgacgccgtgggcgatgccgggcgtggtcaggtaggatccatcgacgtggcggggccgcatgccgttgaatctgcggttgtacagggcggtgagcctttgcgcgcggtcggggtccttgaacacccattggttccacgcgtcgcggatcgcgttggccttctcgatggcggccatcgtggccttctggtccttgacccgtttgggcttgccggacgccgtggtctccgtgggggagtccttggtgacggtgatctgcgcgttgtccaggcacgcctccagcagttggaacgggttgcggtcctcggtgccgtacgtccttgctgccttgtagtcgatgtcgccgccgcccgagtagccgacgcgccattgtccgagctgggggatccagtcgaccgagtactgggagagcttgccgggcgtgagcccgtggccgcgcacgttgaacgtctccatcatgaagtcgtggacgtccctggcggggatccacggggcccccagcggcgccttgatctgctcggtctccagcggggtgggctgtacgcgttccagcagatcggccacgtgttcgagccgttccgcgtccgtctggtcggcgcgcgcggcctcggcgtgctccggctgctcccgccattgtccgagctgttcctcgcggcgtgcgcggaacgcctggtagtcgtcggggcgcgcgtcgatggcgcgtggcggcgcgccgtaggcgtcgtgtgccgctccctggcgcaggtcgggcaggtcgcgggcgatgccccagatccattcgctgaccgacatgtcggtggcgagccgttcggcgagccgcgtggggtcgtcggtgccgggcatgagacggcgtgccatcgcgccgatggtcgtgtccgtccatatcgtgctgccatgcttgtcgtgggccgaatagctctcgaacaggttggagaggatcgcggtcttgtcggcggtttcgagccggtcggtgtgggcgatcttgtggacgaacagggcgaggtccctgacgggcatgcgccggtcggcgaggatcggcgcgtagtgctgtggcgcgtcgccgtcgcgccatgtccagcacaatgcgtcccacagtgggctggtgccgtgcgatcggtgccatgccggcgcgtgccacggcttccgctctccggtgtcggatcgttcgagggtgacgcgtgagtggcgctcgggcagttcctccaccgcccgccagacgagggcgaggacgagttccgggttgcggttccagcccatggtccatccgtgccgtccgtcgttgatgcgttcgatgaccggcgtcggatccctgtaggattcggcggcgtacgggtccgtgaggctgcgccacacgtccgttcccgcggtgtcgatccattcgcgtgcctgctctatggcgggcatgtcctccgatgtcgcgtaggtggatgccgcgaactccgtcatggcctcgcgtgccgcccggcgtctgaggtgttcggccatggccgtgacgtggtcgagcttcgtacccacgtctccggcgaggtagtcctcggcgggcatgacctcgccggtgtccgggtcacggatgatgcggtcgcccagaccggtctcggcctcctcgacggtggtgtcggccaggcgcgcgatgagttccaggtcgaccccgccggcgcggtcgagactgatgtccagcgcgtcgtccaggctgtcggcatggtcgggcatgggcggcaccgggctgatggtccgttgcgagaggcatttcgccttgccggcgaaccttcccttttcgtcggtctcctccaacgccatgacgagatggcagccggattcctcgccgctgtaggcgcgttggttggcgcggtcgcacagtcgtccgaactcgctcgtgaaccggtcgtatgcccggtcgagttcggcgcgcttggcttccacgtccgggtcgtctacgcgggcggggtcgagttcgagccgttggagctcgcgcgccaggtctcgcaggcggatcatgccgcgcaggcgtcgcgcctcgtcgccctggccgtgggctatctcggtgacggtggtgccgtcgccgtaccagaccactccgcgctggtcgacggagtattcgaacggtgccacatggtccggccggaccgtgatctccgcccgtccggccggttccgcctcgcccagcgacagcgccgggccgtgggtgatctgtgtggagagcagttcttggagtcgttcgccgacctgttccgcgtcgccctggaagacgacgtcgaagtcgccgccgaaccgtccgatcaccggtctgatgtcgcctaccgcgtgcgcggtcatgtcgttggcgaccgcctggttgacgttgacggtcacgtcctggtatccgggcacggcgaccggattggagtggatccacgcctcgtcgggcgtgcggtcgagcgtccgttcgcgtctgcgcagaacgagcacgtcggtgacggcctcggtgccggcctggcgggcgaacgtcgaggacggcaggcgcactgcgccgacgagctcggcctttctcgcgaggtcggcgcgcatggtctcggagcgtttgtcgagcgtgtatctgctggtcagcagcatggcgacgccgccgggccgcagcgcgtccaccgagcgttcgatgaagtagtcgtgcagggggaggcgggatgtgccgccgtccgtggtccggtagtcgaggctgatgtcgcccgaatagggcacgttgccgatggtcaggtcgaatcccggatggatggtgcagtccgcgaggtccgcgttgaggatcgtggcgtccgggttcagtgcggccgcgatgcgcgcgctgatcggatcgagttccacgcccgacacgttcgctttgatgttttcggggatgccggccatgaaattgccggtgccgcacccgggttccagcacctggatgggcgcggacccgatgtcgagcgcgtcccacatggccttgaccactggtccgggcgtgtagtaggcggtcagtgtggaggcgcgcgcctgcgtgtactcatcgtcgtcgagcagttcgcggatctcggcgttcaggtcggcccattcgggcttgtcggagaatgcgtccgcgcatccgccccatcccgagtatccgcgcagcgtgtccgtctgctccgcggagagaggctcgtcgccgttcccatcgagcgtcttgagtgtccgaatggcggcgatgttcgcttcggcgcgttcgcggggcgaacgcgcgcgttgcgagtcgagggatgctagaagctttccacgatctcgtggatcgccatgctcatcgactccgcttgcgcctcgttcatcccgttgagccggtccaggtcggtcatctggggtgccgccttcaggcagtccgtccggttgagcaggtgcctggactccatcagctggtccatgatctgcgcctggcgttccctcgtccgcctctcgatgtcccgcagatgctcctcgagcacgttggccatcatcatctccctgaaccgctgcggatggttgtccatcagccagttgatgcgcatgttctggatcccgtgcaggctgctgcgggtgaacaccttgtacggcagcgcccacttgttgaacagttccggatgcgccgcccggcgctgttccatcgccttgaggttcctctcgtagcgcgccttgaactgcgggtcggtccatgtcatctcgtccatcattgttcctttcttcagtgttgttttccgtgccggaggattgtgtgaaacgttttaccacaggttgcggcgtggtttcgccgggcgtggcggcaccgacgccgagcttgttctcggcggcgatccgcgcgtcccgtcggccgagtccacggagccggttctcccggtattcggccgccacggcggctatcgtctcgtcgtccgcgccgcgtgcacggagtcgttgcaccgcggcgtggcccaccgttatctcgtatccgcgcacctgttccgccgtcctgtcggcctgtcgctgctcctcctcgagaaggctgaacaggtcgatctgctcgtattcgaccgaggcggtctgcttcgcgtataggcgttttctcaccatggttctctcctttcttataaggttttccgctgcccgcggttacgatcggtgccggcggtgggcgggtctgcgttgagtccgtcgaggttcttcttgagcctggtgcggaaccggtcgagcgttgacttcaggtccgtgtgccgtcgttccggaccggcggccggggattgcgaggcgggaacgatggggccttgccgctgtttcgtcgccatgtccgtctctgttttccgtggcggcgcgggtgtctcatcgcctatggcgtcgggcgttttgccgccttccggcacgtactgttcgacggtcggacgatccgttgttttgctcctggcctgcgtcggatcctgcgtgccggtgagttcctggatgagcagtctggcggcctggcggcgttggcggttggtccaccgtccctcgtcctctccggcggtccggtcgacgagtctgcgcgcccatttcattgcgacggacggcttgtacgtaccggcacgctggtattccgtgaaccggccctgcatgcgttcgatctgcggccaggattcctccacggtcttcgaggcgagctccaccgatgccgtgtcgagcgtcttctcggcgtcgcggttgcgtttctgcgcgtcgatgaccgcctggacgagcgtctgcgggtcgacctgcatggtgcggcgttccgctccgcggccggtgaacagctcgaccggggtgccgggtctgaacctgatgttgacggcccgtccctcgttcttctgcctctggttcttcgcgctcatgaacatgtcggtcgcccagccggtcaggtccttgccatcgatggcggtgccgcgggggagtccgacgatcatcttcggccagtcgcgtccgtccttcgcatgcaatatataggtgtgcgcgagcctgttcgccacccacgcgttcggccagacctgcttcgtcgccgcggccgtccgggccggcgtctgtgtcacggctgtggggtcggtgtcccgctccggctgctcctgctgggggagcgcgggcgtcggcgagatgggttggccctggaggatggatatggcggcctggtcggtgaactcgtcccagtccggggcgcgtcgaccgtcgttcagattcagcagcggcttctgctccagtcccggtttgagcagtccgctgcgcatgacgcggccggtcatgccctgggcgacgggtccgccgtcctgttcgcgccagtgctggtattcgtcccggtagacgcggctttgtgtgagcagttcgccgtcgctcatggtcttggcggggaaggactcgctcatgtcctcgctgtggctgatggtggtgacctgcatgctcaggtcgtcgtattgcaggtgtttgaagctcatcgcgtcgaacagtccctgctggttccgatgccaggagaagaccatgaggtcgtacccgttatcctccaggaagaacacgcaggggcgcggctcgtgctcgaccgcgttctgcatgaggctggcctggagcaggtcggggtcgagccgtcccgccgcggacgcggcggcggcgaggctggcgctccatcccatagggagctgccggcccgtcgtcggatccgtcatgcggtactggcccggcgtggccacggcgtcccaccggtcgggatggcggtggttccattgttcgatgcccgcgagcatcgcgtccatcgggctctgcccgtccgccggtctgatggcgaaggattcggtggcgcgggtcacgtcgccggcgattgtgttccggtgcacgatggtgtcgccgggatcgtagatcatgcccaccgagtcctcgccggccgtccttgcagtgccggccgtccatatcgtgtcgccggacgaggcccacatggtcaccggccatggggtcgggtcgttggttccgttgatggtgtcctggaagatcgcggcgtgttgcgtcgcctgttcctgctggttcattatggtttcctttcagcggcccttgcggggcgtgcggtccctgttctgggtgggtggcatgtggttcttttgttcggcgaggttctcgttgagccgggtcttgaaccgttcgagcagtgcctttttcgaccggatcggcttcggtttccgctccttgccggccggcctgggattgtctgccctggcctgcgtctgctgtcgcgtggccggtgtccgggcttcgtccggcgcgggttccggttcgctttccggctccggtgccggcttctcccggttcggctcgatcgtctgcctgcgtgtctgctcctgggtttgcgcgccctgcccgtagtcgtcgcgcaggatggtgtcgagctcgtcgcgcaggctcgggtcggcggcggccttgccgatgatccggtccgcgaagtcgcggccggcctgctcgtcgcatgttgtgtcgcccatgagctcgtcccatgagagttcgggatgccgggcggcgaggctgttcgcggccatctccatgacctccgggtccacgaagtcccaggcgatgcgctgcgtcggcatgggcttcatggctggttcggccggggtctcccgcgccgggggttctggctcgtttcgggtctgttccgtctgctcgacggtgaagtcgtcgtcggtgacgtccaggcccatgcctttgaacgcgcgttgcactgcgtggcggacatggtcttcgtccttgccggcgaagtgcaggatgaactggccttggtcggtgcgttcgaggtggtagtcgatgccggcggtcttgaggctgtgctgtacctcgcgcatggtcgagtcgtcgagttgcagctcgtgcaggtcgccgtccttcttcctttgcaatcgtttctcggacatctcgccgctgtcgatcttgttcttgacggcctcgcccgcggcgtgcacgccggtcttggtgagcttcatgccggaacggagcagcgccatggccacgcccttggggattctgagcatgagcttcgcgcctccggtgatgatggtctggacggcgttctggatcttctcctcagcctgttcctcgattggcattgcggtttcctttctgttgtcggttggtgtttcctgggacggttcagatggaccgtccacgcttgtgctgatgctgttcgcgctgctcggtctccgtttgctcgcggtcgcgggtcgtgtggatctcccgttcgatggcggccagctcgccctcgtaccggtcgcacagggcctcgcgacgttccatctcgccgcgcgtctcggccacgaggtcgaggtctccctgttggatcgcgtcatgcaacgcgatgacggcggcctggagttcgtcgtgcgattcgcggacctttccgcgcagcagcttgagtcccttggcgctgtcgccgcccgcgagcctggtccagcggatcgccgcgttcagcgccttcgcctcgccggcgagccggtcgaggcgtcgcgcctgtgcctggtagtagcgctgctgggtggggcttaccccgtagcgcaggggcagccgttcgggcgaggccagtggttcgagccggcttgtgggctcgccgaaccactggtagaggccgtgggtggtggtcttgccggcgtaccggttggacgggtcgaggatgatctggtcgcggtggaggggcaggaacgcgcgcagcgtggatccgccgtcgtccacgagacgcttcgcgtcgaacgtgatctttttcttccggtgggtgccgggcagccacacggtgaccgtcttcctggtctgtttggcgacgagccgacggttgaacgtgatggggatgacgggcgtgctttgcagtccggccatgatgttcgtcatgtcgtacgccgagccgagtttcgtgtctcggaccttgaagccggtgtccttcatggtgaacgtgaagtgctgtcctcggaccgtcacgtccacgccctgcacgtcgagcatgttcctccagtcctcgaagttctccgcgccggccagggtcaggtcgatcagcatgcggagctggtccttgacgcccaggcccttcgcggacgcgtagatctcctccatcgacatgccgtagcgacgctccatcggctcctcgttttcggcccgtcgcgtcgttcgcgccgtcgccgccgtgcccggttcggaagtctcttcgacatgtttggggtcgcgtgcctgtgtcgtcgggtcttcgttcggcgtggtttcgtcgccgcgcattttgcgtgcgacccgctcggtggcggggttgaagatgacgcttagcccctccctctcgctgatctcgttggcgatgacgcgccactgttcgatgatgtccttgggtagttccgccttcagatgcttcccgtatcgggaggcggcgcacaccatgatgtggtcgtgcaggtggtggcggtcggtgtgtgtggcgaccacgaacttgtattcatcactggtgatgcggtgcgcaaactccacaccgagttcgtgcacccgctcgggcgtcacggggtcatcgggactgaagctcagcttgatgtggtacgccaaacggctgttcttttggatgcctttgggtgagttctcgttgtcttcgagcattggatcagccagcgcgtcgtagtccgttccggtccgctcgtagttggagctgaccagtcttccgccgtcggtcttggcggggtcgatgatgtacgccatcgccccgttggggccgccgagattcgatttcacgggcttgccgagcttgaccacggccatgctcacacgtccttcccggcggtgcgtttgttggcgaacaggtcgccgagcagacgctcgatgcggtcgaacgacgcgcggagctcggccacctgctcggcggtgatgtgctcgttcgcgttggcccagtgggcgatctggttgacgttcacgccgatgcggccgatctctctggcgagcggctcggggtctgtcagcggcctgatctcggtgacgcggatctcgccatcggtcagcattttgcgtgcgaacacggtgaacgaacggtatcttgtcgtgtacttgttcacctttttgtgcagcgaattgacgcgttcccactcgtcgggagtgaacgtgacgagcttctgcacggtgcgtcggcgcttgttcgcccagctcatttcgcacctcccgtggaggtgtgcggacggcacgtccgtgatgccgcgaagcggtctggagagcttgctcggccatggggtctgggtctcccgagcaagccgattcgcggtgcgaatcgagtgaacgtatatacgttcacgtcacttgctactcccatatcaatttcattgattgggagcgatttcgcacggcatgattgcggaatgccgtgaaggatgatcgcgttcactccttgctcctttcgcccatggccttgagggcacggccggtgtcttacgccaatcgtccgtcgtggaaacggcgatgggtttggacacttggagcagggaaacgagaaggccccgcgaaaaaatcgcggggccggtgggtcgttggtggcgcgtcatgtccgtcatgcatacgggcatgaaaaagccccggcagtcttgatgacggtcggggcaggggcgcgtgggcttctagatgatttgcatgtcggagcggacgcgttccgcggcgatgtcgatgtctccgggccatgagggcacgccgaacgcgagtcgcacgcggtcgaacgtctgcgggtccttgagcggtttgaacatgccgcggtcgacgtatcgggacatgtcgaagattccggtcgcgccgtcggagcaggtgaccttgagcttgtagccgggcatgggctcgcattgggtcactttgattgaatagtcgatggtcatgtccgttgcctccttgtcagcgtagcgggtcgattctgaacgggtgctcgaggttgaaggccagctcccagtcggcttccagctcttcggcatgcagcagcacccatgcctcgaccagtttgcgctgcttgcgcggtaggtctcccttgagcaggttgccatcgaaggtgaaggacgcttcgtggccttggtatctggcgtggatgtgcggcggaacatggtcgtccgcgttcatggtgatgatgattccgaagaacatgctgatgaccggcatgtccgcctccttgttttcgttgtcttccattctaggatatttttcttttgaccggatggtcaagcgaaagcgctagcggtggtagcgggttccgtcatgagaacgcgtcgaaaccacgggtttcgctgcgcgggcgttgacgggttccgcgtgccgctatgatcaaggcgtcagccggccggtcaaaagaaaatcctcgggatgcgcgcggcatcggtgccgtgctccgtttcccgtcggcgagacgtggcctccgtgccacggcgacgccctgtcgggtccgggaaccgttcccggcgcgtggagtccagaggacggtagtcgtcctctggccgccggaggcgccgcccgcatgacgcgggcggcatcggccccggggcgtcacttggccgggaacggcgatgacgttttagtcttcgacgcttgtccagtagaggccgtcgtcagggatgtcgtcgacctcgtcccacatggttcgcgcctgttcgtcccaccatgccgcgtcggcccaatgcgcgtcggcctcgtcgtatccgacgctgccgttcgccagagtcgcgtaccggtcgaagtcgatgcccgtcgggcatatggcctccatctgttcggcggtcgcatagtggaggctgtccagatggtaggcctcctgtccgggttccaagtcgtgtgcggcgaggttggcccgcgccgtttcggcgagctcgtcgtgtttggcccggaaccattcctcggccctgttcttctccttcatgtccatgtctcctttcattccgcgcgcccgaacggttcgtcggtgaaccaccagttcctgatgacgagcatccacccgttcctttcgagcagcgggtcgaggtcgtcgggcgtgatgatgtcgcccgcgtggttgacccatactgttttctcgatgctgcatggcggccatccaccgtcgcctccgcgcacggcgtagcagtgccatccgtcgggaatgtcgcccgcgtggagccgtacgtcgctccacatcgcgtcgattcgtcccccgtcggtctcgaagacggcgtgctgcaattccatcggttccatctgcatggttccactccttagtgtcccgccggcgttcctgttttcctttcgccggacatggggcagcctcgcggtcccgccgcgcggcggaggacgcgtgggccgtgcccgcttcgggataatcgggcgaagccctcccgaagcggagcatggaacacgcagttccgaagacgcgggcgcggggctgcgatgatgaaccatggccggccgaccgttcccttccaggcgtcgacgcctggaaatcccggaagggtcggcgaagatagcgcgcggcccagggccgcgctccgtttccggcgaagccaggatcacaagcgtgtgatcctggcggagcccgactgtccaaaccggcgcgtgtccaatcgcgtgaccatggttccagccggatcaaaaccgggaaccgatgaaaacaagactggaaaggaaacggaccatggcatccgattacgtggacgacttcctgcgcaacgaacgcgagtcgttcaaacgcaaggagacggcggcgaagaagttcgacaaccgcctcgacaacttccgcaaaagcgcgcaggcgctgcgcgacgcggcgaggcaattcgaggaggcgttccccggcatgagccgaacaatgatcgcggacaagctggcaatgaccggaaccgaaaaaagcgtcgcgttcgacgcgaagggcgaactcgtcgccgcgccggccggaagaaaaaccgtctccgccgaacccaccgtcgcgccggcgcccgacgccgcgacggatccggagacgaccggatccgacgtccaggaggcggacgacgagcccgccccgcaggagcccgcagccgaacccgacacctcggacgacggacggcccgcatgggcgtccggcaactactgatgatcggacgtgatgcaagatgcgactgatcatcgccgagaagcattcggtcggccaggacatcgcccaggcggtcggcgggcacatggaaaagcatgacggctatgtgcaggtcggcgacgacctggtcacctgggcacaaggacacctcgtcgacctggccgcgcccgacgaatacaagaaccacgactggggaaagtggagcctcgacacgctgcccatcgacccgacacccgactggcaatggaaggtcagccgggacaagggcgcagaccgccagtacaaggtcgtcgcaggactgatgcgccgcggcgacgtcgacatgcttgtcgacgcatgcgaccccgaccgtgagggcgaggccatcttccgtcggatcgtgacgcatgtaggagtctccaagccgatgcgacgcctatgggtcgcgagcctggaggaggacgccatccgcgacgccctcgcgtccatgaaggacgagacggaataccgggggctcgccgattcggcgatgatccgcgcgaaggccgactggctcatcggcatgaacgcgtcacgcgcctacagcctcgtctacaacgcgaggttcaccgtcggccgcgtgcagacgcccacgctcgcgatgatcgtggaccgcgaccggcaaatcgccggccacgtggcccgaccgtactggaaggtcgtcgccccgatgggcggatggaagctgtccggcgaacgtttggacaagcgggaggacgccgaaaccctgctgcggatcgtcaactcggacgacttcaccttcgagatcttcaaggccgaccgcaaacagcagcacgacgcgccgccccgcctgtacgacctgaccggattgcagaaggacatgagccggctgcacggcctgaccgccgcccgcaccctgaccgccttgcaatccctgtatgagaaaaaactggcgacgtatccacgcaccgactcgcagtacatcacgcacgacgacctggacacgctgcgcggcctcaccgaaggcgaccgcctcgtcaccggcttcatcgaaccggacgcgaaacctgaacggccgcgactcgaactaaccgtgaacgacgcgaaggtggccggccacaccgccatccttcccaccatgcaggccgacaaggcggcgctcgacgaactcggcgacgacgaacgcctcgtgctcgtccgtgttgctcgccgcatgtgggaggccgtgggcgacgactacgtgcacgacgtgacgaacgtcgtcgcgaacatcgacccgcattggtgcgaaaagcatccggacgaaggccgcctcctgtccgaaggcgaatgccgtttcaccagccgttccgaccagcccgtctccctcggctggcacgccatcgaacatgacgggccacaggaagatcaggacgacaatgacgagactgcgggcaacatcatccccgcgaacctcgtcaccggggtctccatcgcgcccgtcccgcaatgcggcgcgacattgtccgagggaaagacgaaaccgccgaagccgttcagcgaggcgacgctgctcgccgcgatggaacacgccagccgctgggtggaggacaaggacctcaaggccgcattggacgacgacgaatcccactcgggaggcatcggcaccccggccacgcgcgccgacgtgatcgagaagctgatccgcaccggatacgtggaccgcaagggcaagcagctgcgctccacggaccagggccgttccctgatcgacgtggtcgccccgaagctcaaggacgtggcattgaccgccgacatggaacgacgcctctcggaggtcgaacacggacaggcggacgcctcgcaggtcgaaacggagttccgcgacctcgccgcgcgcataccggccgacgcgcagaccaccgtccggcaggaccatgtgcaggcgaagacgcggaacacggaatcgttcggcggctgcccgcgctgcggcaagcccgtcgtcaaaacgggcaaggtgttccaatgctccaccaaccggcgcgagaaacaatccgacggtacatggaggaccacggagggatgcggctggcgcgcctggacgaccgtggccggcaagaccatcaccgacacgaccatgcgcaggctgctcgacggccggaaggtcagcttcaagggcttcacctcgaggaagggcggcacgtttgacgccgcgctcgtcatcgacaaggacaagggcgtcgccttcgacttcggcaataacaacaaggaaaggaaaaagaaatgacggagacacaacagaccatgaccgaattcacctacgcgacgggggagaccgacgtcatcggcgaccggttcagcccgtccgtggtgctcttctggctcaagaccagcgtcgccgcgagcaacatgcgcgtgatgtacaagagtccgaacaccctgctgggcgtgatcccgctcggctcgtccacgcagacgatcccgctgcgcaacatcgcgtccgtggacacgaacacgaagttcaacctcggtagcttcgtctggggcgccgtcttcctcgtcgccggactctcgttcctttcgagcagcgcgcttgtggggatcctgttcctcctgctcgcggccgcgaacctggcgaacacgatgagcgcgcagctcgacttcgtcaaccaggccggcggcaggaacagcgtcaaggtgtccatcctcgaaaaggacaagctcatgcagctcgcgcagaacatccagcggctcgtcttcgccgacgtcgagggacaacgccaccaggaaagcatggacatggcccagaagcagtacacggcccagaccaacagcgtcctgatccagcagcagatgctcgaccagcagcgcaaggccacggccgacgataatccatcgatgccgaccgagtgacgaaaccggggcgcggccacggccgcgccccgggaaacgccgggtccgccctgtagaaaacctcgattatactaaaagtataatcacggttcgcgcaggcggatccggctttcttatatccaggaggggccatggtaaaagaggattggagcgaggccaaggcgtggatgcgcgcgacgcgcgaacgcatcggcatgacccagcacgacgcggccgtgcttgcgaacctcaccgtggacatggtcaagaaatacgagtcggagaaataccggatccaaccatcggggataatgcgggagatgctcgaacactatctcgccgagcacaggcgcgccgtcgtggccatcgtggaacggcacaggggagatgagcgggccgtgctctcgttctcccgcgtctccgacctgcccgaggggctgcccgactgggtccgggccgaggaatccgtgaagcgccgcgccgccgccgtgcgcgaggcagccgtgctgcttgaggcggagggcgtcgccgtcgactacacctatctgcccgaagaaacggaataggagagggaaggaaggccgatcatgttcggactttacatgctcgcgatatacctgggcgtcgccgtcatcgccgccggcttcgtcgcactgctcgtcgtcgtcgcgctggcggtgggactggtcacgcatcccatccgcacgctcgccctcgtgttccacaagctcgccgccctgtccgccggcctggcgttgatcctcgcgttgatcgcctggttctggaccgaccatacaaagccggacttcgtcccgtgcttctggggatccatcggcgtgatcgtcgcgtccatccttatccgcgcgttcgccgagtggattctcgaacggcccaccagggccgaacgccgagccatgaaacgtgccgccgcgcaggaaaccggccgggtgacgatgcgcatgccggtatcggaagaagtggccgcggcgttcgaatcgacccgggacggccggcgcgcctccctatgacatgcaggccgcaggacggaacgaaccgcggctggaataatgaactttgcaaccggaacacgaaaagagggacatgatggccaatcccgagctatcgcagcgcatacaggaactgcccgaggaactgctcggccttgaacacgagccgggaatcgccgaacgtctacgacggatcgacgcgctgaaggaccgtgcccgcgcactggaccccctggacggcgtcgaggacatggcgctggcggattacgaccgcgactggctggtgcgctacacctacaattcaaacgccatagagggatccacgctgaccctggaggacacgtccctggttttggagggcgagttcgtcccgtcagattcgccggcacggtacgtgttcgccgcgcgcggcgtcgcggacggcatggcctacgtacgcgaatacgcccgggaggggaggagactggatgaggaactggtccggcgcgtccatgaggtgacggcgctggacctccagccgttcgcccgcggcacgttccgcccctacggttatctggcgaggatcaccgcgacccgcgtcaagaccgccgacccgctggagatccgcgacgacctgcgggccctgatcgacgggctggacgcgagcggcgctcatccgctgctcagggccgccggcttccatgcgatgttcgagaacatccacccgttcatggacggcaacgggcggaccggccgccagctgctcaatttcatgctgctgaagcacggctatcgtcccgtggcgatcaagtatgacgccaagcgcgactatgcccgcagtctggagacctggcaggtggacggcgatcccgtggcgttctgttctgtgttcctcgactgcgtggaacaggaggaacacgcgttcatcgatctggtcgagggattgcgtcggaagccggacgccattcgcagcaaaacggatctgctggacagattcggcgacgcgctgcggaagaatcttgctcggcaagacggggatggcaagagtgccgggattgatcacaaaggtcctgggcgccatatgggtcattaggccgaaggccctgggccacgaaatgagaatcagggagaaagggagtggcgtgatgttcggaactgaaactatatctgaattcgaatgcgacgccgcgcggagaacttttctgctccgcccgcgcagccatgctgagggacagcctcccgcccatggaggggatgctggggtctggtgtttggtcggctgagaacagcgtttcacgggtcgtgccgatactcgttgtcggtttctaataggtgatactgaggggtatctgatttcaggaggattatggcatctgtgcaccacggtgttgtctatacgaaaaaatgggttgtcaacctgattctcgacgtggccggctatgtgccgggcaccggcatttcggataaggtgatcgtcgaaccatcctgcgggtgcggagctttcctgaccgtgattgccgcacgtctggccgatgatgcaattgccgttggcaaaggttggacgtcgctggggaatgcgatccgcgcctatgacatagactccgcgtcgatcgagacggcaaggaaggccgccgccgagtcattgatgaaaagaggatgccccgcgatccaggctcgggagctttgcgagcagtggatcgtacacggcgatttcattcttgatgacgtccctgccgctgattttattgtcgggaatccgccatacgtccgggccaccgaaatagaccgggggaagcgggcactttacgttaagcgtctctcttcggtaacgacgggatgcgacctgtacgtgagcttcttcgaccgaggcctcgatgcgttgagggatggcggaacgctatgcttcatctgcgccgaccgatggctgcagaacaaatacggcacgttgttgagatctcgcatgggcacggattgtgacctcgtatccctcgtgcgcatgcacggcgtcgacgcgttcgacgacgaggtcgatgcctatcccgcggtcacgacggttcgcaagggcccggcgtccgatcatctgaaattcgtgaactgcgccccggaattcaacgaggccgacgccaccacggtcctcgattggctgatggacgacgagccggagctggttggtgagcgattcgaagcattcgagattgataagccggccggtgataggatgtatccgctcggtaatcatgacctagtgagattcgtctcgcaggcatgtgaaaggttgccgaaactcgaagaggccggcgtgaaactcggtatcggtatcgccactggttgcgatgacgtgttcctcaccgaggacaacgacctagtggagcccgaccgcatgatgccgattttctacatgcgtgaccatcgtcgtgggaacgacgataggcatcgctggcttgtaaacccgtggaacgacgacggaactttggtcaacctcgacgaatatccacgactcaaaacctatttggaaacaaacaaggaacggctatcgagacggtatgttgcgaaaaagaataaagctgcctggtaccgcactatcgacaagctcacacctggactgcttgaccgggaccttctacttataccggatatggcggctcagcccgatccgattctgtcgcatggaaagtatccgcatcacaactgctattggatcacttccgatgagtgggatttggaggttctcggcggcctgcttatggccgatacgacgcgtcgtttcgtcgatgcgcttggtgtcaagatgcgtggagggacgttgcgctttcaggcacagtacctgcgcttggtgcatataccggaatatagccaaataagtgacacgaacaaattggggctttcgcgcgcttttaacgagaaggacagggctttggcaacgaaattcgccgaagcggcttataaggaggccatggaatgagatctgacatcgaggccgcgattctcggcatgtacgattcaatcgaacgcgcccgcgaggcacaggctgcagcagggcattccgatcagggagcacgtcaggggatcacgtctggaaagcacctggatccgattgcagctatcattcgtgacgatctcattaatgcgggtttccatcctgatgaggtctatgaccaaggacgcatgtgcacattaccgggctggttccgtcccaccaagaactgggacttgctggcgcttgacaacggcgaactcgtaagcgctatcgaactgaagagcattaacagttccttcgggaacaacgccaacaaccgcgcggaggaatcaatcggctcggcatttgacgcgcatacggcgttcgatgagaatctgctcggttccagcagtattccaccggtcatgggctatgtgatgatagttcacgattgtccggacagtcggattgtcggacgtggggtgcggtcagcgcattttccgattgaccctgatttcgagggggcgtcgtacctcgatcgttttttgctgctctgtgaccgactccgtcgaaagagcttgtaccaggccgtctggctcgtgtttgcgaatcccgaggacggtgtggcctatgagccttcgccggcactgacgtatgacaagttcatcgcaaacattgttatggcgcttggcgtgcatagggcgtaaaagaatgaaagcagaatcgatttcgttctttcgacttttaccggttccggtagccggtccgtagtctctatccgatcgtgcatgttccatggtgtctaagtgttgcaacattcatggtcggggatacacggtcggccatacgcaggggtgagggtctccgtatacgatgtgagatgctcacccttggcccctacgggtgtcggcggcggtccttatcctatttcgccgctgatctgataccgctggtcggaccaggagaagatggttccttccactgggcatatagtttgatttccccgcatttgtcttttgggaccatcgcgtcaaaatcatccgcgtctcttatgcttacgccatgaccgtcttcttgcgtattccatccttcaaagatgagtcccttcttccgacttgaaggctgatggtacgcgcttttcgccgaaagaccatagcttattattctgtgctcgtttattattttgagcttgcttttctgtccatcatggaagatcacatgatggccgtgcagtgcaaactcatcctcgcggataaaagaaataatacaaatgagagaaactacgattgagaagaaaaccacaaggcttaggataatgacaagcactaatacgcagatattatctatagccgattcgaaataaaccacttcaaataagatggaaatacatagccagaatacaaaattagagccagccaacatgcggcaaagtgtgggagaacagaacgaatcatgataatgatcttccgagtctggacgattggcgaatctccatctatcgattatgtaatcgatggcatatcccacggcaaggctcaaaggaacaaacagggcagcgattgccaccagcattagctccctggctaagagtttggcagtatatttcgtggctgtctcaattgacactgcaatcgttgccgagaacaacatggatatcgacatccaggaaaaaccccatatcgatattgggttatttgcttctttgacggcccggtatgaacggtaagcaacgatatatacaggaatccagattatcggcaggataagaaaagcgaggaggaaacccacgcctagtaagtcttcctttttaatattgcttaaaatgctgcttttctcaggggaaagcaatcccgagaatttgagcaagaagggtattgcccataggataagaaggagcagaagagaaaaaagagtaaaaaagaagctggctcttcttcgagacgttttattctcgattagttcattccgatgtttttgtgttttctcttgtcgccaacggcaccatgcatcgtatctgttcacttttgctgtctctgcgtcgatttcagcttcaagaagcacatcaggatgattctcctttgcctggcgaagagatgacagtcttgaaagacgcttctgctgtcttgaatatgcgttgcctccaatcaaagtcgatatcttgatggcacaatgagcaacaacagtcagaaggagaagagctgccaccaaagtgtagggccagtcgttgctgctttccgtcatagtgctgatggcttcagaaattaaacctaaggtttcttttattccattcattatcttgtccgtaatgtgtctgatcctaaaactacttcatgcacaacactaatactgtcgaccatctcttcggcaaggggcgtactgtgatggattccgagggctgaaactgattccgttatctcgtttggcctttcgctgtttggtgtgggtgagtgggtcgggggggtggtggtgctggtcgggtagtttgggggtatggataccacgtcgttgttcaccgccgccctgcaactgcctgacccgtggagggtgtcgggcgtggagttccgtgacgaggaggacggcagacgggaactgcatatcgcgatcgggttcgcggcgggttcgcggttcccctgcccggaaccggggtgcggcgaggccgcgtgtccggtgcatgacgcgagggagcgcgtgtggcggcatctgaacttcttccagtacaaggcgttcattcacgcgggcgtgccgcgcgtgacgtgccccgcccacggcgtgcacgcggtcccggtgccgtgggcgaggccgggaagcgggttcacgctcctgttcgaggcgatggtcgtggagctggccaaaagccagccggtcgcggacatcgccgagcaggtcggcgaacatgactgtatttcgtcaagtcggtgtttcgtgttggggctggtgccgttttgttggactcgtcgttgattccatcaccaccaatcatgccacaagaccgagctcgcgtcgacgatccatgatgctcatgccgaactccgtcttgatccgcctgtcccggta

SEQ ID NO: 17 - DNA, 194196 bp, Bifidobacterium longum
cgggacaggcggatcaagacggagttcggcatgagcatcatggatcgtcgacgcgagctcggtcttgtggcatgattggtggtgatggaatcaacgacgagtccaacaaaacggcaccagccccaacccgaaaaaaatacatgactaaacacgaaacaccgacttgacgaaatacagctgttcgcaatgcagcttctcgatcaggatcctctcctcggacgacaggtgcgaatactgttgacccatgagtgcaacaccttcttaagttagaaacttcgaacacttccaaccttagacaaggtgttgcacttctatttagaacccggggcgtaaacacgattgccttcaaagaagatggtcgtgactgtgctggaatcaatgttcggtgctatgaagcgaagcgttggttgtgtgtctaagctggccgcattgttgaatgaggctcaacttcggggtgtcgttttatcggctgtgatgttattgtggcgcgacacgccagctttataggcgatgagtggtggcatcagatgagttcgcttgtacgtctccattctttgttgaaatatgttatgcaaagtgtgtaattggcatatgaaactgtcatatttgatgtgttgcgttgcgtttatgtgaacttattttcattgtgcatatcgttatcaatttgttatcaaggacgatcgcgagtgaaatgcgctcatttatataatggctgctgcatggctgcccttgagggacgttcctctggcatggctttgcaatgagccgcgatgtggtcgtaaccaacgtgggattcgattgtgcggcgaagaaaaaatgatgggggggggagtcgccctccatcattcaggaaagggaactgaatggtttataacattcacatattgcaaacaaggaaaaccggtcgtgtggttgctgctgcggctgcatccgtgctgtgttgcatgggggctgtatttccagcgactatcggagtgactgcggcgtcggccgatgaacccgtcgaattggtcgtcaacggcggattcgaagacgatcttaatggttggaagtctggaacggtgtggaatagctccgcatcgtccattgccgtcactgcggatgatgtgcatggtggcagtggcgccttgagcgttactgatcgtacatcctctgatgctggtgcaatccagtctcttgatggcaaggtggaaaaaggacagacatataccggaagtatgtgggtcaaggccacggaagacggtgaattcaatatcactgtttgttcgggtaatggttccggatgtgaccagattgcgaccggaacggcgaaagcgggtgagtggacacaaatttcaggtactggaacgttaggtggtagtggtgatttcaccagtccctcgctggtgattgaaaacaagtatggcacgagcaatgccgacttcattgtcgacgacatttccgtaaccggttcggattctggttcctcattcgtgccgccgactacgggtacggcaacggcagccaaggctttcggcgactattcaaacccgattatcgattattggtatggcgccgatccgtgggctatggaatacaacggacgcgtatatatctacactacgggtgatggcacttctgtgaatgctgatggctcgttgaattatgactatgaatatgacagtactgggcagatcaaggacaattcgttcgctcaagtaaagaccatcaatgttctgtccagtgatgacatggtcaattggcgtaatgagggttacattcgtgtggctggagaacagggggtggccacctgggccagcaattcctgggctcctgccgtcgctcataagaccatcaacggtaaagagaagttcttcctgtatttcgccaatggcggcagcggtatcggtgtgctgacctcggattctcctgttggtccgtggaaggacgaaaccggtgagctgttgattaagggcggtactcctgaatccgctggtgtggtctggctgtttgatcccgcggtgttcgtggatgatgacgggcagggctacctgtattacggaggtggtgttccgacaggcgaggaagaacatccgaacacggctcgcgttattaaactgtccgatgacatgctgcataccgaaggtgaggctcaggccatagacgcacctgccatgtttgaggactccgggattgccaagataggtggtacttattactactcgtattgcactaatttcagccatgacaacgtaattgatggtaacacggtcggttacggcaatatcgcgtatatgacttcagacaacccgatggggccgttcacttatcagggtgagattctgaagaatccgagcacgtatttcggtgttggcggcaacaatcatcacgcgatggttcaacttggcgaccagtggtatatgacctaccatgcgcaaacggtggcaaaggaattgatgaacggcggtaatcttgacgcggcgcatggctaccgaaatactcatctcgatccgattacggttaacgaggatggttccattgccgatattgcaatgacatatgagggtctctcttcggtgaagaatctggacgcgtatcaagatggaggcattccagcttccaccattgcatgggattccggcattcagaacgcatatgacctgacttctggtgtgcgcgtggtcgatatgactacagacaattccgaaggtcagaagctcagcaatattaataatggtgagtggacgtctttggcgaatgtcgatttcgggaataacggcgcctcttcgctgactgtgactgcagctggcaaagccggaggcatccttgagattcgtcttgatgatccggattccgaacctgtggcttctatttcgattcctgccggtgatggatccgagtacgccgattacacgaccacccttgagggtgtgacaggggtgcatcatgtggtgttctccttcaaatccgatggtggtgcgaatgctcaggatgagctgtacgacatcactacgtacactttcacggagtcgcaggatgaaactccttcgactccggtggacaagtctgatttgcagagcgcagtgaatgagaattccggcctgaacgcttccgattacacggaagagagctggaaggtgtttgctgacgcattgcagaaggctcaggcggtattgcaggatgaatccgctactgaacagcaggttcaagatgcgcttgctgcattgaatagtgcacgtgccggtctgaagctggctgatgattccactgatggcaatgcttccgatgccgttgatgacacggatggcgtggatttggcacaaaccggttcctctgtcttgcctggtgctgtgattgtcgcttgcttggctctcactggtgtgatcgtagcgcgagtgcgtcgcgagatgcgctagttacctcttggtaatgcggtcatcccgtagcggcagcctcgggatgaccgcacatgaaacctagaactggtacttgttcaagcgtaagttttggcagtggtaatgtccatcacttatccatatgcgggaatgtcttatcgtcattcattgctgatttgtgcgggcatgctattggaatacgcactcgatgttgagtgcttatcatgaaaggttaaaagacttatgaattatttacgacaaaaaatttcggctagtgctatcgcggtgttgtcgacttgtgggttgattttggcgccaatgccggtctttgcggatgattcaacgccatcttcaacgccatcggatggcagttacaccacgactgatagcggtgatggcacgtattccattcccatgttgaacacggatgttccggatatcagtgttattcgtgtgtcgaaggacgatccgaataacaaagacggtcgtgatgtgtattacatggtgagtaccactatggagctcagtcccggatctccaattatgaaatcctatgatctggtcaattggtggatagtcacgtacgtgtatgatcgcatttctatgagcgatgcttcatccttgcgcaatggagctagctcgtatggcgaaggcgagtgggctccgtcgctgcgctatcacaatggccgcttctacgtgttattcaatacgaacaaccttaatggcgcttatatctactacaccgatgatattgagaatggtccttggacgaagattgcccttaatcggggattccatgatccgtcattgtattttgatgagcaagggagtccttggattatctccggcgtcaaccaatataggctgtccgatgatttaaccacggtggtggagagccatgagaatatcatctctgccgaacagttcactgatgatcttggtgagactcctaccggatttgaaggatctcagactttcaaaatcggtgattatttctatactccaacgatttactggggcaaagacggtcgtacggtgatgctgctgcgcaccactgatttgcttgatggctccaaatacgaagccaaaaagtattgtctaggtgctttcgcacaaggtagccttgttgaagtcgacaacggtgatggcacgacgtcttggcatggattcttcttccgagacacatatccgaccggacgtattcccggtttgattcctgcaacgtggggtgatgacggatggcctgtgtttggggacaataatcaggtaagcgcgtcggacacctacgacaaactgattgatttgcctgctgatttggagaatctggttcgccagcgttccctggtcaattcggacgattttgataatgacgcgcctcatcagtcttatcaggatcaggattggtggactctggaggagcctcctcaggttgacgattctctgattggaatcgagctggtggacaatggcgatttcgaaaacgggactgaatcgtggacccctcagtggaatggtacgcttaccgcgattacggatggttctctttctggaaccacgagtcttgctgtgacgaatcgtggcgaatacaatggcgctggcccgggtcaatctatggatggaaaattgcagcagggcgtgacatatcgtgccagtgcaacgattcgatacgaccatgagatggacggcgtcgattcatcggctgtgacttcccacctgttttatgtggcgattcaatatgcagacggcacaattaatcgtgtggccacaggaacagtgaaacgtggggagacgactactatcacaggtgagttctccatcccatccgacgctaatgtggaaggttccaaactcattgtcgaaaccgcgtggggtgcggaaggcacgtgcatggattacgtcatcgacgatatttccctgatcggtcttgctgatgagaaggaatatccggtcgccgaagaataccaacccaatggttcgaatcttgatttggtatgggaatggggacataatccagataaccgatattggtctctcactgatcgtgaaggctggttgcgtttgaccaatgggcacaaggtttccgccacggccaaatatatgaaaggcacttatggcgacctgacatattttgaaaccgcccgtaacgttttgtcgcagcgtacctttggcggatccatgtctgtggaaacccacatggatgtcagtcatatgaaggatggagacaccgcaggcctcgctacatatacccgtagttttgcctatgccgctgtgcgtcaagaaaatggacagcgaacgttgggtgtggtcaagcgtgtctacgacaatggcgtgaaggacgcggacggtaatatcgttgacgatacgattgatcgtgacgctgaagaggcctttgtatcgggcggcacagtgacattgccagatgatgcgaccaatgtgtggatcaagtcggacaacacactggataatgcgagtggtaagttgacgattcagtattggtacagtctggacggtaagcaatggtccaagcttggcgacgagcaggggccgctgacttacgattggagcttgtcgcactttaaggggtatcgaatcggcttgttcaattacgccaaggagaatacgggtggttatgtcgattttgattactatgacttgagcgacgtgttgacttctgacggcaaagctgtggatacgtctaagctgcgttcggccattgatcaggctgactctctgcagtctgcggaatatcctatggatgagtgggataagatgctcacgctacttgataaggcaaagcaggcgttggcatccgatccttccacgcaaaatgaggtggatgccccgcagcgtgcactgagtttgcagctcgcgcaattggcggttgaccgtcagtctggtgatggcggaaatcctggtggtggtgatcagaccggtgatggtgatcagaccagtgacggtaaccagtcgggtaacggcgatcagaccggtgatggcggccagcaacagtcttctactgctgatgataattcatctgaactgtcatcaactggttcgtccgtaacaccgatggtgctgtctgcaattgccctgatgctggctggcatcagtgtcattcggatacgccgctcttcgcgctgaaatatcgccgcagcctgttggttgcagcgattgaatgtgcggaatcagtgatgtgtcgcaatggtgggttgtgcgaatgctcggcaacgtggattcgtacaacccatcctgttatgttgagaccgcggcgtgagacatggtggagcatgacatcggcgtagaaacgggggagcagggcatcatctttcttgcttccgaagcgcgaatcgggcgagcggggcttgtctgcgggcaataatgacgttgctcccacggattcggataaggagaatcgtagcaaggatcatggtgaggaccagggcgagtaatcgatcgtatcggagacttgcccaacacgcacgctaagatgggcatcgcaataatcggcaatgagcaggtaatcggcgaggcggtgcatggagcaggaatccaacgagcaagaacctaacgaggcgacggaaatcgtaggcggcaaagtagagactgtcgaggtttccaagcaccccgaggcttccatacccgagaccgatttgtctctggcggatatcgagcgccgtcgttcgcatccgttgcgttgggcgctgattattcttgccgtactgtgcgccatcatcgcgccgtactggttcgggcgttcgttggcggtaaataatactgactccattgtggccgtgctcgggggagtgtctccgcaaggcatcgcactggtcggttgggtgaccgtggtgattgcgtacgtcggattggcgatggcggtggtcgtctcgccgtcctggccgtggttgatcgtgttcgtgatcgggttggccggcgaacagttcatcgcgggactcagtatgctcaatctcaatttctggtattccacgtacgtggtctacggtaagcaggccggcctggcgaatgccgcgaatctgggcattatgggtgcggcgatcggcatcgccgtatatgccctgatgttcgtgggtctgctggtgattatccggaagacctcaccactgaacgtactgaccaaaagctgggcaagtttcattctgtacttcgtgattgaaaccatcgctctgctcgtggtgttgtttggcggattgctcaccactgtgtgagcgcacgtgagtcgccgtacgtcgctcagtactcaccgctcactgctcaccgccgcgcaaaccgtgtgcccgatgtctatttagaggtgcaacaccccctgttggtcctgcaattctagcagttcgtcggcgaatgcctcggcgggcgtccggtagtccagcacgcgcatgggacggttgtcggcctcgtcgacaatctcccgcagttccccggccatgtccatccggatctcgctgcgtttgggcagataccggcggatcatgccgttccggttctcgttgcttccccgccgccggctggagtacgggtcggcgaagcacgtgtccatgcccagcccgtcgcgcaggcgcgtgtggcgggcgaacccggtgccgttgtcgtgcgtgacgccgccgcgcgcgccggccggcagcggcgagaacatcgccagctgcgccccgacgctttccccggcggtcttgccgggcacgatcccggccatgaggaacctggtcttcctctcgacctcggtgtgcaggttgcatccggcgccgatcacgccgtcggcctcccaatggccgaaaccgctgcggtctccggcctccggcggacgctcggagatgggaacccgtccgggaatcgggaaacgcgacgtcctcccgccgccacgcctgcgacgcctcccgtggccacgtggaagacgacgcgcccagcgttcacggcgacggcggtcggcgtggatccaacggcagacggtctccgggcacacgcgcatggcggagtcgtcggggaacaggacgcgcagcctgccgctgacgggcagcagcgaccagccgcgacccagccattcggccacccgcgcccacaggcgttcgcatgacaggcggtggcgcctgcgcggttcggcgcgcctgcggccggccttgcgctgcgcggggccggcgatgtagtatctgcccggccacgggcccgtcttcagccgtttcggccggtacggccggtaggactcgttctcgttggacgggaaccacgtgtcgcgtttgatctccctgccgaccgtcgaggcgttgcggccgagcatcagaacgatcccgcagatgatggtgccgttgccgatctcgatctggatgacccggcgttcctcttccgacaggtgcgaacatgcttctcccataggtgcaacatcccttcggactggttatccggacaatctccaatctaacgggtgttgcactttcaattagacaacggggcgggcatgtccgtacgaaaaacgtctatcatgtgcaccatggggaacccaaatgaaattagactggcgatagtcgataacgacgacttcgtgctgatgggtttggcagcgttcttgtcgcgtcatctgccgaatgttcggttagcttggaaggcgaataccggaaccgatgctctggaatatgcgacggatcccgcaaatgaagcggacattctgctggttgacatgagtctggaggacatgcccggagacatggtgtgccgggaaatcagaagtcgtaacaggatgttgccgttgctggcggtgacatcgttcagtttaactcgctatgcgcgacgtgctgctgagggtggtgctcaaggcattgtgtcaaaagctgattttccagcactgtgtaaagcggtcaagttcgtcagcgatggtcatactctctgtgttcgagtaggaggggagactattggattcgaggatgtagatgctgcatatcatcgtctggttcgacttcccgtgaatagaatcgaaagattgtcggaacgggaaaaatatgccatggaactatattcacagtcgtataagcccactcagattgcccggatgatggatgtttcggcagggacggtgaaaacctatcttgaccgtgttcagaacaaactccatcttacttccagagccgaactgattgcctattggtggaggcgggaacgatggtgagacgattggcaatgaaaacgatacttgtggttcgcaagaaatgcttgggagtatcgaaaaaaaatcttgttctatcgatagtggccatgacatgtcttgccgcatgtatcgccgaatggattcttgattctcctgagagtttgaatgatgggtttattcgcatcgtgtacatgcttgctgtgagtatgttgccgttatatccggtaccggcaacatgggggattatcgtcatcgcattcctgaatgaattgatgccttgcttatcgcaatgcgatgagtcatggggtgttctggtatctcttgcgattcaaggctatgctgctgtttggtggaatggtgtgacggcaacggtgctgttgtctattagcgctttgctgaattatgcgatatatcgggagaatagtgaatttggttcgttcgatggttccattaatttggtggtgttgctttggtttgtgtttcttttaggggtttggctacggcaaaggaacggacttgaaaagaaaaaagagttagaaaagaaagctgaaattgttcgatataacttacagcttgctgaggggatgcatgatgccatgtctggtgagttgacacgaatgttggtcatagtgcaggaaggtattgatgcatcgaaggaagaagagcttaagcgatggagaaaattgcagaacggtatcaataggatattccaagatctgcattcggttatgaattatctatcggatgatgaccataaacaagatgatgtatttcatgtaagtcttgccgaacatattcaagctacattgagtgaaagtgaccgtcggttgcatgacaaagggttttgcggtcattcatctcttcgcggtgtatccagcgcaatgttgaactcgtggaatcaaataatcgttaacctgttgcgtgaaatttacacgaatattgaacgctatgctgacaaaagtgaatattccgtcattgtcacattttcaaataatgctgttgatattgttcaggtgaataaatgtcgacaaaagagtcggcgatgcgtgactgtgggagcaagaaaagggctaagtatatattcccgtttgatatctggacaaggaggattcatcagatatgaaaaagacggcgaagaatggtctttctattgcatgttaccgctactgacctaatttctgatatggcataatggaaaccatacagggcatagtgaatatgttgatatttcttcctccgttgaactgttgcttggagtgctggctgacgctccgaatgtcaaaccaagtaccgtaagtattaaaagcggtgttctcatgagggttcctttgcgtcggggtgtgtcaatgatcattgcacaacatggattcatataaaagtccttgtcccctaatggcatacaagtcattgcgaagcgggagaaagcgcgtcatgcttacagtagctcttcgcctgaagggcaggaattaggtaaggaggcctatatgagcatcaatgagaagtccattgtcggtgaatccttcgaggatctgtcggcggccgatatggcgatgctgaccggtcgcaacgatgatggcgtcgcgccggcgtcgctgtcgttcgcggtttccgttctgagcgtgtctttctcggcatgttcggcaacggtcgtcacccgacttgcatcctgtgggaactgcaagtgaacgttgctttacatgggtcaggtatggattgcgtaaaacatccgacccatacctgacacttgttatcgttaaggggaagtggcatgaaggcgattctgtttcgtgactgcaaggcatgtttccagtcattcaagaactggggtatggttcttatcattatggtcacggcaatattcgtggagatggttgccagtggcgcaggcattctagacccatttacttgggctgtcttttttggaccgtttttcatctattcgtcatgctcggtgatggtctccatcctgtatcaggatttccgagatggactgtttgagctctatatacagtctggtcgttcctattggagctactgctggtgtaaatgcctgtttcctgttatcctgacagtgatttccgtgcttttgaatctggcttttatgcgtgttttgtcatcaggctttcagataaccgctggagcagatgatgcaattggtgctcttatcgtatcagtcttaggaacaatcgtctgttctttgggcgcaatgccgatggtttatgtctcccggaacagcgatccgacaatggcacaactggttttggtgttgattgcggtcctgctccaattggcatatatgcttgtgatcgtcaacgtgatgccgctgtgcctgttctcggttggttatgtcgtattggtagtggtcgccatcggtatttcaaccggagtattctctcgatattttatcaacaccaatatcgagctgtgacatctactggattcgaagcttttggaaaggtggatttccatgaccagcatggtggcctatgtcgcttcgcgtaatccgcagtcgcagacgttgcggtcggttcgtctgatacaggatgcggtcagtgcgaacattgacgcggaatggacgattctgacgccgaatgacacgacgatcttgccgtcggatggtactgcgagcgagttttccaccggtgtcgatcatatcgagctgaacggactggacgattccgcccgggtcaaaaaagcaatcgaacgatgcgattatctgattctcggttcgccgacctatggccataacgtttccggcgacatgaagattctgatggatcgactcacctattgggggcatttgttccatctggcgggcaaaccgggcatggcaatggtcagcgccacaaccaacgggttccttgaagtcggcgaactgatggaacggttcatggaatcactgggcatcatcattgatgaaaccgcataccacaccacttttacgccattcgatgaggcaatggccgatcagaccgccgcggctatcgtgcgggcgctgaacacactgcgggatggcgtcgtgcctgaaaccagcgaaaggcaggagctggcattccaatcctacaagcgtgactacgcccgacgagacggtagcgatgcagaatcgcggtattggcgggaacgcggcatgttcgactgcgcgacgttccatgaatacgtcgaaacgcggcggaagctgccggaatccgtccacgccgaacggtagggggactttccatgaacggtaacgttggaacgacctgggcggcttctgccacgacccttgaggaacggtgcatggcggcaaccgctatgccggatgctttgcgacagtatcgggcatcgcacgcggaagacatactttcggcaacggtggaatggaaaaaccgacggaacccactgcgggacgaggactatcaaggcatcgccgacgcgctcggcgatgacgcatccgtggtcgaaaccgtcatcgcggatcgggaacggaaactgagcggccatgtcgagccggcatggtccgttgaactgcagacgattctgaaccgttacgacagcgaggaagagcgagtcgaacgcacggggtatgccaccgccttcgcaccgttcgtcgcgtacgtgaaagcggaactgcaagcgtatatgtcggcttgttcattgccgatgaatgacgagcgccttatcgaacagtgcctgagcgcatacgtcgagcgtctgttgggcatcggattgaaaaccgtcgtatgggaattgcatgtcgcgcgtcaggccggttcgttgggcgacggcgatgcgaagcgacaattgcggcgatatttcgaactgctggccaccgacgaataccgtggccatatgtatgcgaaatatccggtactgcttcgttttgtcacgcagacgacagtccattacatcgatttcgtcaaggaaatgctcgaccgcgtatccatggatcgcgacgagctcgcctccttcgcaggcgtcggcgatgatttcagattggaagatatgtccatcgaccgtggcgacgcgcacgacggtggaagagccgtggccatgctcaccatcggcggacggaaaatcgtatacaagccgcgtgacctgcatatccatgagcttttcgccggattggtgaggcgatgcgaacggacgaagggtttccttccgatgcgagtgtcggacgtgctgacgaaatccggctacgcctatgaggaattcgtggaacacggcacctgcgaggatgcacgtcaggtggagcgctattacaccagatacggtcagctgctcggattggtatggctcctgcacggcgacgacatgcaccacgagaacatcatcgccagcggggaatatccgatggtcgtcgatttcgagacgatcgccacgaaccatgtgaccatggacatgcccgacggcaccgatgccgacatccgcgtatccacgatattgcgggattcgctggcatcctcctgtctgttgccggcgaaaacggcgatgtcggccgacggtacatccgtcgacatcagcgccttcgaaaccggtgagcagacgatgcccggcatcgtcgcgtccccggtgggattggactccgccgatgcccattacgagaggaacgccgtgacgttcagcaaggacggctgcgcggtgacattggatgacgccgttgtggatccgtatcattacaagcgacagattctccaaggattccgcaatacggtcgccgcggcgatgaccatcgacgcggatgaatgggatgcgatgctgtccggcgaggatacgaccgtgcgtgtgctggtgcgcaacaccagcgcctacgcccgatttgcggatttcatccatcatccgtcggcgttgaaggacatgctggacgtcgaagccatactggagaacctgtatgtctacccattccgtgacaagcgcatcttcgcaagcgaataccggcagatgctcgccggggacatccccatgttcaccgcacagctgacgggacatgatctgcacgctcccgatggaacgaccattgacggcgtctgcgaacgttcggtacgcgaacgggtgcttgacaccatcgggcatcttgacgaacaggccgcattgcaatcgcgcattatccgcaacgccttgcgcatggaacccggcatggaggacgcgcatccgacggcttcggtgtcgtcggacacggatgcggagcattacccaatcgaactcggcacgaggatagccgacacggccatcctccaggaaaccgatggcaccgtatcatggcttacagcgaaccgatccgacaccatggccgcggacaagaccgtggatgaacggtacgaaccgggggcgccgacttcgggactctacgacggcatggccgggacgggcatgttcgccgccgaactgtatcggcggacacacgatgagcgctggcgtgacctgtgcacgcgtatgatgcggagtctgatgcgccgcaaggacagaggcattacgtattccggcttcacttccggcctgtcgcgaagctattgcgcgttacgcatggccaatgccggcatcacgtcgcccgaagctcgccgttgcatgacgcagacggttcgtatgctgccggcatacatcgacgatatgctgccgaagctcctgcagcgcgacaatcctcaaccgtcattccatctggattacctgaccggggcgggcagttcgatcatgctgtatctgcggctgtacgacgtattccatgacatgcgcatagtggaacaaaccagccggctggggagaaccgtcatccgtgcgtttcccgaaacccagcggaacgccgacgaatccgatgacatgccgtatccaaccggtgccgcgcacggactggaaggcatggccgtggcgttctggaagctctacgcggcgacggggaatcgcgaattcgccgaattcgcccgaatgctttggcggaaatcggacgctcgaagaagcggtgcgaaacaggaggacgccggcaaatggtgccgtgggaaggtcggcgtgctctgggcacgcaatgagctggcggccactgccggcgcggacggcgaacgtttcttcgaggatgaaaacggacgggcgttcccagacaaggcagatatcacggcgttgcttgggaacgcggattgggacgacgacggcgtgtgccatggacgatgcggcatgatcgacaccctgatatccatcggcaatgccaacggtgacgaatggtatcgcatgcaggcacagcgtctgatggacgacatgatcgcgcaggcccgttcgtcgggacgtttccggctgaggcaatcccgtgaattcgtggatctgtcgtacttccaagggccggtcggcgtcgcctacacgatgcttcgtctgaacgacccgtccacgccctccatactcgcactggaaacgcgatgacggacatgacggatacgaacacaaccgaatcgacgacaaggaaagacaatatgaccgccgaccacatcaaccacgccgaccgcaccgacaacggcgaacatgccatcatcgccgtcgaacacgtcaccttcggctacaagaagaaacagaccgtgttggaggacatcgacttcaccgtgccgcaaggccagtcgctggcgatcctcggatacaacggcgtcggcaagaccacgctgttcagactcatcgtcggactgctgcgcccccgtgaagggcgatgcgtgatcgataggcgtcgggtgccgtcgatgcgcgacgtgttccagatgaccgagaacggcaatctcgtcggcacgatgaccgtgcgtgacaacatccacttccggcaactgctgttccggtccggcaagggaatcgcggacggcggccataccgtcgactcgaaacggctggaggatgagccgctcgtccgtgccttcgaattggaggggcatctcgacaagaaggtggcggaactctcgaccggtctgcgcaaacgggtcggcatcgtcgccggcatgctgttcgacccgcatgtcatcatgctcgacgagccaagcaacgccattgatccgatcacccgctcgctgctcgtcgattacgtcaaccagcttcgcgccgacgagcgcactttgctcaccgtcacccatgacctcgaatactgttggaatgtggccgaccggatcatcatccttgacgacaaacacctcgtcaaggatatgatgctcgccgaattcgacgactatgaggcgttcaccaaggcgtccacgctcgggcgtgaccgcacgcacgtcgacttcggccttcccgcgcgcggacggcaagcatgagatcatggcgtcgccaccgtgtcccgtttatcgaacaaggcgagcacagcgaatgcgggctggccgccgcagcgatgatcctcgccgcattcgggcatcccgtgaccatggacgagctgcgccgccggtacggcgctccacgcggcggactgagcctcgcgaacatcgtaacggtgctgtccgactccggcatccgcgtacgcgcggtcacgacccccagcgccgaagcgttgaaaaccgtcatgacgccatgcatcctgcattgggacgacaaccatttcgtcgtgctcgaccattacgcatacggccgattccgcatcgctgacccggcgaacgggcgccatgcctatacgcccggcgaactcgcggcccactgttctggcgcggtgctgattccgcaaccgacaaacgacggctgcgcaaccattcccatacggcctcgcagcggaaccgtctccatcctgaccgggttcctccgccggaacatgcccgccatcggtctgagcctgctgttctcgctcgtcgtccagggactgacattgatcgtgcccgcaggcaccggctatatggtcgaccatgggtcgctcgccgcccaaagcggtttcacgccgttggtcgcgacgatgctgcttgcctcgctgctggtctactatgcggtcggcgcgttgaacaccgtgatgctcacccgcgtgcaggtgcgattcggacgatacctgtcccgccgatacatgaccggcgtgctcgatcgggagttcccgttcttcgtgaaccgttccggtggtgacctgatctaccgcgcgaacctggtcatggtcgtcgaacagatcgtgaccggcagtctgccgtcgacggtcgtgtcgatggtgttcctcgtggtctacctgatcatgatgatcgcctattcagtgccattgacgatgctgaccctgacggtgtgcgcggcggtgctcgtcgtatccgtcatttattccctgcgcaacaggacgctggtcgagcgtgcgaccgtcgcgcaggctgacgtgcaacgcgccttcatcgaaaccttctccggcatcgaaactgtcaaaagcctcaatttggaaagccactgctacgaccgctggtcagcgcgtctgggagcgcagctcgactaccagactcggcaagggcggctttcggcattgctgtcaagcctgtcctcggcgctggtgttcgtgttgccgctatgcgtggtcgccttcggcatgaccttcgtgggacgcggcacgctcgcactgggtgccgtcgtcggattcatgtcattggcgtccgcattcgtcacgccattctccggcatcgtcggcgtcatcagccagatcatggcgttcgccacctatatgcgcaagatttgcgagatgattcccgccggtgaaggcggcggtgcgtcgcttgaatgcgacgaaccgggtggcgaaccgggtgacgtcggactgggtgacggcggacggtccgcatgtggtgggccgagtggtgacgaatcgggtgatggcatactcgaacggttgcatgccaccggcgtgggatactcgtacacggcgttcgacgctcccgttctctccgatgtcgattgcgacatccgcaaaggcgacaagatcgccatcgtcggccccactggctcgggcaaaagcacgctgctgaaactgctcgccggactcatcgaacccgtctgtggcacggtgaccatcaacggcggcggatgccggatttacgacgcggacagccgatggaaggccggcaggctggcgtatgtgcatcaggaatccacggtgttcaacgaaaccttgcgcgacaatatcacgctgcaccgtccgtggctgacggatgacgacatcgtcagggcgtgcgaggttgccggcatcaacgaggggatgatggatccggtcgtcggcttggacgccatggtcagtgaacgcggcatgaacctgtccggcggccaacggcagaaggtcgccatcgcgcgtgcggtcgtcggaagaccggacttcctacttatggacgaacccaccagtgctctggacaacgataccgagcgacatgtcatgacggcgttgctcgactccgacaatgcgtgcatcgtcgtggcgcacagactcgcatcgattcgggatttcgaccgcatccatgtcatggatcatgggcagatcgtcgaatccggtacgcatgacgaactgctgcaggccggcggattgtattcgcggctgtaccggcaggagtgagtgtccccttacacccttacgcctttaaacctttaccctttacaccttatcccttacaccctcggctcatgaggccccagtccggcccttgccgtatagttttcatttggcgtaatttcgcccgcggatagagagcgtttcgagcgaacctgcacgaaacaccgcgcaacgacacaataaggaggacgccgtggcactgacggctgacgagaagacccagattatcaacgagtacgcgacgcacgaaggcgacaccggttcccccgaggttcaggtggctctgctgtccaagcgtatcgccgacctgaccgagcacctcaaggagcacaagcacgaccaccactcccgtcgtggtatgcagctgatgatcggtgaccgtcgtcgcctgcttgactacctcaagcgcgttgacatcaaccgttaccgttccctcatcgagcgtctgggtctgcgccgataattgaagacttccgcccgagtacctaggatggtgctcgggcgttttacatatcgccagccaacggcaacaacggcaagagggttagaggataggccagcaggtaaggccgacaagagaacccgaatgaaggggttgacacgaggaacgacggccaaggggccagtcgaaacaaggtatgtgacgtccgctgaagaggacagttgcggttcaagcgagtcgccgaaccgcagcacagtatgtaggaataattagaaaattaaagaaggaggaaccctatggagggtcccgaaatcaaggccgttgaggccgtaatcgacaatggatcgtttggcaagcgcacgctgcgcttcgagaccggccgcctcgcccagcaggccgatggcgctgtggccgcctacctcgacgacgattccatgattctgtccaccaccaccgccggttccagcccgaaggagaactacgacttcttcccgctgaccgtcgatgtcgaagagaagatgtacgctgccggcaagattccgggctcgttcttccgccgtgaaggccgcccgagctccgaggccatcctcgcctgccgcatcatcgaccgcccgctgcgcccgctgttcccgcacaccctgcgcaacgaagtgcaggtcgtcgagaccgtgctcgccgtgaaccctgatgacgcttacgatgtcatcgccctgaacgccgcctccgcctccaccatgatctccggcctgccgttcgaaggcccggtctccggtgtgcgtctggcgctgatcgacggccagtgggtcgccttcccgcgttggagcgagcgtgagcgcgccgtgttcgagattgtggtcgctggccgcgtgatcgagaacggtgatgttgccatcgccatgatcgaggccggtgccggcaagaacgcctggcacctcatctatgacgagggtcagaccaagcccgatgaggaggtcgtggccggtggtcttgaagccgccaagccgttcatcaaggtgatctgcgaggctcagaacgagctcaagaagatcgccgccaaggagaccaaggaattccagctcttcccggagtacaccgacgaactgtacgcccgcatcgacgagatcgcccacaaggatctggacgaggcgctctccatcgccgagaagctgccgcgccaggaccgcatccacgagatcaaggagcacgtgcgcgaggtgctcgcggacgagttcaccgacatggacgacgccgagaaggacaaggaactgggcaacgccttcaaggaactgcagcgccagatcgtgcgtcgccgcatcctgaccgaggactaccgcatcgacggccgtggcctgcgcgacatccgcaccctgtccgccgaggtggacattgtgcctcgcgtgcacggttccgccctgttccagcgtggcgagacccagattctgggcgtcaccaccctgaacatgctcaagatggagcagcagatcgacgcgctgtccggtccgcagtccaagcgttacatgcacaactacgagatgccgccgtactccactggtgagaccggccgcgtcggttccccgaagcgccgcgaaatcggccacggcgccctcgccgagaaggctctcgtgccggtgctgccgagccgcgaagagttcccctacgccatccgacaggtctccgaggccatcggttccaacggttccacttcgatgggttccgtgtgcgcctccacgctgagccttttggctgccggcgtgccgctgaaggctccggttgccggcatcgccatgggcctcgtgtccggcgacgttgatggcaagcacatcttcaagaccctcaccgatatcctgggtgccgaggatgccttcggcgacatggacttcaaggtggccggtacttccgagttcatcaccgccctgcagctcgacaccaagctcgacggcatccccgccgacatcctggccgccgctctgcagcaggccaaggaagcccgcgccacgattctcgaggtcatcaacgagtgcatcgacggcccggccgagatgagcgagttcgctccgcgcatcatcaccacctccgtcccggttgagaagatcggcgaagtcatcggcccgaagggcaagatgatcaaccagattcaggaagacaccggcgctgaaattgccatcgaggatgacggtaccgtcttcatctcctccgagggtggcgaggctgctgagaaggccaaggccatcatcgaccagattgccaacccgcacgtgcccgaggccggcgaaacctacaacggcaaggtcgtcaagaccacgtcgttcggcgctttcgtgaacctcacccccggcaccgacggcctgctgcacatctcccagatccgcaacctggccaacggcgagcgtattgacgctgtcgaagacgtgctcaaggaaggcgacaccgttgaggtgatcgttcagggtgtcgatgatcgcggcaagatctccctggccattcctggtttcgaggatcaggagaacaacgcccgcccgagccgtggcgatcgcgatgaccgccgtggcggccgtggccgtggtgaccgtgacgatcgccgtggcggccgtggccgtcgctccgagcgcgatgaccgtgacttcgacgatcgtgacgaccgtccgcgtcgccgtcgctccgatgacttcgaggatgattacgacgaccgtccgcgtcgccgtcgctccgatgaccgtgacttcgatcgcgatgatcgcgatgatgatcgtccgcgtcgccgtcgttctgccgaccgtgacttcgacgatcgcgatgaccgtgatgctcgcgactcccgtgacgatgatcgtccgcgtcgccgtcgctcttccgatcgcgatgaccgtggcgatcgtgatgaccgccgtggcggttcccgtggccgtggccgtggctcggaccgtaacccgcgctacgccaccgacgacaactacgacgactaccgcgccgaccgcgaagagcgtactgagcgcccgcgtcgccgcgtccgtcgcgactttgatccgttcgaggactaaatccctctcacggatcggtcgcggcatagccgctcccctcacctacgggaagcccgtagggcttcccgcttaacggttcggcattcgaggactgatcgttctctagcttctctcgggtgagaagggcttgatcgcaaaccaaaaggcttctataccgtttcattcggtatagaagcctttttggtttttcggcttcttcgcgctgcatatttcgatgttgaataaggcactcgtgctgccgccatgtacgtttagttgtcggttgacaactattcccatgcatcaagaatggcggatgatcatcgaaggtactcatgggcgttgatcactgtggcaacaacaaaggccgggcccttgtgagagcccggcctttatgccgtatggcggcggattaatccttaaaggctaatccgttgtcaatcagcgttacagaatcgccatgcacacgaagtccagaatgaacagcgcggccacagtccagatgatcgggtgaacctccttggccttgcccttgcaggtcttcacgatgcagtacatgatgaagcctccggcgatgccgtaggagatggagtaggagaaggccatgaacacggcggcgaagaacgccggaatggcttcggcgatgtcgtcccacttgacttccttcagggaagcggccatcatgcagccgacgatcaccagcacgccggcggttgcggcggacggcacggcggagacgaccggggccaggaacgcggacaaggcgaagcagatcgccacaaccacggaggtcaggccggttcggccgcctgcggcgatgccggcggaagactcgacgtaggtggtggtgttcgaggtgccgcagatggcgccgatggaggtggcgatggagtcggcgaacagggccttgtccatcttggaggagaagccgtggccgttctccagagccttctcatcctcggcggagaagatgccggtgcggcggccggtgccgatgaaagtgcccagggtgtcgaacgtatcggacatggagaaggcgaagatggtcacgatgaccagcggcagcttggtcggatcagagaacagtgccgggaagccctcggcggagaagatcgcgccgaaggtctgcggcagctgggagaaggtctcgctgatggactgcgagttggaccaggtggtcacgccgaacgggatgccgattacggtggtgatggcgatggccagcagcatgccgcccttaaccttcatcacggtgaacacaatggccagtacgaggccgatcaggaagacccacagcaccttgtcgttgaagttggccagacccggggtagccgcaacggcaccgcccttggcggcggccttcggatcgccgggagtgaacttgatcaggccgacgttcagcatgcccacgtaggccacgaacaggccgatgccgccgccgatggcgtgttgcagggactccgggatggccaggatgatcatcttgcggatcttggtgacggtgatgaggatgttgatcaggccgcacaggaacaccatgcacatggtctgctgccagctgaagccgaggccgaagcacacggtgtaggtgaagaacgcgttgaggcccatgccggcggcctgggcgtacggcacgttggcgaacaggcccatgaccagggtgccgatgatggccgcgatgatggtggccaggaacacgccgccccacggcatacccgtctgcgacaggatctgcgggttgacgacgatgatgtaagccatcgcgaagaacgtggtcaggccggccagaatctcagtcgagacggtcgtgccgttttccttcaaatggaagaacttctccatttactctctacttccttgggtttatgcggggctgcgcaccgcgtgcataatgctgcggctggccccggcgagaattgcgactcgccctgatcggcctgcccaacgcgcgtcaggcgctgcgcacccaatcagaaccgtggccgattatagcttgtggaggcaacgtgaacgggtccgggagtagactgactgccagaataattcggaacaactcaggggacacgcaggacacacccgtggaaggaaggcgcgcgatgaaaccggccgtcgaagtcagcatcacctcttggaagaagaatgtcgtcaagcccggtcaggagtacggccgcgtactgctgatgcccggcaccggctacaactgcgaccgtccgctgctctactggtcggcccaggctctggtcgaggccggctggcgaatcgaccgcatgaacgtacgcaacgcttccgacgacctgtccacggtgattccggtcctcaatcaggcgattgacggctgggtggccgccgcgcgcgagtccggcgcgggtaaagccggtgattccggggatggcgttgccgccgatgattctgctaccgtgctggccgatggcgcagctggctcgccgaaccgtgattccgacaccccgtccggccctcgcctgttgctgatcggcaagtcgctgacgacgatgacctacccacatgtggcctcacactacggtctgccgttcgtgctgctgaccccggtgctgcatcacgccgacttcgatccatccgcccgggtgattccggtgccggctgtcggcgatgatatcgtcgccgaatccgaggccccgagcgtggccgaagcaagggcgatcatccgcgcggaacaggccggccagtcgcacgccgccagctcccgatactccggcccggcaccgctgatctgcgccggcaccgccgacccgttctacgatcaagcccgcgccaacgcgctcaccccgcacgtgcacgaatacccggatgccaaccattcgatcgaggtgcccggccactggcgtcgctcgctcgactatctgaaggaagtcaccgcgtccgtagcccagtacgccgccacgctgtaatgccccgcgacacgcccgaattctgcaatgtcgctgaccatccgtaatctgatcatccgtaaaccacagaccgttggttgaagtgcgcgcgagtgcatttccgaagtttggttcgccaagccagcgcaggttgagagatataagcccgtcaagggccggcgaaggtcgcttcgcgagattatattgctctgcctgtgcgcagggcttttttgttgcccggccgaaagttccgaactccaagtcaacggccgacttaggaaggaacgccatgaagaggcccgaaaaggaagcggtagtcgctcagcttacggaagaattccgtaacgctgacgccgtctacctgaccgagtaccgcgggcttaccgttccgcagatttccgatctgcgtgaaaagctaggccgcgatacttcctacaccgtggcaaagaacacgctggcacgcatcgccgccaaggaagcgggcattgagggtctcgacgagattctctccggcccgaccgccatcaccttcgtgaagggcgacttcatcgaggctgcgaaggtcatccgtgacttcgccaaggacaacaaggctcttgtcatcaagggtgccgccgctgacggcactgtctacgatgccgagggcgccaagaagctggcagacctcaagtcccgcccgcagctgcttgccgaattcgccggcgacatcaaggcatcgatggccaaggccgcgtacctgttcaacgctctgcctaccaaggctgtgcgcacgatcgacgccctgcgcgaaaagcaggagaaggctgcctgatttacgccctcacggcatgaatcagtcgcttcgataatttaaacaataaggtttattaggcagcggatctaccacttcgtccgccgccaagattgaaaggaagccataatggctaagtacaccaacgatgagctgctggaagccttcggcgagatgaccctggtcgagctctccgagttcgtgaaggccttcgaggagaagttcgacgtcgaggctgccgctccggttgccgctgttgccgctgttgctggcgctgctgctccggctgaggaagagaaggatgagttcgacgtcatcctctccgccgtcggcgacaagaagatccaggtcatcaaggctgtccgcgccatcaccaacctcggcctggccgaggccaaggctcttgtcgacggcgctccgaaggccgtcctcgagaaggccaagaaggaagatgccgagaaggccaaggctcagctggaagaggctggcgccagcgtcgagctcaagtgatttgtgcggcataagccgcaatcacagcttttcgaggaaccccgcacctgtgtttcaggctgcggggtttccgcatactgagtagactagttgacgaggacgaggcggagaacgcgatccggcgtggaaacacaaagctggcaatgagcgaaagttgtcaattctgtgcccagtaatccgccaaaagccggtaaaagatgacacaatggcacgtagtgtggtcaaatagtgtgtccaggaaggcggtcacggtgagcgagtggacggtgaagatcaacggtgtcgaccggatcagcgtcaagccgggggagtgcgtggaaatcggccgtaagccgttacgcccccttgccgatgatggcaacacccgccttgacgtcgccgatcagaccaaatcgatgtccaaacggcacgccatgttcacggtaaaaagcaatggcacggcctcggtccgtgatcttggatcgaccaatggatcgtatgtggtgcgggaaaatggcgatttgttgcgcttgccggccaatgccgagttcctgttgccgacgtctcccatgcgcatgcagttcggcgatgtgcctgcggacttcattcgtgtcgacgatccagtggcaaagccgctcgacctcaaggtgcctgatttgtttggctatgcggttcacgaagcaccgcaggagccggatgcggcggatatgtccgtcgacgatattcttgatttgcgggccggcgagccgaccgccatcttcagcgcggataatgttcgacgcaaggtcgacgagcttgaacttggctcgctgaatatcacgcagccagtgacgaaaaacgatgagccggccataccccgtgatctgttcgcggatgcgttggcccagcatgccgagcaggagaccgaacgcaaaaaccagcaggccatgaactccgtggcactgccgaagcagcagaccgaacctgagtcgacgattgtaacgcctgcatccaagcacagcaggatctccggtattgttccagtagatgccatcgcccatgccgttgttaagcacgctcccagcacaagcgagccggcagtggcgtcggcggcggttgttgaatccgatgcagcggctggcgcaagcaagtcagccgaaaacgttcagtccgctccgaataccaggaatgccggcgattctcagccggcggacactgtcgaacagcatgctgaagttgcccagcctgaagccgcccgggaagccgaagccgctcaatctgaaaacacccagcctgagaccgctcagccggcaaccgcccagtctgaaaccgaccagccggcagctgacgtaccggacgatcagcagcggaccgcagccgaagcatatcaagaagccaccgcagcaggcgtagcagaccagcagccggctgccgaaaccgcccagcagtcggtatccgaagcatatgatatcgactccacgggcgtacacactccggtcttcgagcccggctcggtgttcgagcgtgtggccaagggcgagctgaaagcacaggagccggcagtcgaagtcgatggcctgacctctgacgaggcaaaaaccacgcaagatttcaatgttcaattcgaagtcgcccgtcatcccgaattgctggcgttcctcgccatgaatccgtacctgtacgacgacatgtattcttggctcgccgcccgtggcgaggccgatattgacgaagccctgtctcacaacaagggctatcaggaataccgcgaagcggttggaaagtgagtcgagagatgacccagagccagactcagaaccagaatctcacggaaggtctgaatcgcatccgtcgctggcgtgaccaataccgcagcatgcagccgccatcgccgctcgaggatgtgaatcaactggccgcgaagctggagatgacccatgcccatccctccggcatcgcccagctgttcgcttccggccatgtccggttggattcgttgttccgcgacacgggtgtgcttaaggccgccgaacgccatattgggcgcgtgctggatgaccaggccgccaaacgcaggatttccggcgtggcggagttgtcgctcgtggtcggcgtggccacatggaagggcaacgcgctgccggtgctgttgtacccggtgagcgtcacgatcgaggatgatggcttgtcgaccaccattcgattcaccggtcgcgtggccctgaacgtcgcgttcgtcaatacattgcgtgagcagggggtgttcctggatgaggattccctgtttgacggtgccagctatgacagtggcactcccgaaacttccgcgatgttcgcccgtatttcgtccgaagcgtcggagcgtatctccgacttcgccatcgagcgccagattgtgctcggatgcttcatggacccctcgtcgcagatgatcagcgaaagccgacagttcatcgaccagctggagaacggccccaccggcaatgtgctgttggacgcgcttgccggcgacgaatccgcccgcaccgcgctcaaagatgccaatattccgcaatacagtcctttcgacgtagacccgcatgctgagtacgaagtcggcgatgtggacaatacggtgcgatatgccgcgtcacttgccgccaatggccatagcatcgtggtcgacggcgccttcccgaagggcaccgcggagcaggctgtggccatcgcatcgcgctgcctgatgaatggtcgttccgtgctgtacgtgcccggcgtggccgagcagaagcgtctgttcatccagacggcctccgccaatgagatgaaggcgcaggtactggatgtatccgatgaacacgccaacgccgcgcttgataagcagctgattgccgcagtcggattccaaccgggagtcgccacccagcgattcgaccagttggccgacgaactcgtgggcgtgcgttcgcgcttgacccgctacttgggcgacctgcacgggggcaatgataagtggaatgtgtccgcatacgagaccattcagaatctggcccgtatctccgtgctcccgacgcaccctgccacccacgttcgacttgacgagtcaagtgccctgagcatcgccaacgatattgacacatggatcggcaagatggaacgcgccggcgagctcggcgaatacaccatcggcccggaagacaccgcatggtacaaggcgtccatcaccactgaagaacaggcagtaaccgcctaccagcgcgtggacgatttgctgcgtcgcttcctgcccgccacccgtgagcaggtggcacgcaccgtgcagacctgcggattcccggttcctcccaccacccgcgagtgggagcgtcaggttacggttttgaagaatctgcgacgagtgcttgacgtgttccagccggagattttcgagcgagacatcagctccatgatcgaggccaccaagccgaagagccagcgcaaggccgagggcacgtcgatgggattctgggagcgccgccgccacatcaaggaagccaaggatctgctgcgcgtcggcgcgcaggtcgaggacttgcacgaagcgttgaaggtagtcgccaagcaaggggagcagtggcatcagttcgtgcctcacggcggttggccggtgctgcccagcaagctcgacgagatcatctccacccaagaggcgctggtcagcaatatgaccgcgctggataccgtgctttccaccacacccgctggtggcaatctggaaaccgccgatttcgagaaggtggaagcacgcctgaaagcactgctggatgatcgcaaggcactggacaccttgccggagcgttgcctgctggagcaggaattcgcctctgccggactgaacgaactggtcgccgatctcaacgctcgccgagtgagcgtggagcaggtgcgcggcgaagtgcagctggcctggtggaccaccgtgtttgaggacattgtgcgttcgtccgccatcatctccaaccaggatggtgccgcgctgcaggccgcatccgaccgctttgcgcaggtcgatgtggagcacgtgcgctccatcggaccgatggtgtcgcaggaatccatgcgccgcctgtgcgacatgctgttctcccgcactcaggaagccaaccagatgcacaccgtgctggcagggcgcgccagtgtgtcgctgagcaggattcgccgtgatcatccggagattctggccgcggccaagccgattctggtggccgcgccgggtacgctcgccgcactcaccgagccgggtgtgctggctgatgtggcgattctcgatgcgtgcgcgcacattcccgctatcgagttgctgtccatcatcggccgcgtgcagcaggtggtggtgatcgcccactgcgcgacggtaaccagcgaaagcgtcaagcagctgatcgacacgttgcctcatatcgaggtggatgctgccccgtctcgccgtgcgccgcgcctgtccgcattccttgaatccgagggatatggtcctgttcgctatgatgtggccaccgagccggctgccggtgaggtgcgattccaccgtgtggaagcgagcggtgtgccggttatgtcttctggtctggtggaatccagccagccggagattgatgaagtggtgcgtctgattacgcaacgtgccgccggttttgccgtggttccttccagctatcgacttgtggtcgtgatgttgaccgacgcattccgcacacgcttgggtgccgaattgaagtcgttggcaggcaaatccaaggcgatgggccgattcctgcgccatgtgcggttggtttccttgcgtgacgtggccggaggtcgtgccactgacgtgattctgtcgatgtgctatgcgaaaaccacgcacggacgtctgcttcagcagttcggtccgctcgaaagcacaggcggtcgcggactgttgctggatgccctggcattggcggaccacagcttggatattgtgtcggcctttggttccgaagatttggatgaagaacgactgcaccaatccggtcctcggttcctgaagaccatgttgacgtgggccgaacagcttgacgaccgtccggtgcttccgttgcgtgatgcggcaggcggcaacgtgctgttcgacgatatcgccgacaggttgcgcgcgcgaggactgaacgctgctgttgattatggattcgacaagggcgtgaagattccgctcgtggtgggattgaaggacaagccgtttgccttggccgtgcagaccgatgacgcgaactttatgtccgtgcaatccacgcgtaggcgtcatcgtttgtcggcacaggatctcatttccttgggctggaatgtgatgaccgtctggagtgtcgccgccttcgtgaaccccgataaggaagtcgaccgtatcgtcagccgtatcggtgagatctatcgcgaggttgaataaccatggcggaatactcggctacacggcgcacaccgcgcaagcacaagcgcgtggtgatgaagggcactgagcagtttgacgctgacggtgtcaaactcgagcccggagacatgcagaccgaccaacaacggcaatccgacgacgacaaacgcatcctcggcgaactgccgccgcattgggccgtttttaacgagcgcgagtaggagttggggcgcactctgtgcgccccaacactgtgttttccgcagccgacaggctgcggaaaacacagtatcggccgaaggccgattccgcttcctaccgcacaacggccataatcgctccggcctgttgcagctccataaccttggccgcggcctccggcggcattgcgaacgacaccagtcggtcgttgcctcccaatgcaccaatcgcatccggtttgccgacattcatcaccgtggcgttctcggccagcgtgcaatcagcgccttcgcaaccgacggcggaaaccagtctcacctgatcgccggccaatacatcgtcgacgctactggccaagcggacttcaatcaccgtagtgccggtcggtgctacgggcgcatctctggccatatgcgtggaaatgggatcggctgcttcgatatcgatttgcgctaccttgcccaccacatcctcaatattgcctgtccaagacgggcctgccgcagataccggcatatcagccaactgaacgtcggcggccagaataatgtcaccccgtcgaatcgagcggacggccaccaccatcggctcggtctccaccacggccaatacggcttcaagcccaaacagcactgcgagtcccacgcacaacgcagcagtgagtcggcgcaaggcatccgccatgcgccgtcgccgcaatgagccgcgcgcaggcggcttaataaacgaaaaggtcaccatgcaaccatggtgacctgaagtttttcgtaagcgcaagccaaatcgacctatgtggttctagcttgccaagttatccacaacgcttcaaacccgtgcaacagacagtgcccgtagtgccaatatccgcggcataccgccgtcgacaccgtcgtttacagaggaaaagcgggtgtacagaccttacttgccggatttgtcggtgcggtagaagccgtgacccttgaactcaatcggcacggcggaatacaccttgcgcacctgctcctgcgagcacttggggcacacggtaatcgggtcgtcattgaacgactgctgttcggtgaagtcatagccgcagttcttgcaacggtaatgataggtaggcaacggattcctccaacaaagtcatatttctcgcggatggcccaaacgccatgccacgcaaccgttcatatcctagtcgccgccctgacacattggcgttacggtcttactagccagcttgctgttgccactctggttccatcggccagtgtgcgtggctggttggtcagtctggcttgcgccgagtatcttggccggccggccagctcaacaggcccgatgagctaagccgccggtatccctccggcgtcagcactccgtcggccggcacatcatgtggttcggccggcaaatcaatgtccaacacctcccacggccagcacaccgcaatcaggggacatgcgggcttgcggcgagccaaggcccggtcataccagccggctccacgccccagacgattgccctgcgggtccactgccaaagccggagcgatgaccagatcggccttctccaacgcttcgggcggtagaactgcgccagttggctcatcgggtctgtgatggacggtgctgggagagctgcagctaccggcattgttcgcgccacccactgcatccatcgagcgcaatgattccaatgaatccagcacactccagccaatttccaacccagaccccaaccttggcaccaacacgtggcagccatgagcccgcagccatcgcaacagtggccgggtttcgatttccgaacccatcgacacatatgccgccactgtgggaccatcctgaatcatgtgtgctgggaaccgtcgcaccagcaattcaccggccgctccgcgttcttccgctggaacgcgcttgcgccgagacagtatatggtggcgcagcgtcgctttatccgtcttctctgttttctctgtgccgctgtagtcgctgccgatattcatgccactgcccacttcgctcataccgcacaatctagtgtttccatcgtaaaacgaaagtggccacggtagcggcgcaagaccttcatatggctacaataaaggccgtgtcagttttccagtcgattaaagaggcgttcaagctggaccaccagatccgcccgccacgtctcacccatcccggttttccgatagtcctgcgccccctgaccatggatgatgaggacggctggaacgaagtgcgctggcgcaacaacgactggctggcaccttgggaatccggtgacccgatgcatggcggctccatcacattcaatcaatgggtgcagcggcagcgccgtaacgagcagcatggcgtcggcgtgatcttcgccatcgaataccagatgcgtatcgtcggccagatttcgttgggagccatcgtgtatggtgccatgcgtaccggcgtggttggttattgggtcgatcaacggtgcgccggccacggattcgcgccaatggcactggccatgcttgccgattgggcgctcggagacccattcgggcccgcgttgcatcggctggaaatcgccattctgccggataatgcgcgttctttggctgtggtgcgtaaggtcggagcccatcatgagggactgcgcgagcggtatatgtatgtcaatggccagtggcgtgaccacgtaacgtttgcgctgttggctgaagatatggggcaagggttcgccgccagactcgccgccgccggttccagataagcgtcgaccggaagaattccgctccgacacgcccggacggaaagccccagttcgtcggcacgtctcctatccttgactctatgggttatgagtcactgagcactgtcgtcgtgctggtgattgtggcgattattatcgttgtatggctgcccgtacgtacggccaacggcatgaaacgtgtggacgagcaccggcaggatcgttattcgccttccctgcatatcgttgatgcagagaacggcagacgattcggagacatcaagccgcataaggcgaaaggggcagcaatgccagcatcaacaccgtcagcgaggctgacatctgagcacatcgcccatgtgcgggaactgcgccgcgcggccatccgccgccggcagattctcgccgtatgcctgcttgccataaccgtgttggtgtttgccgtatcgttccccctgcatttcagtccgctgcttgctcttattccgttcgtgctgttgctgctggtgctggtgctgggagccaatgcctcacgccaggcccggcaatgggagcgcaaggtggtccgctacgagcgggctcatagcggtacgggctggtccaagaaaccgtctgccgagtccaaggacagcaagcgtgtgaacaaggccgaaccggttgcggccgtaactgcgcctgccgagaagcctgccgagcagattgaggatgctgccaccgaggtcatggaacagcggcagattcgccgcgcgttacgcgatgccgagattgagcaggccaaggccaaggcgttgcgtcagtccgccgccgcatatcaggccgcggaagagcacgccaaacagtctgagaagtctgatattgcacagtccgccgccgataagcctgccgccgaaccgtctgctatggtcgatgaatccgctgaccgtaagtccgctgccgaaaccagtgaatcttccgccgcgcccgatgcctccgctcgcacggataagtcgactaagtcggataagtccgtcgcccctcgagttgaaccatcgcttacggtgcgtgatgagcgtgatgagcgcgacgatgccgctgccgacgctacgtcggaactggccagcgtacgccctgcccgagcactggatgtcttcgatatggccacctcgcaggatctcatctccttcactttgggcggggaacataacgccgacaacgctccggaaagcttggagatcaagtcgacccgtcaggtgtccaaggcggaacctgtcgaacccgcagtggcggaaaagttgattgacgaggcccgagccgtcaaggccgcggacgacgccaaggctgtcagtgccggaaacgctgtagacactgagtcggagcagcgcgatgatgccgatacgaacgccgctacggacgccgatgacgaggctgcaaacgccgcccagcgagccgcattccacgaatccgaggagcgtgccgacgtcgaagcgccagcggcgaccaccgattcgttgggcgcaggcctggactccattcttgcccgccgcggcaactgagcgttgcgattcgccgattttctctcacagcgttagcactcgagttggcagagtgctaataatcgcgctacgatgtgtcctagcgcaaagggacaacgcaagtgatcgtcagcctcttgaggcgttctggcgcggcattatcgaactacaagtagatacgaggtgacccacagtgtcgattaagctcacaccgttggaagacaagatcatcgtcaagcaggccgaggcccagacccagaccgcttccggtctgtatattccggacaacgccaaggagaagccgcagcagggtgaagtcctggccgttggcccgggccgtcgtgacgacaagggcgagcgcatcccgatggatgtcaaggtcggcgacaaggtgctgtactccaagtacggcggcaccgaagtccactacgagggtgaggactacctcatcgtcggcgcgcgcgacattctcgccatcctcggctgattagtcgcctagcgaacttcaacaaccccgactgttcccacggacagtcggggttttctcttgccaggcggaaaggggctcccctcagagaggggagccgaaaaccgctcccgccaaacgcccagccatgcctgctatgcataaaggtgcatgcgcgcaacgtagttgagttcggcgttgcaccgcatctacactgggtaacggattggggtccctatggaagaggctcagttggcgacttggccgagcggcttaagacattttgcacaagacggcagtagatcgacggtatgttgttttttccgtgtcgcaggttcgtggtgtcgtcgcgctgtgccaatggttgtctctctaccgacgctgagtgccgtggcatgaggccagcgtcggcagtgggccacggaatggcgatgtgctgatgctgagccgcgttggcgtcgttatagggccagtttttggaccattgccgacggcaaatcggcgttttgtgtcggcgacggtccaatacctggcggtctgccgacgataagtgccgtcatcgtcggcagaccgccaggtattgtccccgtgccgacgtaaaaagccctgccatcgtcgtcaccgagccattttgtgactcactgacggcggcagcagggcggaagaggccgaaatcatgcgcgcggtgcggtctcacacctcgaatccggcctccaccagcgcgtgatcgatgtcgcgaatcaaatcgtccgtatcctccagacccacggccagacggaagaagccgcggtggaactcaggcgggtacaggtactggcgctcgtcatcctcgccgaggaacacgatcagcgattcgtcatggccgagcgagacggccgacgtaatcacattgagcttggaaacgaaccggttgtgcccgtcatgattggtgtcgaggccgaacgacagcacgccgccgaacccggagtccgggcgggccagctggctggccgccaccttgtggtgcaggtgcgattccagaccggggtacgccacgaaacgcaccacatccagcgattcgagatgcttgacaatcgccaaggccgaggcgtcgtagggcagcgcgtaggcgttcgccagcgtgatggggcgacggatcgcgccggtttcggcgtcgaccccgttaccgaggtgaatggccagcgtgccgaatccgagcggctggtcgtcgaatgattgtccgtgatgtacaagatcagaagccatgcgcccagcatgccagcatgcgccgtgccgcgcaaacaggcgacatcgctcgaaaaccgcgccattgcaaggttctagagcaccatataagaaaaaatgattgggtgaagtgcggggtgcagccttggtcggggctgtttgcagggccgaagcgggccctgaaaacacgctgtgagacacgccgataaaaccgcagaattccgcggtaaaacaaggttcgcgtaggggccgatttgcatacctggaaaatctgtggttatatagccaagttgcctgttgaggtcaaacaccgcggcgggaaacagactggcggatttcccaagcggtcaaagggagctgactgtaaatcagccgcttcgtgcttcagtggttcgaatccactatccgccacgccccgatagctcagtggtagagcacttccttggtaaggaagaggtcgtgagtccaattctcactcggggctctctggcggggtagctcagctggctagagcgtacgactcataatcgtaaggtcaagagttcgagcctcttcctcgctacaaatcgcgcccgctaaccggtgggcgcgcactatacctaagaacacagaggtgaatgacaatggctaagagcgccgacatccgtccgggcatcacgctggcctgcaccgagtgcaaggagcgtaactacattacgactaagaaccgtcgtaacacgcccgaccgtcttgagctcaagaagttctgcccgcgctgcggcaagcagaccgtgcaccgcgagactcgttgatcgcaagtatcacagctttacaaaacccggcccattcggccgggtttttgcgtattgcctccggaggcgagtggcagggtgcggaatcagtatccgcatcgcgtgagaaacggcagaaatcccgcgtctgaacgaacccctcgcgggcgttctgtcgtttcgggccgccaaaacggcagaaatcccgcgccaccttcgttcagacgcgggcgttctgccgtttcagccgatgattgcctcgatatcgcacctgcgccactaagatagtaagccatgacaagctttgcagacatcaccaccatgggcgtgggcggccccatcgcccatttcatcgagccgaccacgcgcgtgggactcatcgaagccgtggaggaagccgattccaaaggcctgcccttggtcgtcgtcggtggcggctccaacctgcttgtttccgataagccttttgacggcgtggtggttcgagacgcccgacgcctcatcactgtgccggacgaggctgcaccggtagagggcgaggatcgcaccgtgcatgtcaatgccgaggccggtgccaattgggatgatttcgtggccttcaccgtagagctcgggctcgagggcgtcgagggactgtccggcattcccggcacagtcggcgcttccgtggtgcagaacatcggtgcctacgggcaggaagtcgccacttcggtcgaatcggtggaagtctgggatcgagacaccaaaacaacgcgcgacctcacacccgccgatcttcgattcggctatcgatactccgcactgaagaccagcatgtacgccggccccggccggccggccggccgattcttcccgacgccacgttacgtggtgctttccgtcacctttgccctgacccactcggccgaaggcacggtaggttacggacagcttgccaaagcgcttggcgtcgaagtgggcgaccgtatggccaccgccgacatccgcaaagccgtgctcgcagtacgtgccgccaagggcatgctcgaggaccctactcgctacgccttgcctgacatggccaccgccaagcgcgaggccaatatcctgaccgatctggagcgtctggcctccctcaatgaggccgccggcattcccgttggcgatgacggtctgcctgctcccgactacaatcgccacagctgcggctcgttctttatgaatccgattctgaccgccgaccaagcggcggccctgcccgaagatgcgccgaagttcgacgcgactctgcctgacggcactcccggcaccaagacgtccgccgcctggctcatcgaccatgccggctgccataagggatataaggtcgatgcggacgcgccggccagtctatccacgcagcacacgctggccttgaccaatcgtgggggagcgagcgcggccgatatcgcagctttggcgcgtgcggttcagcaggcagtcaagagcgcgttcggagtggacttggtgcccgaaccggtctgcgtcggtgtgctgtaatcgcgctattgattgatggagtgggttattaatcccatatattgcggactctgagtcttattaatagacaagacacgcgggctcttctatactcgattgtcggtattgtgcgcattcggtgcgcaaacaacagagaaaaaagaagagcactatgcaactgttccgtacaaaatccgtcgaacagaccattgccgaaaccggtgaagagggccgcaagctcaagcgcaacctgacttggtgggatctgtcaatcatgggtgtggccgtagccgtgggcgccggcatcttctcggtgggcgcgcaggccgccgccttccacgccggcccggccgtgatcatcagcttcctgatcgccggcatcgtgtgcggcgcagccgtgatgtgctacgccgaattcgcttcgatgattccggtggccggctccgcctacaccttcacctacaccacggtcggcgagatcatggcctggatcatcggctgggatctgatcctggaaatgctgatggccggctccgtgatttccaaatattggggcgtatacctcaacgatttcatgcgcctgatgggctggaacgccaacaccaacctgacgttcggctccttccacatcgatatcgccccgattatcatcgtggcgttctttaccacgctgctcgtattcggcaccaagatcggcgcccgcgtggacggtgctatgaccgtgctcaagatcgccatcgtgttctttgtggtgatcgtcggcttcttctacgtcaaggcctccaacttcaccccgttcattccgccgagccagccggcctccaccgtggaaggctcctccgccgtcaccggcgtgatgacccagccgttgtggcagttcgccaccggcatgaccccatccgtgtacggcgttcctggcatcctctcgggcgcggcgctcgtgttcttcgcgttcatcggattcgacgtggtggccaccgcctctgaggagaccaagaacccgcacaagaacgtgccgctcggcatcggcgtgggcatgctgctcatcattgtcatgtacatgctcgtggccgtggtgaccaccggcatggtctcctatgccgatctcgccaagcaagacagcccctcgctggccaccgccttcgaactggtgggcgccgactgggccgccaagatcatcagcttcggcattgtgctgggcctggccaccgtggttatggtgctgttgctcggcctgacccgtatcgtcttcgccatgagccgcgatggtctgctgccgcgcggcctgtccaagaccggcaagcatggcaccccggccgctctgcagatcgtcgtcggcgcggtggtggcgctcgtggccgccttcttcgacatcggcgtgctctccgacatggtcaacatcggcaccctgtccgccttcacgctggtggccatctccatcccgattatgcgcaagaagcgccccgacctgccgcgcgccttcaagatgcccggcagcccgtggattccgatcctcatcgccgtggccaacttctggttgatgctcaacctgtccgtgctcacctggattcgtttcgtggtgtggctcgtggtcggcttcgccatctacttcggctacggctactggcatgcgcgcctcggcaagggcgacctgaccgaaacgctgtccgccgaaaccgataaggccgttaacggctgagagcgaggagcgtcccaacaggcgcgtacccttgtatcagtatttgttaaggaggattccatgccatatgtaatcgctcagccttgcgtggatgtcaaggacaaggcttgcgtggacgagtgccccgtcgactgcatttacgagggttcccgctcgctgtacatcaaccccaacgagtgcgtcgactgcggtgcatgcgaaccggtgtgccccaccgaggccatcttctatgaggatgatctgccggacgagtgggcttggtacaaggatgccgctgtcaacttcttcgctgaagtcggcgatttgggcggcgcttccgccaatggtccaatcggcaaagacccggaacaggtcgccgcgctgccgccgcagaaccagtaagctgattcgcggataagcgctgcacacagcgcatagttcggattgaaccctcggtctatcacggccgagggttcgtcgtatcttaggaacataccgtccaagaaaggggttctcatgggcttccacgcatattcgtcgccatacgactggtctcgtatcgccggcttcaaagccaccgccaaaaccgtgccgggtggcatgatcgacctgtccgtaggctcgcctgtggacccggtgccgagcagtgtccagcaggcgctggttgccggcgcagacgcccccaacgcccatggatacccggtcaccgccggcaccgccgaccttaaggccgctatcgatacatggttccgcgaactgcgcggggtggatctgaaatccatcaacgctgccgccgtacccaccgtgggttccaaggaggccgtggcgctgatggccagcctgctgcaccttggcgaaggcgatgtggtcgtccaaccggctgtctcctacccgacttacgaaatcggtacccaacttgccggcgccaccgtggtcaaagtcgatgatgtgaccgacgtcgattcctgggtgaatattccgaacgtcaaggccatctggatcaactcgccgtgtaatccctccggcgaggtcatctccgccgactggctgaccgacatcgtggctgctgcccgtcgcatcggtgccgtggtgctctccgacgaatgctatgcgttaatggactggcgttcggtgcgccgcaatacagccgcgtcctctgcgcctgccgcgtctgcatctgctgcgtctgtgcctgccgcaccggtggccgaatccaacgagcccgcctccgataccgcattcagtctctccgccacgccatgtgccctgaatccacatgtgtgtgaaggttcggcagctggcatcctggtgctctactcgctgtccaagcagtccaacatggccggctaccgtacggctctaattgccggcgattaccggctggtcaaggaaatggccgaataccgcaagcagatcggccagattatccctggcccagtgcaggccgccatggccgcaggcctgaaggacacagccgctgtgcacgagcaatggaggcgttaccgtcgccgcctatccgcgctggttgacgcactgaaggcatatggctattcggcacaaatgccctccggcgcgctgtacgtatgggtcaaggccaagtccggcgactgctgggccgatatggccgagcttgccaaaatcggcatcatccccagccccggcgaattctacggcgctcccgcctacctgcgtttctccgccaccgccaccgacgaggccatccgttccgcctgcgaacgtctcacggcgtaatgagatcgtaagtggcgttgagccgttcacgccccaaactgggcggccttgttgccgaatttgcggcgcacagcgtccagtgcggcctcggcatcatgcaaacgcgcctgtgaggtctggccgcgggcattgtcggcctcttcgagcatgtcatccagtgaaggctgcacggccgtagccgccgccttactgagcgaagacgtgctcataccggccaagcgaatagttttgggcaggggagtggcagactccgccgaggccggtagccccagcatgactttcagctgccgcacgcattccgggtacagcacgccggccgtatcggtcggccgctccatcgtaaaagaccgggtctgatagctcaggtcggcgaaccgcaacttcaccgtcagcgtgcgcgccaccagccccttgcgccgcagcgtgctggctacttcgtcgcaggccgaacgcagtagcccacacaccacgcgcatatcgcgtgtatcctcggccagggtttcctcggacccaatggatttctcctcgcgcaccgtggtaatttcgcgggaatccaacccgtgcgaggccgcccataatccacgtgccgcagctggggagccagtggcacgagtcaatgcagcctcatccagctgagccaattcagccaccgaatgcacgccccaagcgttaagccgcttctccaaagacggcccgatgcccggaatgccacgcaatggcatcatctgcacgaattcggccgatcgggccgcgggaatcagcagcatgccgtccggcttggcattggtcgaggccattttggacaccagtttgttacaggcgatacccactgaacacgtcacgtggaagcgctcggccacctgagcgcgaatccacgcgccgatcgcgctcggccgcccccactccagcagtgcggcggacacatccatatagccctcgtccaccgaaacctgctcgaaccggtcggtgacggtcaaaaacacctcatgcatgattcggtgcgacatcatgcggtaatacgccatatccactggcagaaaaatgccgttcgggcacaaccgatgggcgcgcgcggccggcatcgccgaattgatgccgtatttccgggcttcgtagctcgcggcggacaccaccgcgcgcggcccggtgccgatgattaccggcttgcctttgagcccggggttgcgcgccacctccaatgaggcatagaaggcatccatgtcgatatgcagcacggtgcatccggtctcgtcgtggccccaatcgcgtttggcggcctcaagtctcggtgcggtgctcatgccaccattgtaggaatgccgaacgaggtcatgctcactatgtggcgcgcatgacgcggcgctcattgtcataatgccgaatatcgccggaattccaagggtttacgcactgtgcggctgtttcgcatggtgggtgcgattccacggaatcgtccacattgcgtcactgtccgtaacgccttccaagtcaatgcgcgctgtcccggctctccgagtagcgtaaacctcatgaagaaggcagtggtcggtatcctcaaccgtgttcccgtggttcttatcgtgattggtgaggcactggtgatttatttggctacggccgtcgccaaacttgcgttcacccagctcgatccgctgtactcggtgtggtatcgcgtgggattcatggcggtgctgttgctgctgtggcgcaggccctggaacaaggcgaagcgagcgcaactgtttcaccgcgacgcccgcagctgggggctggtcgtactgctcggctgctcgctggtgctgatgaataccctgttttatgtggccatcagcaatatggatatgggcattgccgtgtctatcgaatttttgggaccgctttcggtggcggtgattaccggcaaaagctggcgcgagcgggtcggtatcggtatcgcggcggtcggtgtggtgctgttagctggcatatcattggccaatccgtccggcaatggcgcgtttttgtatggtctgattgcgattttgatcggcgggtcgatgtggggcatgtatatcatcaccggccggcgcgtggcggctggcggcaattcgctggataatctgtgcatcgccgtgaccatcggctggctggtccagtccctgttccttggcgtgccggctgtggctcatgtggttcaccccaaggccgatgccacgtgggcgcttgagcccggcggctcgctgaagctgctggctctgctgtttgtgatttccctgatggcctcgttcattccctatgtggtggagcagatcacgctgcgacgcaccacatccggcgcattttcggtaatgcaatccatcaatcccgccatggcggtggccgtgggactggcgttcggcgagattcccagcgttggtgaaatcgtcggtgtggcgttggtgatttgtgcggttatcgttacgttctccggcgacgccgcacccgcggacgttcaataatgtgtcgttcggcacgccgtatccgcaggacgtggtacagtaatttgctgttgcgcattattgcgtaacgtggagtcatgcctgagtggccgataggggcaccctgctaaggtgttagtcgtgtaaacggctcgagggttcgaatccctctgactccgccgattaaggttccgggtgaaagctcggaacttttttgttttccggaaactccgggttaagtaactcctgaaataaccgaggacgggcggtctccgcttgtggtaagcggagtcggaggtacgccattgtccgtccgcctccaaaccgccattttagtgggcgaacgagtgcggcacgtcgggaaaagtccgagcgacgaaagaaaaatgtccactaagtgagacttttgcgtggtgttcgtgaatggtgattgaagattaaccggtttatatattgcttgtccaatcgcttgctcatcgcctccctccccgcagtacttgaccgagatgggcggtaccctagagagagaagaagagttccgaagggcgggcaaagatgagccatatcgctgggcaggggcaacatcgctccaactcgacacgaaccaaccgtgcggcgctgattatcgtgttcgtgatcgtgctcgccgttgcgctgggcatcggcgcatggttcgcaacccatcgcacggacggcaatggccccgcacacgccggagtgtcggacgtcgcgttgaataaagcgaagaacacgcccaaaccggtgaccgaacatcacggcaattcaccggattgcccggatacggactgcatcgccatgctggtcaacggcgatttgttgttccatgagggattgtggagccatttccaaggcccgaaccccaacgccacggatggcaccgccttcaacttcgacccgctgttcgcgccgatgaagcagtacattcaggcttcggacatcgccgtgtgcgaattcgaaaccccgatcgcccagcgcggcggcccatatgccgcgtacccgatcttcaacattccgccggaagtggcggatgccgcccgcaacgtgggatacaacgcctgcacacacgccaccaaccattcctgggatcagggggcggatggcatcgcccgtctgtgggacacgcttgaggccaatggcatcgcccagaccggctcgtacaaaaccgaagccgactccaccaaaccgttggtcatcgattccccgaccggcggcggcaagctgggtctggtcaccggcacggtctccctcaacggcatgaccgccgacgaggactggcaggtggatcgtctgcgcgaagacggcgacccgaatcacgacagcgacatccagcgcgcggtagacaaggccaacaaggcccgcgagcaaggtgccgatgtggtggccatcgccatgcactcggtgcaggaataccttgattacgccgattcctggcagatttcggaagcccatgagcttgccgacactggtgccttcgacgttatttacggtgccggttgccattgtgcgcagcccatcgagaactataacggcacgtggattatctacggtctgggcaacgccgtcaccgagtcggcgaacacgccggaaaccttggtcaacaatcagggtgtgaccgcacgcatccagttcgccggcaagaagggcgtcaaggggtcgtggcgcgtcaaccgcatcgattgggtgcccaccgccaacgtgcatcaaggcaactaccaatggtgcccgatatccagcgaccatcccataggcacatgttgggacgaagcctacgacactcagatacgccaacgcatctgggatgtcatctattcgatgggcgcggaccagaacgtcgtcaaggaatggaacatcacgcaggagcaggcggcaaagcaatagttgctcggcttggtctcaaggaggggaagccgcaaggtgacgcttttcccgccggcctcctaatgtggagcccatgaccgagatttacgaaacccaaagcgaacgcaccgatctgcccctcgtcgtgatgccgtccgtgcttgactcgatgatcgagcccatcaaggcccagttccccgcgctccacgacgttgcccgcgtgcgtatgttcgaggaattcacgtccgacgaggcgaccatagccgagcgtctgaaggatgccgacgccctgctggtgggcggctaccacatttcggacgatctgctgcgcaccatcagcgggcaggggcacgtcaagtgcatcgtgttctgcggtaccggcgtcgccagctacctcaatctcgataaggcgcgcgagctgaagatccgcgtctgcaacgccgaacattatggcgatcacgccgtggccgagcacaccttcgcccttctgttcgagctcatccgccgcgttggccaactcgataaggacgtcaaggccggcaactgggcgtgggccagcggcgatggactgcaactcgccggccgtcgcatgggcatcatcggactgggcggcatcggctccaccgtggccggcatcgcccgcgccctcggcatggaggtcgccgcatggaattcgcatgtgccgcccgagcatttcgaacgctccggtgccactccggtcgacgatctcaacaagctcatcgaaaccagcgacgtcatctccgtccatctgccgctgaacaacgccacgcgcggcatcgtcaccgccgagaaccttgcgcatgtgaagcccggcaccctgttcatcaacaccgcccgctccgaagtcatcgaatccggtgcgctgcttgcccgactgcaaaagggcgatgttcccgccgcactcgacgtgttcgaccatgagccgctgaccgccgacgacgccatctgccatgtgcccggcatcgtcctgaccccgcacgtcggctggcgtgccgacggcgcgttcaaggagctcacccgccagatgatcgcctgcctgaccgcctacttcgccggcgaagactataacgtcgtcgtctccgaacgctgatagccctgcctagcctcgcgctcaatcgaacacccagccagtcgaccaccggaacacgctcatgcagacgattctcaacacgcccgacgatcctgcccacgattcgctcgtcgaaaaaaagtccgaatttatcggcgacgccgcccatgtcgatacgctcgacgaggcgctcgcgttcgtggctgcgatccgtgagcagcatccgaaagcccgacacgtggcgtatgccgccgtgtgcggaggcgcggatgggcgactgtccgaacgcatgagcgatgacggcgagccgtccggtaccgccggcaagccgattctcgacgtactcaagcagtcgggcaccaccgattgcgtggttgccgtcaccagatatttcggtggtattctgctgggctccggtgggctggtccgcgcgtactcatccgccgcatcattggcgatgaaagccgcccgcgccgcccgcatcatgaccgccaagcgataccgggttcgcctcgaatacccgcagttggcccgattccagcagatcctggcgcagcttggtggcagtcaggaggatgaatcgtatgcggtgaacgtcgagttgaccgcggtggtgccgcaggatgattgcgcgcgattcgaggagcgtgtgcgggaagcgttcaatgccgctgtggtgccggctccgattgacatggtcaacattccggttccgctcgcgtgacgcctgtatgactaagctgggcatcatgaccgacgagaacaccaccagccagcagacccagcccaccgaggccgcaaccgaggccgcggccgagactgcaaccgacacggacgcccagcagcaggaccaaggcgcgcagtccgcagccgagtccgccgctccggtggatttcgaaccgctgaccgctacatacgagcgtctgcgccattccaccgacccggccgaactgtccgaattcgcccgtcggccgttgcctgaccgtgccgatcaggcggcgttctcccgcgccaccgcacttttggaggctgtggccggcaacccgcacaccccggtggccgatcgtgtgttcctcgccgacaccatgccgttcccgaacgtattggtcaaactctccgaagaccccgaaccgtccgtgcgtcaagccgtggccgccaacggggacgacaagaattggctggtcggccgtctgaccaaggacccggtgcctgcggtccgggatacggcgttgaaaaacaagcgcaccagctggaagatgcggcttgagggtgcgcaggaccccactgcggatgcggagacattggatttcttgggcgtacttggcaccgaatccgaagagggagcaccggcggtgctttcttcgatggtccgccgtgccgtggcactgaaccccaatacgtccgaagcgatgcttgccaaattggccaacgacccctcggccgaggtgcggcacgccgtggaaagccgccgctaagcacactattgctgtgttttgccgcgcaaatttggccggcaatcaccccccctgtccgccattgtgagcgctcacatctcactatgtgagggtaaaaagtacataatttggcggaatcatggcatttttcttacggtgtggcgcaatcaaacggcgttagactggggctatgagtgagattaccgagagtgaagagcgtctggcccgtccgttgattcgactggccaagttggtcggtgtcggcacgagttatttgggcatgagccatgactaccacgagatagacgatgacgtcctgatcgaggtgctggcagcgctgggcatcgacgcctccagcgagagcgcccaactcatcgccatccgacgcattctgaacgagcgttacgcccgattggtggcacccaccgtgctgcatatcgccggtagcgaggaccgggtgctggtgaacaccggtattctggacgtgccttcggcgagcatcacgctggagaatggcgagccatatcaaggcaccattgaagttggtcctggagatggatcccaggcctacgacttggatggtacgttcatttcgaatgcggctgtggtcattcccgccgatctgccgattggttaccatacgctgcacgtcaaggtcgccgaccgtgtgcaagacgccactttgatcagtgcacctgatcgcgtcgatctgcttgacccgatgaagggcggcagtctgtggggctggatggcccagctgtactcgattcgctcctccaactcctggggcgtgggcgattacgaggatctgaagaccatgctggtggacgccaagcagaagaccggtgccgacttcgtgctcattaatccggtgcatgccgccgagccggtgtccccgctcaccccgtcgccgtatctgccggtaagccgtcgcctgatcaacttcacgtacatccgtcctgaggcgatcgccgaatatgccacgctcagcgagggcgacaagaatgccgtcgacggactgcatgccgacaccgaaccgctgaacggtgattcccagctcatcgaccgtgacgccatgtggcgcagcaagatgcacgccctgtggattatctttaaggccggccgtaccgccgaacgccaaagcgtattcgaccaattcaaggcggactgtggttccgacttggaggcgtatgccacgtggtgcctgtgctacgacaagtggggagcacccaacggcgaggagagcaactgggagcgcaagttcaatcgcaactccccggaaatcgccaatctgcgcaagcagtacccggacactttggacttctaccgctggctggaatggattgccgccgagcagctgtcctccgcccaacaggcagccaaggacgccggcatgcatatcggcatcatgtccgatatggccgtcggcgtgcacccctccggcgctgacgtgtggtggaatcccgagcgcttcgccaagggagccacggtcggcgcaccgccggacatgttcaaccagcaaggccagaactggagccagccgccgctgagcccgatcaatctggagaccaccggctacgaggcctaccgcaatatggtgcatggcatgttcgcccgtgccggtgcggtgcgcatcgatcacatccttggtctgttccgcctgtggtggattcccgagaaccgttcggctatggatggcgcttacgtgtactacgactcagacatcatgctgggcgttctggccatcgaggcctctcgcgccggcggcgtggtcgtaggtgaggacctcggcgtggtgccggaccatgtggccgattccctgtcgagccacggtattctcggttgcgccgttgaatggttcgagcagtgcgacggcgtgttccgcgccccctcccagtggcgtccgtatgcattggcctccgtgaatacgcatgatttgccgccggccgccggttacctggaatacgagcacgtcaagattcgtgagcgtctgggcttgctgaccggcccggccgaggaattcgaagcctccgccaaggccgagcaggatgcgatgctggccatgctggtcgagcagggttatcttgatgccgactttgccgaacatcgtgaggatcacgaggcggatatcgtcgacgcgctgtaccacgcactgaagggttcgccgtgcaagctgctcgccgcctcgatcaccgacgcggtgggggagaagcgtgcgcagaaccagccgggcaccaacaacgaatacccgaactggcgcatcccactggccgacgccaagggcaacgtggtaccgctcgaaaccctcttcgactcccccggtgcccaacgcttcgcccaaatcttcaattcctgacccgctttacctccctctgacgagccgagtcgttaagcggacagtccagtggactgtccgtagacgaggcctgaaagaagcgatagctgagagaaggcagggaattgcctcaccgtaggtgagtcggttagccgaagtgggtgggagagaaaccataaataggggaagagaagccataaacccaatggagtgtccccagttgccctatgtcaagcccggcgatatactagtggattgttgtgtttccctaaggggtccttcaaagcgctatcccactcgccatcgaggactttcagggagcccacggataatgaggttcgacgcctcttggatgcggccctgaccaagccacaccaagcagctgagacccggaacacaatatagaaaaggtaatccagtgaaaactttcactccgaagccagctgatctgactcatgactggtacgtcatcgacgccaccgacgtggtgctcggccgtctcgccacccaggctgcaatcctgctgcgcggcaagaacaagccgacctacgctccgcacgccgattccggcaaccacgtgatcatcatcaatgccgacaagattgctctgactggcaacaagatgggcaaggaactctactcgcactccggccgtcctggtggtctgcgtcgtgactcctacgccgagctgctcgagaagaaccccgagcgcatcatcaagaacgctgtcaagggcatgctgccgaagaatcgtctggccaaggtgcagctcgaccgcctgcgtatcttccgtggcgccgagcacccgcacaccccgcagaagccccaggtcttcgagatcgcccaggtctcgcagcaggccaagtgaaacctgagaggagataagaatcatggctgaaaacaccaacgactcccaggttgtcgagaccgaagaggagctcaccaactacaccaccgagaccaacgctggcgctggcaccggcacctccgcgattgagccgggctacggcaccggtcgccgcaaggaggctgtcgcccgtgtccgtctggttccgggtgacggcaagtggaccatcaacggccgcactctggaggagtacttcccctccaagctgctgcagcgtgaggtcaactccccgatcgttctgctcaagctcgaaggcaagttcgacgctatcgtcctcgttgacggcggcggcaccaccggccaggccggcgccatccgcctcggcgttgcccgcgctctgaacgccatcgatcgtgatgccaaccgcgccgccctgaagaaggctggcttcctgacccgcgacgctcgcgtcgtggagcgcaagaaggctggtctgcacaaggcacgtcgcgccccgcagttctccaagcgttaatttcgcttgtcctgtaccgagcatacaaaggctctccgcggaattccgcggagagcctttgtgtttgtgtcgcgctgtcttgagtgtgactcacacctgcttcatcagcgtgatgctcagcgccggcatggtccagacattgtcgtcgacgggagtgtccggtgtatcatccacaggggcatcgggcatatcagctgatacctcatcccgaggcgcggacgaggtgccgtttgcggcgtgatctgttactggcatcgcgaatttgatggtatccgcttcattctcagtcgaggattccgtacgctgcatggccacttcttcgaccatcttgagtactgtctcgctggcgtccggtacatgctgcgtccagacggtggtgtcaccgttcaaatcgcattcctcgacctgagtgccatgcccggctcggcggccgttgatttcggctgagcaccatttaggcgtccagtgggtgtctggcggcaggcggaatgtgcggtcgtcagcggtgccgttgaccacaatgcacacgtccacctcactgttggacagcaatcgcatggtgaagctacgtacgcccagatcgaaccagtcacgctccatcggcgtggtaccgtcgggcaggaaccactgcacgcggcttgagggcttgagtaggccgatctgggtcagtcgggtgaagaaatcctcgtggtgatacaggtccagtgatttacgcagcgccaccagtcgagacacggtttccaagcggcgcatttcgcgcgtcttgttggtggaatacatccaatcccacttcagccacgtgatgtcgttgtcttggcagtaggcgttgttgttgccgtcctgcgtgttgcggaattcgtcgccggcgagcatcatcggcgtacccagcgagagcagcagcatgccgatcatgttcatggccgcctgttcgcgtgccgcaatgacgtctggatcatcggtgacgccttcgacgccgaaattggcggaatggttcaccgacgagccatcattattgttttcgccgttggcttcattgtgcttggagcggtatctggtgaggtccgtcagcgtgaaaccgtcgtggcaggacacgaaattgatggaggccggagcgccacgccctggttcggtggcgaacagatcggccgagccgcagagtcgcgtggacatctcctgcaaactgatacgcccgaaatcggagccgccgtccacatcctcaagccagaaggtgcgggccgtatcgcggaagcggtcattccattcggcgaacggcacggagaattggccggtgcgccagccgaggttgcccagatcccacggctccataatgagcttcaggttgcccagcagcagatcggaacgcagggcgtagaggaacgggtgatgatgggtgaattcgccttccaggcgggccagcgtgacgccaaggtcgaagcggaaaccgtctatgccgatacgcttggcccagtatcgtaatgagtcgatggcaaaggtgaccacatgcgtgttggtgaagtccagcgtattgccgcaaccggtggtgtcttcgagtcggccggtattggatttttgatggcgatagtaggccaggtcgtcgaggccgcgccagcagaccgtcgggccttcgacgccgccttcgcatgtgtggttgtagaccacgtccatgatgacttcgaagccggcctcgtgcagtgcgcgcaccatgtctatgacttcttggcgcacggcggccgcgcccttctcctgggcggctttagtggcgtaggagggttcgggggcgaagtagctgagggtggagtagccccagtagttcttgcggccgtgttcttgcaggaagagctcgtcctgcttggccataatcggcagcagttcgatggatgtgatgcctagaccctgcagataggcgagcgtggtggggtgtgcgagtccggcgtacgtgccgcgcaatgattcgggcagccacggtgcgttggcggtgaagcctttgacgtgcatctcatagatgacggttttgcgccacggcacatgcgggtgctgcgggtcgccctcatgcttatgggtatcgcgatcgtcgatggccacggacaccggcatatggccgagcgagtctacagtgctcatggcaccgtatgccgagccgattaccttgcggtccacgacatcgcattcataggagaaggcggcgggggtgagctccatggagccgtcgatgcccttgccatacgggtcaagcaggaatttgtatggattgaagcgcacgccgtgtttcgggtcccatgcgccgtccacgcggtagccataacgcatgccgtcccatgctttgggcaggtgcacgtaccacaggccgtagttcggcccggtcatgcggaacaaggtctcgcgcagatacaaatgttcgataatgcgtgtgcataccgggaactcatgaatctgctggataaaggagatattcgggtcctcgaacaggcggatggcgtcttggaagaaagcgctgggctcatcaatgggctccagtacgcatagccaaacctgatcggcagtttcggaacgaacaacgacgtcagccccaccgtcgtcagtgaagtacagccctgggcgagtggcgtaacgatgcaacggtgggtttttcatacctccattgtagacgtgttgtcacttttggtggaagcccttgatttcctgccgcgttccgcagcaccgcagatgccgtcgagataattctcggcgaaccgcaacgcggcaccgatgatgttctgatcttcggcgcagtagctcttgcgcagattgaaatggtcggtgccgaacgggctgcgtgcgatgacgcgcgtcttcagatcctcgatgtcgctgtcttcaagatgctgggctgcttcaccgccgacaatcacgtcgcccgcgatgatggatcgcgcgttgacgatggcctgcgccacgtaatccagccactcatccatgcgctcgcgatgatgccgttcgccctgctcaagcacgctgaagaagccgggaatgctttcgtaatcctcgggcaaggtctccggcgagcagtaggtgtccatgcaaccgcgctggccgcagtagcattcgcggccgcccggcaccagcgtcatgtgttcgatggcgccgttgcactggttcgggccttgatacagtttgccccccgcgatcaccgcgccgcccgggcgtcgctccagatagacgcacaccgcatcggtgagcgtggagtcgaaccagagttcggccatggctgaggcatcggaatcgtggatcatcatgcacgggtaatggaccgattggctgatggtttcgagcgtgagcccagtgttgcccataatggtgccgaagatgatggtggtggcgtcgggggagaggatgccttggatggcgaacgagacgccgagcaccttgccgtgcttcttttcgacgtcggcggcgaagttgttgatgatgccgccgatacgctggtagtaaacgttggtgttgcggtaaggcagggcatcgttgcgtttttcgatgacgttgccgtacaggttaatcgcgcacaggcgcagttcgttggaccgcatcactaccccgatggcagtgcgatgatcgggattgaactcataattttgcgccttgcgcccgccggtggaatcctgcagttcgcctttgcggatgagtccgtcatcttctagtgcgcgcagattttgggtgatggtgggcaggctgaggccgagttcgcgttccagttcctgcttggtgacatggctatggccatacagatactgggtcatggcactgcggttgtgcgctttcactgcggtcgatggcattgccctcatgtttacccctttgtgcgatgagatatatgcaagtttactttatgaaagtggctttcatgtgcctcgacgcggaggttatgaggcaacaatcgtatatttgtaggcgattttgggtacttttttaaaccaactttctagaaatgtggagaaaatgattgcttttgaaaacttactttaaaaaagttctcggattgtgttgtttgcaggcatgtgattttcggtaaaaagtgaacaaaaagtaccaaatcgccggatagagtgaggatttgttcgatatttcgcacaactcgtaacaaaaactgttcaatatcgcacgtgaaacgccgtcgattttgtgcgtatgcatcgcgccggaccgttcagtatattgtgcctcaggtcacatatgcaatgtgacaacgcatcaccggtcattttcggttactgaggcggtatcccgctggtgcaactgaggtgacgaggcgatggcccagaactttgccatataccccaagaagatcgaggaggaccccaagtggcagaagcaaagaagaaggtcgaagctaccaagccgactccagaagagaagcaggccgcagctgaggccgaagttgacgcgctggttgcccgcgccaagaaggctctcgtcgaattcgagaacctcgaccagaagcaagttgatcgtatcgtcgccaaggcctccatcgccgctctgaacaagcacctcgttctcgccaagatggctgtcgacgagaccggccgtggtctcgtggaagacaaggctaccaagaacatcttcgcctgtgagcacgtcaccaactacttggccggccagaagaccgtcggcatcatccgtgaagacgacgtgatgggcatcgatgaggtcgccgagcccgtcggcgtggtcgccggtgtcaccccggttaccaacccgacctccaccgccatcttcaagtccctcatcgccctgaagacacgctgcccgatcgtcttcggcttccaccccggcgcgcagaagtgctccgtcgaggccgccaagattgtgcgcgacgccgccatcgaggccggtgctcccgagaactgtatccagtggatcgagcacccgtccatccaggccaccggcgcgctgatgcagcacccgggcgtggccacgattctcgccaccggtggtccgggcatggtcaaggccgcttactcctccggcaagcccgccctcggcgtgggtgccggcaacgccccggcttatgttgattccgatgtggacatcgtgcgtgctgccaacgatctggtgctctccaagcacttcgattacggcatgatctgcgccaccgagcaggccatcatcgcccacaaggacgtctacgaccagctcatcaaggagctcaaggtccgtaaggcctacttcgtcaacgccgaagagaaggccaagctggaacagtacatgttcggctgcactgccggttccggcgtcaagcccgtgctgaactccgcggtgccaggcaagtccccgcagttcatcgccaaggctgctggcttcgagattccgtccgacgccaccattctggccgccgagtgcaaggaagtctccgacgacgagcctctgacccacgagaagctcgctccggtgcaggccgtgctcaaggccgacaacaaggagcaggccttcgagatgtgcgagaagatgctcaagctgggtgccggccacaccgccgccatccacaccaacaaccaggagctcgtgcgtgagtacggcgtccgtatgcacgcctgccgcatcatctggaaccagccttcctcccttggcggcatcggcgacatctacaacgccatcgccccgtcgctgaccctgggctgcggctcctacggcggcaactcggtgtccggcaacgtgcaggccgtgaatctcgttaacatcaagcgcattgctcggaggaacaacaacatgcagtggttcaagatcccggccaagacctacttcgagccgaacgccatcaagtacctgcgcgacatgtacggcatcgagaaggccgtcatcgtgtgcgataaggtcatggagcagctcggcattgttgacaagatcatcgaccagctgcgcgcccgctccaaccgtgtgaccttccgcatcatcgactacgtcgagccggagccctccgtcgagaccgtcgaaaagggcgctgagatgatgcgcgaggagttcgagccggacacgatcatcgcggttggcggcggctccccgatggatgcctccaagattatgtggctgctctacgagcacccggaaatcgccttctccgacgtgcgcgagaagttcttcgatatccgtaagcgcgccttcaagatcccgccgctgggcaagaaggccaagctggtgtgcatcccgacctcctccggcaccggttccgaggtcaccccgttcgccgtgatcaccgatcacaagaccggctacaagtacccgatcaccgactacgcgctgaccccgtccgtggccatcgtggacccggtgctggctcgcacccagccgcgcaagctggcctccgacgccggcttcgacgccctgacccactcgatggaagcctacgtgtccgtgtacgcgaacgacttcaccgacggcatggccctgcacgcggccaagctcatctgggacaacctggctgagtccgtcaatggcgagcccggcctggccaagaccaacgctcaggagaagatgcacaacgccgccaccatggccggcatggcattcggctccgcgttcctcggcatgtgccacggcatggcccacaccatcggtgccctgtgccacatcgcccacggccgtaccaactccatcctgctgccgtacgtgattcgctacaacggccagattcctgaggagcccacctcttggccgaagtacaacaagtacatcgccccggagcgctaccaggacatcgcccgcaacctcggcatcgacaccggcaagaccccggccgaagccgtggagaacctggcgaaggccgtcgaggactaccgtgacaacaagctcggcatgaacaagagcttccaggattgcggtgtggacgaggactacttctggtccgtgctcgatcagatcggcatgcgcgcctacgaggaccagtgcaccccggccaacccgcgcatcccgctgatcaacgacatgaaggacatcgccgtcggtgcttactacggtgtctcccaggcggaaggccacaagctgcgcatcgagcgcgagggtgaggccgccactgaggaagcttccgagcgttgattgcaggcggtttgtggttggtggcactatcagtagccaccaaccgcggtgttgcagcttagtggctgcatagcgcgacacaaggagcccgaccccattacaggggccgggctcctttgcatatgtggtgctccctcagccagagcaggtacctccatggggtggtaacccactcatggggtggtaacttgcccatggggcggtgaaaaccccatggggcggtgtacgaaaacggctctattctgcggaaggtaaaattttaccgtccgccccatgggccaattaccgccccatgagggaattacctccccatggaatcgctgaagcgtcgctaaatcgccgcaatgatgcagccaaaagcaataaagctggcaaacgcctcggtaatgccggtcaccacgggcttcaaggttgtgcgccgtgtaaccaccggcaacgcaacggcgcgggccaacagcagcacagtcatcgcaatcagatacgggctgcgtccagccggcacggcggctagcagcaatagcgccacatgccatacccacgaagccgccacgtacgaacgcttcccgcgttcccggatcatggttttgaccaccaaaaccgacccatactgcgtcagcgcaaacagcacggtggcaatcagcccgctcacgggcaatgaacccgcgggccaccaggcgtgaaggtcgaatatctggctcaaatctggcatattccgaatcgcggcgcgtgcggcggtgacatcagcggctgcgcacgaggcatgtgctgcgttgatgggcataacacatgccgtctcaacagtgctgccaaacgacgcgatcaccgtggccatggccgacgcggcaatcaccgacacggcattgccccacagcgagcgctccttcctcagccacgaggacagcatcgacagcgcaaccagcactatatataagggagcccaacgcagtatgccggtatgcgtaatcaggaatggcaagccgatgacgatgagcgctacggcataagtgagcatcggcggcagataacggcgtgaaaagtgtgctttgaaccagtgcgcggcgctgaactgcacgcaatagcacacggcccacgtcgccaatagccaaagcgtatcaagattaggcccgccgataaagaagccagccacagcgggcagcataaccattacccatgcgccaggttggttgtcgaaccaatcgcgtttaagagtcttgcggcgggaagtcatatctgtcatgatatcgcagcgaatggttctcaataagaaagatgtgagacctgcattgcgacaatcgaacagacgccgagcggctatgccgcgaggtaatacgaacggcatgagcgcgacacgcgcgaactccactgtcccacctcaatgcttgaataaacaagttgcctgatttgggctcgcaaattggaattaaaaaagcgagcgcgggccgggagtcacttcaagtgaagtgacagccggaaaccgcgcactgatgtcggatgaccgccagaggacgtatgtccaagggaggccatgcgcgccggtgccctagaagcaggttggtaaacagtacaacgaacatcgctagaaagggcggacggcaatggcgggacagaaaatccgcatcaggcttaagtcctatgaccacgaggtcatcgaccaatcggcgaagaagatcgtcgaaacggtgacgaacgcgggcgcaactgttgttggccccgttccgctgccgaccgagaagaacgtcttctgtgttatccgttctcctcacaagtacaaggattctcgcgagcacttcgagatgcgcactcacaagcgcctcatcgacatcgtggacccgacccccaaggccgtggactccctgatgcacatcgatctgcctgcggacgtcaacatcgaaatcaagctgtaagggaggaggaagcattatgtctaatcgcaaggctctgctgggcaagaagctcggcatgtcccaggtgtgggacgagaacggcttcttcgtgcccgtcactcttgtcgacgtgtccaccaacgtggtgaccgctgtgaagaccgaggaatctgacggctacaaggctgtccagctcggctacggcgccatcgatcccaccaaggtgaccaagccgctggctggccactttgctaaggccggtgtcaccccgcgtcgccacctcgtcgaggtgcgcaccgacgacgtcgatcagttcgaggccggccaggaactggccgctgacctgttcgaagagggtgctgaggtcgacgtgaccggcaccaccaagggtaagggcttcgccggtaccatcaagcgttggggcttcaagtcctaccgccgtactcacggttctcacaagaacgagcgccgtcccggttctgtgggcgcatgcgccactccgagccgtattctcaagggcaagcgtatggccggccgcatgggtcatgtgaccgccactacccagaacctgaccgtcgtctccgctgatgtcgagaacggcatcctcgccatcaagggcgccattcctggccccaagggcggcatcgttctcgtccgctcggctgtgaagggagcctgataaaccatggcaaacgttactctgaacgtcaccgacgccaagggccaggccaccggcaccgttgaagctcctgaggctctcttcggcgtttccgccgaggatgtccaggctcacatcccgctgatccaccaggttgtcaccgctcagctcgctgctgctcgtcagggcacccacgccaccaagactcgtggcatggtttccggcggcggcaagaagccgtggaagcagaagggcaccggtcgtgctcgtcagggctccatccgtgcaccgcagtggtaccacggcggcaccgtgttcggcccgcagccgcgtgactactctcagcgcacccccaagaagatgaaggccgcagctctgcgctacgccctgtccgatcgcgccaacgccggtcgcgttgccgtggtggagttcggtatcaccgagccgtccaccaaggccgctgtcgccgctctggccccgatcaccgcggacaagttcaccacggtcgtcttcactcgcgacaacatcaacgagtggctctccgtgcgcaacatcccgaccgttcacccgattttcgtcgatcagctcaacacgtacgacgtgattacctcgcagtacgtggtcttcaccaaggaagccttcgaggctttcgtggctgccaagaccgagccgaaggaggcctgatttagatggtcgctattcacaagcccgctcacgacgtgattcttaagcccgtcgtctccgagaagagctacgccgcttccgaccgtggccagtacaccttcgtggtggctccggatgcgaacaaggtgcagatcaagcaggcaatcgaagagatcttcaaggtcaaggtgacgaacgtcaacaccctcaaccgcgctggcaagaagcagcgcactcgcaccggtttcggccagcgcgcttcccagaagcgtgcgatcgtgaccgtcgccgagggccagacgatcgacatctttggtaactgaaggttagccgagaaaagttaaaggaagaactacattatggctatccgcgtttataagccgacgaccgcaggccgccgcaacgcgtccgtctcggatttctccgagctgactcgttctacgcctgagaagtcgctggttcgcaagaagtccaagaccggcggtcgtaactcttacggccgtatcacctcccgtcatcgcggcggcggccacaagcgtcagtaccgtctcatcgatttcaagcgttgggacaaggacggcgtgcccgccaaggttgccgagatcgagtacgatccgaaccgctccgcccgtatcgccctcctgcacttcgcagatggcgagaagcgctacatcatcgcgccgaagggcatcaagcagggcgacgtcatcgagaccggtgctcaggctgatatcaagccgggcaacaacctgccgctgaagaacatcccgaccggtaccgtggttcatgccatcgagctccgcccgctgggcggcgctaagatcgctcgttccgctggtgctgccgttcagctcgtcgccaaggatggcgcctacgctcagctgcgtatgccgtccggcgaaatccgcaacgtcgacgcgcgctgccgcgctaccgtcggcgaggtcggcaacgaggaccacgccaacattcagctcggcaaggctggccgcgcccgctggatcggccgccgtccgatcacccgtggtgagtccatgaacccggtcgaccacccgcacggcggtcgtacccgcggtggtaagccgccggtctccccgtggggcaagggcgaggttcgtactcgtcgtccgaagaaggcttcgaacaagatgattgttcgtcgccgtccgtccggcaagaaccgcaagtaagggagtatcgagaagatgactcgtagcatcaagaagggccccttcgtcgacgcccacttgcagaagaaagtcgacgagcagaacgagaagggcaccaagaacgtcatcaagacgtggtcccgtcgttcgatgatcacccctgatttcatcggacacaccttcgccgttcatgatggtcgcaagcatgtcccggtgttcgtcaccgaggccatggttggtcacaagctgggtgagttcgcccccacgaagaccttcaagggtcacgtgaaggacgacaagaaggcccgtcgctaaggataaggaatagaacatggaagctaaagcaatcgctcgtcacgtccgcgtgacgccgcgcaaggctcgccgcatggtcgacctcatccgcggcaagaaggcgaccgaagccgtcaccattttgaagttcgcccctcaggctgcggccctgccggtccgcaagaccctggagagcgccatcgccaacgctcgtgtgaaggccgacaaggccggcgagccgttccgcgagaacgacctgtacatcaaggagacctacgttgacgaaggtgtgaccctcaagcgcttccgcgctcgtgcccagggccgcgctgctcgcatcaacaagcgcacctcccacatcacggtcgtcgtggctaacaaggaaggagcccgctaaagatgggtcagaagatcaatccgtttggctaccgtctgggcatcactgagaaccaccgctccaagtggttctccgactccaacaaggccggcgaacgctaccgcgacttcgtgcttgaggatgatcagatccgcaaggagatgagcaaggacctcgagcgcgctggcgtgtcccgcatcgtcatcgagcgcacccgcgaccgcgttcgcgtcgacattcacaccgcccgtccgggcatcgtgatcggtcgtcgtggcgccgaggctgagcgcgtccgcgccaagctcgagaagctgaccggcaagcaggtccagctcaacatcttcgaagtcaagaacgccgcgctggacgcccagctcgtcgctcagggcatcgctgagcagctgaccaaccgcgtcaccttccgtcgtgccatgcgtaaggcccagcaggacgccatgcgcgccggtgccaagggtatccgcatcaagctctccggccgcctcggcggtgcggaaatgagccgttccgagttctaccgtgagggccgcgttccgctgcagaccctccgcgccctcatcgattacggcttcttcgaggccaagaccacgtacggccgtatcggcgtcaaggtctggatctacaagggcgacatgaccgaatccgagttcgaagagcagcaggctcagcagaacaaccgtccgggccgtcgtggtggcgatcgccgcccgcgccgtggcaaccgttccgccgccccgcaggccgccgaagcccccaaggctgaggctcccgccgaggccgctccggctgcagaaacgaaggagtgagcaagaatgcttatccccaagaggactaagtaccgcaagcagcaccgccctgtgcgttctggcatgtccaagggcggcaacgagatcaacttcggtgatttcgccatccagtccctcgccccggcctacgtgaccaaccgtcagatcgaagccgcgcgtatcgccatgacccgctacatcaagcgtggtggccgcgtgtggatcacgatcttcccggatcgtccgctgaccaagcacccgctcggtgcccgaatgggttccggtaagggtgccccggagttctggattgcgaacgtgcgccctggtcgcgtgatgttcgaaatcggtggtgtgtccgaggacatcgctaaggaagccctccgccgcgctatcgacaagctcccgatgaagtgccgcattatcgcacgtgaaggtggtgatatctgatggcagtcggtaccgctgattactccatcaagaatctcaacgagaagaccaacgcggaaatcgaaggcttcttgaagaagtccaaggaagagctgttcaacctgcgcttccagcacgccaccggtcagctcgagaacaccgcccgtctcaaggctgtcaagagcgacatcgcccgcatgtacaccgtgcttcgcgagcgtgagcttggcatcagccaggagccggccgctaccgaatccaaggagaagtgattatggctgaagagcgtaacttccgtaaggttcgccgcggctacgtcgtgtccgacaagatggacaagacgattaccgtcgagctcgagcagcgttcgacccacccgctgtacggcaaggtcgttcgttccaccagcaaggtcaaggcccatgatgaacacaacgacgcccacattggcgacctcgtgagtattatggaaactcggcctctgagcaagaccaagcgctggcgtctcgaatccattatcgagcgcgccaagtaagtaaagttcggcaaggctcgccatttaccggggcattatgggcaaccacgatgccccggtaaatggggagaaccagctcggctaaggagaatcaatgattcagcaggaaacgcggcttcatgtcgccgacaacacgggtgcgaaggaactcctcgccatccgcgtgctcggcggatcgaagcgacgctatgccggcatcggcgacgtgatcgtcgcctccgtcaaggacgccattcctggcgggtcggtcaagaagggcgacgtggttaaggccgttgtcgtccgtaccgtcaaggaatcccgccgtgcggatggttcctacatcaagttcgacgagaacgccgccgtcattctcggctccggccgtgaaccgaagggcactcgtatcttcggaccggtcggtcgtgaactgcgcgagcacaagttcatgaagatcgtgtccctcgccccggaggtgatctgacatggcagccaagatcaagagcggcgacctggtcaaggtcatccgcggcaaggaccgcggcaaggaaggcaccgtcaagcaggtgctctccaacgatcgactgatcgtcgaaggcgtgcagatcgtcaagaagcacgtgcgtgcaacgcagcagggccagcaggctggcatcgtctccactgaggctccgatccatcgctccaacgtgatggtcatcgacccggagaccaagcagccgacccgcgttggcatcaccgttaaggaagaggcgcgtgacggcaaggtgaagaccgtgcgcgtgcgcgtcgccaagaagtccggaaaggagctggcatgaccgatactactgtcgaagcgccggccaccccgcgcttgaaggtcaagtacaacgagcagatcattcctgagctcgagaaggagttcaagtactccaacccgatgcaggttgcccgtgtccagaaggtcgtcgtctccatgggtgttggtgccgctgcccgcgactccaagctcatcgaaggtgccgtcaaggacctcaccctgatcaccggccagaagccgaagatcaccaaggccaagaagtccgtcgcgcagttccatctgcgtgaaggccaggccatcggtgcgtacgtcaccctgcgtggcgaccgcatgtgggagttcctggaccgtctgctgaccctcgcgctgccccgtatccgcgacttccgcggcatcaacggccaccagttcgatggccagggcaactacaactttggtctcaccgagcagtccatgttccacgagatcgatcctgattcgatcgatcacgtgcgcggtatggacatcactgtggtgacctccaccaaggacgacaaggaagcttacgcgctgctgaagcacctcggcttccccttcaaggagaactgatatggcaaaaaccgctcttaagaacaaggcggccggcaagccgaagttcaaggtccgcgcttacacgcgctgccaggtctgcggtcgtccccactccgtctaccgcaagttcggcctgtgccgcatctgccttcgtgagaaggctcaccgcggtgaactgcccggcgttacgaagtccagttggtaaacatcgacgctgaaggtccgcggcccgaacgcttctagaagaagcgtgagggcggcggaaaccatagcgagaaagggcaacaagcccaaatgacaatgacagatccgatcgcagacatgcttacgcgtctgcgtaatgcgagcgcggccaagcacgaaaccgtggatatgccgtactccaagttcaaggcgaatatcgccgagatcctgaagcgtgaaggctacatcaaggacttcactgctaaggaagccaaggtcggccagactcttgaggtcaccctcaagtacggtccgaacggtgagcgttccattcagggtatcaagcgcatctccaagccgggccttcgtcgttacgcgaagtccgactccctgccgatgccgctcggtggcctgggtatcgccatcatctcgacttcttcgggactgctgactcagaaggaatgcctcgaccgaggcattggcggcgaaattgtcgccttcgtgtggtgagaaaggagagctgaaacatggcatcgcatattggtaagctccccatcgccatccctgctggcgttgaagtcaagattgaaggccagaacttctccgccaagggcgctaagggttctgactcctacgtggttccggaaggcatcaccgctgccgttgaaggcaacgagattgtcctgaccgccgctgatgacctgcgtccgacccgtgccaagcacggtctggctcgttccatcatggccggcatggtcaagggtgttcacgatggctactccaagactcttgagatcgtcggcaccggttaccgcgccgtcgccaagggccagggcatcgagttcttcctcggctactcccacaccatcaccgtcaacccgcccgaaggcatcaccctgaaggtgaccgacgccaaccacgtggttgtcgaaggcaccgacaagcaggtcgtgggccaggttgccgccaacatccgcaagctgcgcgctccggaaccctacaagggcaagggcatcaagtactccgatgaacgcatcctgcgcaaggctggaaaggctggtaagtgatatgagcgttgctattctcggaaaaggcaagaaggtagctctcaagcgccgtcacgcgcgtatccgcaagcgcatctccggtacccccgagcgtccgcgcctggtggtcacccgctccaaccgtcacatggttgctcaggtggtcgacgataccaagggcattaccctggtgtctgcctccactcttcaggccgacttcgccggcttcgaaggcaccaagactgaggccgccaagaaggtcggcgagctgatcgccgagaaggccaaggctgccggcatcaccgcagtcgtgttcgaccgcggtggcaacaagtacaccggtcgcgtcgcagccgttgctgatggcgcccgcgagggaggtcttgcactgtgagcgacaacgaaacgaaggaaacccaagtggctgaagaaactcagaacactgtggcgaccgaatccaacaacgaggaccgcaagggtcgtcgtggccagcgcggtgaaggccgtcgtggcgagcgtcgtaaccgtcgtgaagaaaaccacggcgacgagttgctcgatcgcgtggtgaccatcaaccgtgtgtccaagacccacaagggtggccgtaccttcagcttcgccgcactggttgtggtcggcgacggcaacggcaccgtgggtgtcggctacggcaagtcccgtgaagtcccggccgccatcgccaagggccagctggacgccaagaagcacatgttctctgtgcctcgcgtccgcggcaccatcacccacccggttcagggtcacgacgctgctggcaccgtcctgctgcgtccggccgccccgggtaccggtgtaatcgccggtggctccgtgcgcgccgtcatggaatgcgcaggcatcaccgacgtcctgaccaagtcgatgggctccgccaccgccgttaacgtggtgcgcgctaccgtcgacgccctcaagcagctcgaagagcccgaggagatcgccgcccgtcgtggcctggcgctcgacgaggtcgctcccgatgctctgctgcgcgcccgcgccgccggcattgccgaggctcgcaaggctcgcgaagaggctgctgccgctaaggccgccgaagagaaggatggtgagtgatactcatggctaagaacctgaagattaccctgcaccacggcatcgtgaaccgtaccccggctcagcgcgccaccgtcaagaccctcggcctcaacaagatcggtaagaccgttgtccgcgaggacaccccggccaaccgtggtctggtgaacgccgtgcgtcacctggtcaccgttgaggaggttgactgattatggcagataacgaaatcctgcagatgcacgacctgaagcccgccccgggtgccaagaaggaccgcacccgtgtgggccgcggtgaaggctccaagggtaagaccgccggtcgtggcgccaagggccagacgaagcgcaaccacgtgcgtccgggctttgaaggcggccagctgccgctgtacatgcgcctgccgaagcttcgtggcttcaagaacccgttcaaggtcgagttccaggtcatcaacatcgctcgtctcgtggagctcttccccgagggcggcgaggttgctgtggccgacctgatcgccaagggcgctgttcgtgacaacgctccggtgaaggttctgggcgacggcgagaccaccgtggctttcaccctcaagggtgttaaggcttcggcttccgccaagtccaagatcgaggccgccggcggttccgtttccgaggactgattagtcctacggggagcgcaataggctgtacaacccccgcccgccaataggtggacgggggttcccttttctaaaaaattgttgttctgagtgcagagaagcagtctcaacacaatgatcgttttgagtatgcttccccccgttcagtacgacggagcataattcaggtaacattcgcgagacatgaagtggccgaagtaggcactttagactatgctcgtttgttagtttgtgtatttcgcgcgattggcgcgctattgggaggaaatctaggtgaggacactaatccaggccctgaaaaccaaagagttgaggaagaagattctcttcgtcctgttcatcatcatcgtctaccgcatcggttcgttcattccgacccctggcgtggactacaacgtggtgaacaagtgcatggccaccatcggcagcgcctcccaggagaacttcatcggactggtgaacctcttctcgggtggcgccatgctccagctgtctatcttcgcgctgggcgtcatgccgtacatcaccgcgtccatcgtggtgcagctgctgcgcgtggtcatcccccgcttcgaggccctgcacaaggagggccagtccggcgaggccaagctcacccagtacacccgttacctgaccatcggcctggccgtgctccagtccaccaccatcctggtcaccgcccgctccggcgccctgttcaattaccagtgcgaccaggtcatcccggacggctccgtgttcaacctcgtggtcatggtcctcatcatgaccggcggcaccggcctgatcatgtggatggccgagctcgtgaccgacaagggcatcggccagggcatgtccatcttgatcttcatgtccatctgctccggcttcctgccgcagctgtgggagatcggctacggcaccgacggcaccgatggcgactggctgaagttcggcatcgtcgtgggcgtgctcgtggtcatcctcatcttcgtcgacttcgtcgaactgtgccagcgccgcgtcccggtccagtacacgcgccgcatgatcggccgtaagatgtacggcggctcctccacctacctgccgctgaagatcaacatgtccggcgtcatcccgccgatcttcgcctcctctatcctcgccatcccgaccctgatcgcccagttcggcaagtccgaccagtcgtgggtcaagtggatcaacgccaacctggcgaacaccacctccgtgtggtacatcgcgctgtacgcgctgatgattgtgttcttctgcttcttctacacctcgatcacgttcaacccggacgagaccgcggacaacatgaagcagtacggcggcttcatccccggcatccgcgccggcaacgccaccagccgctacctgacctacgtgatgaaccgactcaacaccgtcggcgccgtctacctgctgttcgtggccctgatcccgaccgtgctgatcatggccctcggcctcaacgccaagctgccgttcggtggtaccacgatcctgattatcgcgggcgtgggcctcgacaccctgcgccaggccaaggcccagaccgaacagttccagtacaccggcttcctgttcgaaaacgtggaccacaaagagggctgacgcccgcttggcagcggtcgcccgcaatgggcaggcggccgcgcgaggagtggaacagtccagtggactgttccacgacggagcaatctttcttccgcatataactcaatggctcccttaaccaagggagccaaaaccgtattaataaccgacataaaaggagaccaccatgcgtctgctcatcatgggcccccagggcgtgggcaagggcacccaggctgctctgctcgccgaacacttcaacatccccaccatctccaccggcgacatcttccgctacaacatcaagaacaagaccgaactcggccttgaggcgatgagctacaccgacaagggcgagctggttccggactccctgaccaacaagatcgtcaaggatcgtctggccaaggaagactgcaagaacggctggatcctcgacggctacccgcgtaacgccgcccaggtcaccgctctcgacgagatgctcgccgacctcgacactccgctcgaccacgtggtggccctcgaagccgcccgcgacgtgctgctggagcgtatgaagaagcgcgccgccgagcagggccgcgctgacgacactccggaggccatcgccaagcgcctggagacctatgagaaggaaaccgctccgctgctcgacatctacgaggcccgtggcctgctcgtcgtggtcaacggcgtcggcgacatcgacgagatcagcggccgtatcatcagccacctcgagtagtaggttcggcagcccgggcaacaagccggagtgatgccgaaataccacatcaacgtttccatacccctgtgcgacacgccgagtgttcgtacaggggtatgtgcgtatatagttgacagttggtgtgtcttcggatatgccatagtaatcatccaacggaataggactagaggcacatggcaaaagacggtgtgattgaagtcgaaggacaggtcgtggaagcactgcctaacgcgatgttccgcgttgaactcgaaaacaagcacatcgtgctcgccacgatttccggcaaaatgcgtaagaactacattcgtattctgccgcaggatcgtgtcgtgctcgaaatgagcccttacgacctgaaccgcggacgcattacgtaccgttacaagtaaaggtacacaagaaaaggataaccatgaaggtcagccctagcgtgaagaggatctgcgaaaactgccgcgtgatccgccgtcacggccgcgtcatggtgatctgcgtcaacccgcgccacaagcagcgtcagggctgagagcagattctccagcggcactaagtaaataaggcactctctcacagtgcttcccgcaagggaacgacactgaaccacgggtacgtaggcccgtgccgggtaaccgggcgagcgggtgcaagacctacggcaacaagaaggaatcgcaatggcacgtcttgccggagtcgacatccccaatgagaagcgcatcgagatcgccctcacctacattttcggtgtgggtcgcactcgtgccaaggaaacgcttgccgcgaccggtattagcccggacatccgcgtcaaggatctcaccgacgagcagctgattacgctgcgtgactacctcgaagccaactacaagatcgagggtgacctgcgtcgtgaagtcgatgcagatattcgtcgcaagattcagatcaactgctaccaaggccagcgtcaccgtaagggacttcctgtgcgcggccagcgcaccaagaccaatgctcgtacccgcaagggcccgaagcgcacggtcgccggaaagaagaaggccaccaagtagtcggtggcatgattcgggccacgggatgattttcatcccatcgcccgaacgtcaacaacaaagttcgttactaggaaacgagggtcaatggcagcgcctaagcaagccgctcgtaagccccgtcgtcgcgaccgcaagtcggtcccggtcggccaggctcacatcaagtccactttcaacaacacgatcatttcgatcaccgatccgtccggcgccgtggtgtcctgggcgtccggtggcgatgtcggcttcaagggctcccgtaagtccacgccgtacgccgctggtatggctgccgagtccgccgcccgcaaggcgatggaacacggcgtcaagaaggtcgacgtgttcgtcaagggcccgggttccggtcgtgaaaccgccatccgttccctgcagtctgcgggcctcgaggttggttccatcaccgacgtcaccccgcaagcccacaacggcgttcgtcctccgaagcgtcgtcgcgtctgagcactcagcaataccaaatccatccaaaaccgcctgaccggtgagtgcaccaccgagttcaagctgaaaggataaccacagtgcttattgcacagcgtccgactcttaccgaggaatctctgaatccgcagcgctcccgcttcaccatcgagccgctcgagcctggcttcggctacacgctcggcaactcgctgcgtcgcacgctgctgagctccatcccgggtgctgccgtgacctccgtgcgtatttccggtgccctgcatgagttcaccactctgccaggtgtccaggaagacgtcaccgagatcctgctgaacatcaagggcatcgtgctcaccagcgaatacgacgagcctgtggtcatgtatctgcgcaagagcggcaagggcgaagccgtggctggggacatcaccccgccggccggcgtcaccattgccaacccggagcagcacatcgctaccctcgccgacgatggcgaactcgagatcgagttcactgtcgagcgtggccgtggctatgttcctgcccagatgaacaagcaggacaacgatgagatcggccgtattccggttgattccatctactccccggtactcaaggtgagctacaaggtcgaggccacccgtgtggaacagcgcacggacttcgacaagctcatcctggacgtggagaccaagcccgccatctccccgcgtgacgcggtggcttccgccggttccaccttggtggagctcttcggcctgtgccgtgagctcaacgcccaggctgaaggcgtcgaggtcggtccggccccggtggccgaggagaccaaccccgagatggccgttccgattgaggacctcaacctgacgcagcgttcttacaactgcctcaagcgcgagggcatccacaccatcggtgagcttgtctcccacaccgagcaggacctgctcgacatccgcaatttcggtatgaagtcaatcgatgaggtcaaggagaagctgcagaccttgggcctgagcctcaagtcctcgccgatggccttcgataccaataatctcgaaggtggcacgttcttctcgccggaagacgagtgatctgcctctttgaccaatcgttcgttcactaggcaagcagatgttcgggcatatgcccacctgcttgcctgaagaacggacatataaggagtaaacccaatgcctacacctaagaagggcccgcgtctggcttccagccccgcacacgagcgcctcatgctggcaaacatggcgaccagcctgttccagaacggccgcatcaccaccacgctgccgaaggccaagcgccttcgtccgctggcagagcgcctgatcaccttcgccaagcgtggtgatctgcactcccgccgtcgcgtgatgcgcgtcatccgcaacaagtccgtggtgcacatcctgttcacccagattgccgagcagatggagcagcgtgaaggtggctacacccgtatcgtcaagatcgctccgcgcgttggcgatgccgctccggccgctgtgatcgagctcgtcaccgagccggttgccaagaaggctgttgtgaaggaagctgaagccgccgccaaggttgccgaagaagaagctccggccgttgaggctgaggccactgaggctgctgaggctattgaggctccggtcgaggagaccgccgccgttgaggctgaggctcccgctgaggaagccgctgacgccgagaaggccgagtgagctgaatagcgtttcgctaagctagctgaaagggctggaatccgtttgggttccagcccttttgcgttgttttcatagaatctacaacgtacgtacggcccgaatggcctcggctcttgcggccagctgatcatcggcgggatatgcgatatgctccaaagtcaggccctgcggcgcaatcggcccgcttgagccttcacgtactggctcggccattttgccggcaaaccactccagtgatttgcgtcccgaaccaactttgatgcatgagccgaccagggagcgcaccatattgcgggcaaaggcgtccgccacaatcgtgaacactaccaggccggactccagcgacggagtccgatatgcttcatgcgatgccatctcatccggtactaggggagtgatcggcacccgccgccaataggcggtcttgacttcacggatcgtagtgcctcccggattcggagtggcgaaggaaccaaaatcgtgcaggccgatggtcaatgaggctgcgcggttcataagctccagatccagcgcttcatccacggtaagtacgcatccacgcagacgcgggtcgacctcagacgaacgatcggcgacccgatacacataagtgcgctccaatgcggagaacctggcatcgaagccgaccggagctacggcaatgccatgaatgacgatgtccgaaggcagcacagccttgagtctgcgagtcagcgcctcggtgaccggaatggtcatgtgacctacgcagcgattcagtacctcatcggatacatccagatgcgccacttggtgggaggcatgtacaccggtgtcggtgcgtccagccactgtcaagcgtaacggttcggccgcgtcatcggtcggcacccgcagcaccttgtgcagcgcatcttcaatggtgccttgcactgtacgaagattgggctgtttggcccagccatagaatccgccgccgtcgtaggccaagtcaatgcgcagtcgtgtcatagccattcattgtaacgagtgcggtcggcgagacgagtgcggtcgtcaagatgcgtgcggtcggcgaagtgacctgcctgtaacattctcgcgcgtttgttgaaacgggcccgccttaggttgaaaccatcaaacccggttacggcttgcggcgtcagcgtgcgctcaacacgcctaaccgcttgaagccacagaagccgccacagcaaggagcaggcacgatgatcgaatccgcagcacgcagactggcccatgaactggtaaaccgccgcgaagcgatcaatcgagagctgtcccgcaacggtgtgcgtttcggcatctacaagaacggcgaataccatgaccggctgttcccgtacgaccctgtgccgcgcattatcgaatccgacgaatacgacgaattggagaagggcctgaagcagcgcgtcaacgccctgaacgcctatctgaaggacatttattccgataagcgcattattcatgatggcgtcgtgccggaagaatacgtatacacctcggccggctacttcccgcaggtcaacggtgtgacccctcccggcggcattttcgcgcatatcgccggcgaggacctggtccaaggcgaggacggccgctggtgggtgctggaagacaacctgcgcatcccctcgggtgccagctacccgctgttcgtgcgcgacatcgagcgccgcatctccccgcgcctgttccgcgacgttcgtattcgcgataatcgcgaatacccgcgcctgttgcgcaaagccatggactttgtctccaccgagggcatcgccgtggtactgactcccggccgctacaattccgcgttcttcgagcacgcctatctggcggagaaaaccggtgcggcgttggccttccccgaagacctcgaagtggtggacaacaaggtctacttcctcgactacgccggcaaacgccaccgtgtgggcgtggtttaccgccgcctgtccgacgaattcctcgacccgttcgccttcaatcctgattcggtgatcggtgtgcccggtatcctgtccgcctaccgcgcgggcaacgtggccatcgtcaacgcgccgggcaacggcgcggccgatgacaaggccgtctactacttcgtgccgcagatgatcaagtactatctcggcgaggaaccgattctcaacaacgcgcccacgtacatgccgatgttcgaggccgaccgcaaggaagtcctgaatcggatgggcgagctggtcatcaaggatgtggccgaagccggcggttacggcgtggtgtttggttcgtcgctggatgccgccgcacgtgaggagctcgccaaccggatcaaggaggagccgcgtcgattcattgcccaagaggtgattcagttccgtgatatcgatgtggtggacccgaagaccggcgagatgtcgccgcgcaagtgcgatttgcgtgccttcgtggtcaccggcaagaatacgcacgtgtggtattcgggcttgactcgatactcgtcggtgcccggccagatgattgtcaactcgtcgcagggtggcggatttaaggatacgtgggtgttggcacccgaatccggcgtggagcacgagtacggtgccgaaacgcaggtggcgaacctgctgagccagtcccgccaccattcgttgtcgctggttaccgcttccaaggcagacaacctgtattggctgggtcgatacaccgagcgcgccttcaccacgctgaaccagttcttcccgttctacgatcgtgtgatggacaccgatgtggacgccttccgtccgttcgctcacgcactcgacctgcccgaagatttcgaggacttcgacgggttcgtgaacagcttcctgtacgacgggtccaatcctgattcggtgcggtcggccgtaacttccgcattcaacaacgccgtgattctgcgcccggaattgagctcgcgtctgctgcagtacgtggagttggcgatgaccaatatcaccgatgccgccaaatacgcggccgatgccgaggacatctacaagcagcgcgatattaccgatgacatgctcgctttctggggcggcatcgagaattcgccggtcgaccccacgctgaaggcgttcatcttcatcggcaaatatctggaacgcatcgacctgtacacgcgcttcggcctgacgatggaggatctggaagcgccgctcaagaagctcgccgcctattcgatgaccttggacggcatgccgctgcccagctgcttcgccgacggactgagctggctggtcggtcagctgccgtctcgcggatatcaggaagtcgccgacctgctgaagaagtaccttgacgactactccggccgtgtcagcgcgctggccatcaaagacatgggctcactgagctccatgaacatggacgccaagcgtccctgatcccgacctgacaccctgacgggttcaaatgctatggtggtatggcgaaaaaaccgtgcgcccgagtgccggcctgtgcatatcagcagattgccggaatatatgcgtgggctgtgagcgcacggaccatacctcagccatggctgtagtgttgttatcccgagaatatgccggttgccggctcgtgtgtaagtgcaggagacgttgtgaaaaaactcgtgttcgactatgagatgaggctgtccttcagcgcaccggtcaccgatcacaggttccagcttcgctgtattccctccactggccctcgccaacaggtgattgacgtggaagtgaagattcagcccgaaaccgaactcgaaaccaccatcgactcctttgactccgtggtgatgaccggattcatccctgagccgcacgacatattcagctactcggtgaccggtatcgccttcgtggacaatgcgcatatccataaggaagcctataaaccgctgtaccgattcaattcagcgctcaccattcccggcccgaacgtggaggcgatgattgccgtatgccgcgaacgcttggcggcgctgccttccgacgccactccggtgcagcaggctgccgaagtgatggatgaggtctacaaggcgtttgtgtatacgcccggttccaccacgattcgcaccaccgccgaacaggccttggctcagcgcaagggcgtatgccaggattatgcgcacgtgatgctgtccgtgtgccggcatgtgggattgaccgcgcgctacattgccggtttgcttgggggagagggcgcgacccatgcttgggtcgaggtgtatcaggatggccgatgggtcggactggatcccacgcataaccgattggtggacgacagctacatcaccatcgcccacggccgcgattaccgcgactgcatgctcgacatcggcatcttctctggatacaacgtccagcagtcccaatgggtcaacgcctccgtccacgaacaggtggcataaataaaatttcaagccccctctgatgagctgagccgtgaagaaaacgccggaggcgtttttaggcgaaggcgaacgacagtgagcaaataaaatggcagctggaaagctgtccttaattgcgttcgagctgtcagccgtaaggctgaccgagggagagaccactcaatgcagagtggccccgtcaccgcttctaccaccaccaatattcggattgtcgtcgttgcaacattcggattttggtagttgaagaattcggattttcgcagttgaccaattcggactgttaatcggctcatcgtctgacccatcgcaatctcacacaaaatcgcattatcccacgccgaatcgagctcagcgaaactccgatttgccaggtcggcagaatgtggcataatgaacaagttgccattttggcagcatggataagtgtccgagcggtctaaggagcacgcctcgaaagcgtgtgaggtgaaagcctccgcgagttcgaatctcgccttatccgcctgcaagggtttcgaggtcacctcgaaaccctttttgtttctgcgaaaccccacctttggggctataggccaaaatggagttataggccaaaatgtgtgtccggcggtctagtcgttcgactgccattcgacccgtgtgtggaactcgttccagtcgatgctggtgcctgtattgcttcaatgtttgttgggcgggttcggcagtgtttttcacagccaaaaaaaatcagtgacgaaacacgaaacatcgacttgactaaatacaaacggcgccgccacgaggagcggacccgccccgcggccccgcattcgctgcagcaccggtcggtctcgtccgtcggatcgcagccgatcagccacacgccggcacacgagcccgacgtgacgtggcgttgcgagaccgggttcaacccgagcctgtccagaccgagcagcacccggccgtcgaacgcgctagacttggaaccaagctgcgcggttttcttcgctttttcgatcacacaccgaataaaaacgcacggcccatacacacccaaatgcgaagggccagttatgacccgagaacgcctataactagcgcctgtatgcatgtaattgcagaaatcgacgtcttgtgcatgcaatttgggtccgtaaatagcgcagaaatgcgaggcaatctgcggacgggaagcgggaagggcggttcaggagctttaaatggtcctcttatgcatgcggcctcatgatcgggaaccggctaggaaatacgttgcatgcatttcggcatcataaggcatcggaaaagtcctacggtagcggtcccgcgattcgtcaattgagtgattactcggtactgtctcccgaaccgaccagttttttgctcatacactagttccgggtttcgatgagattgatgatgggcgataaaagggtccgacgcgctaacgtcgggcccttgcgttgattacggggtcgtgcccctaaccaaaggttacgggacgaatcgtatcatgatgcgcggtagtctgaccgtgagcaaacgcactgtgattgtctatatgacggatgcgcgcggtccaacgtgcgtggcctctggccgttacctcttgctaagactgcttatgtaacggtcgttaaagcatgatgtttcctcgctaggtattttgaccgcggcagttgttggatggatttgattcggatgatgatatagcgttgtatcaattgtggttgctgttatttgtatttgttgaagtatgtgagtggcgagtggcgctttacatgttcttttttctgtcttttggtccgattcttttcggcgtgttgccttgaaaatacacgcttatgcagatgttttgcgcctcgtcgttgcatgatttggttctttgttgtatcatctaactaaatgataagtacaatgttgtatcaagttgtactcagtaattatcttccgcgctgaagcggtgatttttacttatctgagacaacgttgtatcgaatttatggaagcaaaggataacaatggcagagcagcagtccaacaccgcctcagattcctcccgtctgatcgtcgacgatgccttcgaagtggctccggtgaatgatcgtctttttggctcgtttgtggaacatttgggacgttgtgtatatgacggcatctatgagcctagtcatcccgaagcggatgaggatggattccgcaaagatgtcattgagctggttcgtgagttaggtgccactaccatacgttatcccggcggcaattttgtgtccggttatcgctgggaagatggtgtcggcccgaaggaaagccgtccgcgtcgtcttgatttggcttggcattccactgaaaccaatcagttcggcttgcacgagatgtctcagtggttagacaaggtcggcggcaatgagctcatggaagctgtgaatcttggcacccgtggtcttgaggaagctctcgatttgcttgagtacgcgaatgttcctagcggtactaagctctctgatgaacgacgtgccaatggcaaggaaaacccgttcggtatcaagatgtggtgccttggcaatgagatggatggcccctggcagactgggcacaaatcagccgaagactacggtacattggctgcctcggttgcggcgggtatgcgcatgattgatccggatgtggagctggtcgtatgtggatcatccagtcacatgatggacacatttggtaaatgggaagaaacggttcttgaaaaggcctatgacagtgtcgatttcatctcgtgtcatgcctattatcatcctgaatttcaggctgatggcactcgtgatatggcaagcttccttgcatccggcgttgatatggatggcttcatcaaggatgtcgctgccgccatcgacgctaccaaggctcgccttaagagcgaccataacgtattcatctcatttgatgaatggaacgtgtggtatatcgatgaagaaccaagcaaaaatccggaaggtattggtaattggcctgtggcgccccgtctgcttgaagatagctacaccgctgcggatgccgtggtctttggcgacctcatgattacgttgctcaaaaacgccgatcgcgttcatgcggcgagccttgctcagctagtcaatgtcattgcgccaattatgaccgagccaggaggtccggcatggcgccagacgacgttctatccattctcgatgactgcgagatatgccaagaacggtacggtacttgagcccaaactgacttcgaatacttatgccacggccaagtatggagaggtaccggtggtcaactctgtggcagtacgcggggccgatggatctgtgaccattttcgtggtcaatcggtcattggaattgtccaatgacttcgaaatccaagtgccggatgatggcaacttcactgaagcgaccgcacagacgctacatgaagaggacttgctcgctaggaacaccttggaaaaccaagatcgcgtgattcttcacaccaatgattctgttacgttcagtgccgacgatgccatcgtacatgtgacattgcctccggtgtcttggactgccgtgcatgtgcggtgatttgaacgggtgaacatcgaaatataggtacgagataaggggaggagcgtcacatgaattgcagccaattcactccatgtgagggacgaacagagattgtcgatgctgatggacgattgatctggcataacgatgacatctgcatggtattcgtagttcgcgataatgctccggttgtgctcgccggtttgtccggatatggtatgcgtcctgcctgcgaattgaacaacgagaaaggtgcgtttcccattgtggaagtacttacttctatctcgggtcgtaccatgaatcatcaacgcttgaccgatactcgggaaggaagtcagctccgttttgtagcagcttatacctatgagcgcggcatgcgtcatgttctcaggattgatcagaaagatgaacattctggcctgttgactgagacggagttctcgatgttccccggagtcagtgccgtgagttgccagtcccgcatcgcatcggaacgccggctgccggtagaagcagtgtcttcgttgaatctcaccgtgccgttggatgccgctgggggtggagttgacggagtcgaggtctactgggccgacagcacatgggccgcggaaaataattggcatcaggcgccacttcgcgagattggtttgccggacatcaataccaacattaatcctcgtgttccgggcgcgcgatttaatctctcttcgcgatccacttggtcgactggagagaagcttccccttggcgttttaaccatgggggaggggattcgtcgctcggctctgatttggcaaatcgaacacaacggtccatggacttgggaaattggtgaaggcatcgatggccttcatatcacggccggcggtcctaatggggatgatcatcaatgggccgttgtgcttgacgaacgcactgattttgtcacagttccagctagctttgccatttgctcaggcggctggcagcaggtagtcgaacaaatgacgttacatcgtcgggcattgcgctctgctcgtttggctgtaaacggtcagaaccatgattccgaacagctggtcatttacaacgactatatgaataccctgttcggcaatccgacggctgataaagaactgccgctaattgaaggtgcaggcaagctcggcgtggacgtgttctgcatcgatgctggatggtatgacagcgccgatggcggctggtgggacatggttggcgagtggaagccctctaccaatcgtttcggcaatcttggcttgaaaggaatcgcttcggccatccgcaaggccggcatgggactgggactatggctcgagccggaagtcgtaggagtacgttctccaattgctaatgagttgccggattccgcattcttctgccggcatggcgagcgcgtggcagacgatggacgttaccatctcgatttccgttctcctgatgcgcgcgctcatatggatgacacgatggagcgcatcatcgctgaattccagccgaaattctttaaattcgactacaacaccgtacccggggttggtaccgaaatcgatgccggatatctaggtgaagggttgcttggtcatagccgtgcttatgtgcggtggctagacgatctcaagcaccggcatcccgagcttgtcattgagaattgtggttccggtgccatgcgtgctgactacgcgatgctgcaacgtctcgatctgcaatcgacttctgaccaatgtgatccggctatatatgctgccattgcagctggagcctcaatgtcgattctgccggagcaacaaggcaattggggctacgctcagcaggagatggatgacgagactgcggttttcactcttgcagcaggtatcgccggtcgtctgtatctgtcaggtttcgtcaaccgaatggatgagaggcgcttgcgtctggtccgaggtgccattgaagcgcaccggcaggtgctgaggaaccagtccggtcaggtgccattctggccattgggacttccggttttttcgggcgattggttggccagtgggcttttgccttatgcggataataacgagaccggctatatgacgatttggcaccgcggcggtgcaaacagcgttgttgtagaagtgccgcaaggtgccactttgagaccgtttttcccgaagccgggactcatcgacaagagccatggtgcagtcgattggcatgtcgagcctcttgatggcacacatgtccgtctgactgtttccgacaatcgtcgcagtgccagagtgtatgcgattgatatgccggattccaccaaataacaacaagatttgcctgcgcaacaccgcgctggcagcaatgataaggagaaagaacatgaagcaccccttcagaagtgcggttgccgcagtcagttcaatggtgatgctgacttcccttgccgcatgtggcggcagcgacacggcccagtccgatgaaaaggaactcacgatttcttggtattactcctctggcggtggtgacacgtgggagcgtgccatcaagctgtacaagaaggaaaatccagatgtcaagatcaatgaagtccacacttcattcccgcagatgcagaagaatgcatcgttgactctgcaggctgacgatgctcctgacgtggccctgtacaaccaggggaccagttctgttggcaatctcgcatcgcaaggtattctggctgacttaagcgaatatgcggacaaatatggttggaccgatacgttgcctgaatccattcagactgtggccaaatataaggccgatgatggtggcgttatgtcctcggacggcgaatggtatggcgtgccagtcaacggtgagttcgttctggcgtactacaaccaggacatgttcgataaaaatggcatcgctattccggaaaccttcgacgagcttgagtccgctatgcagcagttcgtggacaaaggcattacgccggttgcttttgaaggcaatgagacggcttcgcagcatctgtggtatcagctggtactgtctaaggccaatcgccagtttgttgacgattatcaatcctatgagcacgacgtcgacttctccagtgagccattcacctatgctgcgaacaagttctccgagtgggtccagaagggatatcttccgagcaactccggtggtctggtcgctgaggatatgattacacagttctgtgcaggtgaatacccaatcatgttctctggctcgtggtggttcggacgtgtcaatcaggatggcaacttcaagagcacgttccgtgccttgcccggcaacgagaagctgaacaccggtgcaaccggcaaactatgggtggttccggaaacctctaagcataaggatcttgctgccgacttcctgaacttcctgctctccaaagatgtgcagaacatgcttgctactgaagctggtttgccgttcaatgcctctgatgattactcgattgactctttgccggatgagcttaagaatccgctgaagactttcgatgacatgcaggactctgccaaagagttcaacacggtgttcgaacagttgctcgacaacgatgcgattgcgttgtacccggattggccaagtgccggcatgtatgatgctctgaattcggctctccaaggcttgattaacggcaactccactcctgagcaggcaaccggtgaaatcaaggctgcttatgaggaaggaaagtcagatctgggactgtaacgagttcctgtctcttcgactacacgataaagccacgtagtgtggcatggtgtgggatggatgttcattgttgatcatcttcccacaccgtgcctgacacattcgcactcatgtacagagctggcactgtcgccagcccgcatcccatatcgtcggtgtccattgacaaaaggaggagaccatgtctcatggcaacggctcatctcaaggaaagcggcagaagaagcagctttccaataacgagaaaatatatgaaaagcgtattcgtagcggttatggccgttacattgttcccggtgccatcggtaccgtggtgattctgctgattccttttatcgccaatatttggatttcattgcacagttggcgtggtggccgcagcaaaatgaaattcatcggtttggacaattatgtcaaactactgggggatgaaaagttctggacctcattttccaattcgttgtacatgattgtggccatggtaattattccgctgcttatcggtctgattcttgcagcagtattgttcgattatatcggtcgtgaattcggtggtaagacatcgagctttttgagggcttgctactacctgccacaaattcttcccgtcggtgtagccggcattctgtggaattggattcttaattcacagaccggcgcgattaatcgaattcttgccggacttttcggcatggataagactcctgattggctaggcgacccagatcttgcgatttatgcggtgatgctgatgttggtgtggagccagataggatatccggttgtcatcttcatgtcggcgttggggcgagtcgatcccgagctgtatgaagctgcatcgcttgatggtgccgggtggtggcggcgattcagcgccatcacgctgcctcagattaaacctgagattttcgtggtggtactgacctgcactgttgcggcgcttaaggtttttggacctgtttatatgctgaccaagggcggtccgcaaagctccacccttgtgccgtcctactattcctacattaatttcttcggtaaatcacagattggctatggagcggccatcgcaagcgtgttggcgattgtcatcgccatcgtcgcatctgtcatcatggtgttccagaaccgtagcgctgctcgggaacgtgaaggagctctgatcgtatgagcgcatcatcatctgtcaaaacaggcatccaagctcgtatgaatcgtattgaacagcgtgatcgagttaagcagtccaagacgcgcaagcctattaatctattgcgatgggtaattctcattgcatgtgtgttgtttgcgattctgattctctcgcctctgttccttatggtgctcaatgcgttcaaaacgtcacaagattacacacagaacggtccgttgagcctgcctcatgaactgtatttcggtggcttggtgaatttctggaaagcgaccgacttccccatcaagttctggaattcattgtggatttccgtggtgtctgcgctgttgtccgtggtgctctcgctatttaacgcctatgcgctgggtatcggccgtgtgcgtggtagctcagtgattattgcactgttcatgattctgaccatgctgccaggagaaggattcatctacccactgttttacatgttcaacgcggtgggcatgggcaattctcaatggaccatcgtaattatatgcggcattatcaatatggcgtttggcacatatttgctcagctcggtgatgtcgacattccccaaggagctgttggaagctgcacaaatcgacggggctggtcgttggcgcacactccgtgacgtcgtgttcccgattatgaagtcgaactgcgcggtcttgttcatcttcttcttcatttggacgtggaacgagttctacttcaccttgattttcctagtgtctggagatactcagaccataccgctggcaatcgcgtcgttgcagggcgaccgcatcatggacgttccgactatcaacgcgggaagccttatctcccttattccggcgtttgtcttcttcctcatcttccagaggacgttgacgaagggcattaccgccggagctgtgaaataaccgaacccgatgcactgttggccggtggttctcctcctctccttcccactggccatagtgtatcgatgtatctttcgcccagcgtggggcaacaatgaagaaaggcaaacaaatgaaattttccgatggatattggcgtgtgcgtgaaggctttaccgcagcatgggcccgacagacacatgacatcgcgaaaaccgataacgggatttgtgcacatgcttctgcgaatctggtcaatgggcgtggggattccttaggaggtccggtattcacagttactttatcgaccccggccgaaggaatcatcaaagtagtggaagagcattttcgtggagcggtgaatccagatccacattttcatctgaatattgatgaggatgcgaatttcgacattgagaccggggacggggccacggtgtttcgtgcgggctcgctcgaagtcgccgtctccaatcctggcgagatttggtccatggacttccgagcgaatgggcatagtctcactggaacgtcgtacaaggggctgggcgcatataccgaacagtcgactggtatccattacatgcgtgaacagctgcgtcttgccctagacgaaaaagtctacggcttcggagagcgatttggccacttcgtcaagaatggacagaccgtggaaatgtggaactctgatgccggtacctcatctgacgctgtgtacaaagccatccctttctattggacgaataaaggctatggcgtgttcgtaaatcatagcgaagacgtgtcatttgaggtcggatctgagactgtgggcaaagtgcagttttccactaaaggacatcgacttgaatactatgtgattaatggcccggaaccaaaagatgtactacgccgttatacgaagctgaccggacgtgctccctatctgccggcatggtcatacggtttatggctgaccacatcattcctgaccgattatgatgatgccactgtagcgggattcgtggatggcatgcaggaacgagatatcccactatcagtcttccactatgactgcttctggctcaaggaataccatttctgcgacttcgaatgggatggagatatgttccgtgatccgaggggaaccattgccgagcatcaccgtaaaggtctcaaggtgtgcgtatggattaactcctacctgagttccatgtcgccgttgtttgacgaggctatgtctaagggctacttgctcaagcttcctgatggcagcgtttacgagaccgatttttggcagccgggcatgggcctggtcgatttcttgaagccggaagctcgtgaatggtactgctctaagcttgagaagcttattgatatgggtgtggattgctttaaaaccgatttcggagaatcagtgcctactgaagtggtttatgaagatggttccgattcggtcaagatgcataactactacacgtatctgtacaacaagactgtctacgaattcttggagcgaaagcttggcaagggacaggcggtgctgttcgcccgttccgccaccgttggtggacagcaattccctgtccattggggcggcgactgcgaatcgacttatacggcgatggccgagtcgctgcgcggcggcctatcgttgatgtcgtctggatttgggtactgggcgcatgacatcggtggattcgaaggcaatcctggtcctgacctgtacaagcggtgggtgcagtttggtttgctgtcgacgcattcgcggctgcatggttcccattcggtgcgtgtgccgtgggccttcgatgaagaatcctgtgatgtactacgcaagttcaccaaattgaagttgtcgttgctgccgtatctggcctatggatccaaacaggtcagcgaagaaggcattccgctgatgcgtcccatggctttggagttccctcacgatccagcggcagaatatctggatcgtcagtacatgctgggcgatgatttgctggttgctccggtcttttctccagatggagtggttcgttattatgtgccggaaggaacttggacgaacgtactcaatggagagcgaatcgcgggtccgagatggatcgaggaacaattcgattacatgaccatgccgttgctggcgcgtccaggtgcggtcattccaatgcaggaaggacgttgcgacaccgatggggatttgaccgacgacgtgatcctgaagatttatgatccggcggcccttgactcggaatggcgccaactggtcctgcggcatggttttgaggaagatgccgctgagacgatcttccggattcggcgtacgaatgatgtgcttgaagtgcgctgcgattccgtggaagacggatgggctgtcgaatgtggcggtcagcgggttcaagcgcatgccggagccgcaacattgtcggtgcaatgatcccatagtatgcgcaagcatcgtggacgccggaatgatatctatgacggcattccggcgtctgcaatatctgtgtgaccttctgtgaccttgggcttaagatagggggatatcatgggtggataggcgatggtggtgccacgacaagatatgcgaaggagagatatgggcagccgcgtaacgattaaagacgtggccaaagcggctgatgtctccattaagaccgtatctaacgtgattaacaacactggaagaatgcgcccggacacgcgacaaagagtggaaggggccatgcggcaacttggatatacggttaatttgtcggcgcgtgccatccgttccggtggcaccaggctgataggcctgaatatcttcgacttttcgcagccgtttgctccgtatctagctgataaggtcattgattttgccaaggagcgccaatacggggttattatcaatacctatggctccgatggcactggcttggcagatggtattgaagagacctatcgcttgggagccgatgggtggattttctttactgaacgcgctcttgtcgatgacggtgctgcacttgaacagccatatcctgtggtaatggcaggcgattatctgtcttacggcaaaagtgatttggtgaccatgcctaacgtgtcagctgtacagcagaccgtgggcagattgcttgataccggagtcagagctattgctctattgggtgccccgccggggataactgattgggattctttgaaaagtcagaaagaaggcacccaagagttacgtacccagggctatgtacgggcgttcaaggaacgagggcttgacgtggactggcgatatgttattccggtccatggatggaatcagcatggtggtgtgcaatccactgcagcgatgcttgactcgttaccttgccctgaagcagtggtctgtctcaatgacgccatggcactaggtgccgttcatgagctacagcgtcgtggtttacgagtccctcaagacgtgcaactgataggtttcgataatgtgccggaagccgagtactcggtgccggcgctgaccaccatcgatcctcatatcgatgattatgccaagcatgccgttgacatgcttatcgaccgcatcgaaggatactcaggcccggcccgtacgtacaccaccgatttcacattggtggaacgtgcctcaactcgacttgcccactagcatccaacaagttcgcatcggcttcgtgaggagtgtgtgtctactcgaacaatgcggcgtcagtcgctgggtagccaagttggaacgcggtgtaggcgtgcttggcggccagtgcggcgaggatgagcagcgtatcgctctcggtggaagatttcgattcggtcacggccttgatctgcgcgcgggcgcagtccatttcgatggcggcggcggtcggtacggtttggccacttgccttgtcggcgatggtggtggggttggccagtagttggtcgatggcatagaccttttggcgggggtcgctttggccggaagaactggattgtgcgccggaatcatcaaaattgccgttcgccagcgcaaccaactgctgcccggcggtcttatgcatatcgctcaacgccaacgtagccccagcggtctgtcctcgtgcggccaagacctcgatagcgaatccggcgcgatcctcggccacggccatcgcatccaataccgatcggtcaacgttggcggacgtgacgccatcaagacgcgccggcgtcacctcaggcgcggactgcccgaatttatcggccagaaaagccagccattgcttggtctgcgcgtcacgtaacgttccctcggcaaaacgacccgaacaatacccggcaacgtcaatccaagccaggggagcggccagaccggtggcatactgctctaataacggcgtgccttcagccggatgggtggcgtagcccgccaacgtcatcgctttctcgcaaggggtcatttgagcttctgcctcggcccgtccggccagtcgcggcatcgaacacgccgaaagcgaacacagcatcgcgctcgcgcatagtacggatgccaagcgccgggtaaaccgtcctgaagagaagcgtgtctgcatggaaacatacactaatagctaactgtgactactcataggccatgcgccacataacttcataggaggtacggatcgatggaactggacctgacaggaatacacaagctcgccgccgagcaaggaatcgaccccgaaaccctggatgatgcgctggcagaggccctgcgcctcgcctacctcaagaccccgcacgccgccaagcacgcgcgcgtggagcttgacgaacgttccggcaacttcaccgtgtgggccgccgacgaaattccggtcgaacccaccgaagacaacccttaccccgctcccaagctgggcgaggaatacgatgacaccccgcgtgacttcggccgtctcgccgcagccaccgcacgccaggtcatcacccagctgttccgccgcgccgaagatgagaaggtattcggtgcgttctccggccagaagggcaagctcatcaccggcatcatccagcaggatgcttccgacccctccaacgtgcatgtcgcgatgggcgatgtcgaagccattctgcctcgccgtgagcaggtgcccggcgaacgttaccgccacggcgaacgcatccgcgtgtacgtggtgaacgtggcccgtggcatcaagggcccggaaatcgtggtgtcccgctcccacccggagctggtccgcaagctgttcgagcgcgaagtgccggaactggtctccggtgccgtgtccatcatggccatcgctcgtgaggccggcgcccgcaccaagatcgcggtcaaggccaacaccgatggcgtgaacccgaagggcgcgctgatcggccccggcggcgctcgcgtgcgtgccgttatggagaaccttggcccggagaagatcgacatcgtcgactactccgacgatccggccaagttcgtggcagccgcgctgtccccggctgtggccaccggcgtgcaggtgatcagcgagaagaacaagaccgccatcgccttcatccacgacgaccagctgtccctggccatcggcaaggaaggccagaacgcacgactggcagccaagctgaccggctggaagatcggcatcgaatccgccgaggcccatgccaagaaggtcgccgccgaaaaggccgcccaggctgcggccgaggctgctgctccggaagccgaataggccgccgggctcgaagacgaatgatcttcagggcgcattatttcctgatacgagccgcgtcagcaatggcgcggctcgctgcgtctacgctatccagcgctatgagtatgcttgattggcgtatgtgggctggcgcagtgtgcgcgaaatcgcccacaccagagacgaggtaacacgatcatggtcgcacgatgagacagggtaggcttgccgtcatcaccaactgaccacgcccatgcacgcgcgtggtcacagaataggagtaattagtggcgaaaccacgcgtatacgaactggctaaggttttgaatgtcgatagcaaaaccgtgcttgagaagcttaaggacatgggagaattcgtcaagtccgcttcttctacgattgaaccgccggtagcccggcgtctgaaggcagagttcgccaaggacaacgccaagggcgattccaagcccgtgcagcagcgccgcccggccgcaccttcggccccggcttccacttcatcttccgcaccgactccggccgctcccgcacgtcaggcatcgcctgcctcggcacatcagcaggctccgactccgggtgcaccgacaccgcgtccgcagggcggcgcacgccccggcatgccgacccccggccgccacggtcagaacgacaaccgtgagaatggtcgcgataatcgcgaaggccgtgagaacggtcgtcagagtcgcccgaacgatcgccgtaacaacgatcgtcgtaacaaccagggccgtccgaacaatggccagccggttcagcaccagaacaaccgcggcaatgcttcggctccgcgcccgcacgctcagggcggcgccggtgccaatggcggcaatgccgcttcaaatgcgattccgcgcccgcacgctcagggcccgcgcccgggcaacaacccgttctcccgcaagcagggtatgcacaccccgacgccgggtgatattccgcgtccgcatccgatggctcgtccgactgctgataacggtcgtggcggtcgtccgggccgtcccggccaaggccaggggcagggccgcggcttccgtggcggtcgtccgggccaaggtggtcagggcggtccgcgtcccggccagtggggccacaaccgtccgggtcagggcggcggctcccagggtgccggtcagggcggcgcacgcggcggcttccgtgggggccaaggcggcggcaataacttccagggcggcggtgcaccgagcaacggtcccgcacgtggcggcggtcgcggcggtcgcggcggtgccgcaggcgcattcgggcgtcagggcggcaagtcctcaaaggcccgtaagaaccgtctggcaaagcgccatgagtatgaggagctgaaagcaccgaccatcggcggcgttcgcatccccaacggcaacggccagaccatccgtctgcgtcagggcgcgtccctggccgatctggcggagaagatcaacgtcaaccaggccgcgctggtcaccgtgctcttccacctgggtcagatggctaccgccacccagtccttggatgaggagaccttccagattctgggcgaagagatcggctggaatatccagctcgtctccgcagaagaggaagacaaggaactgctccagcagttcgacatcaaccttgacgaggaagaactgcaggatgacgaggatctcaagcctcgcccgccggtcgttaccgtcatgggccacgtcgaccacggtaagacacgactgctggataccatccgcaagaccaacgtcatcgcacgtgaggccggcggcattacccagcgcatcggtgcctaccaggtcaccgtgaaccttgaaggcgaaccgcgcaagatcaccttcctcgatacccctggccacgaggcgttcaccgccatgcgtgcccgtggtgccgagctcactgacgtcgcgatcctcgtggtcgccgccgacgatggtgtgatgccccagaccgttgaggccatcaaccacgctcaggccgccaaggtgccgatcgtcgtggccgtcaacaagatcgatgtgcccggtgccaacccggagaaggtccgcggccagctcaccgagttcggcttggtccctgaagagtatggtggcgacaccatgttcgtcgacatctccgccaagcagaacctgcacgtcgacaagctgctcgaagccgtgctgctcacggctgacgctgagctggacctccgcgccaaccccgacatggacgcccgtggtgccaccgtcgaagcccgactcgacaagggtcgtggtgccgtggccactgtgctggttcagcagggtacgctccacgtgggcgatgccatcgtggccggcacttcgtacggccgcgtgcgtgccatgctcgacgagaacggtcagccgatggaagcggccggtccgtccacacctgttcaggtgctgggcttgacctccgtgcccaccgccggtgacctcttcctggtcgcctccgatgatcgtgccgctcgccagattgccgagaagcgtcaggccaccgagcgtgccgcccagctggccaagcgtcgcaaggtcgtctccctcgaggacttcaagaagaagttcgccgagtccgagatcgacatgctcaatattgtcatcaagggcgattcgtccggttctgtcgaggcgctcgaggattccttgatgaagatcgaggtatccgacgaggtcggcatccaggtcatccaccgcggcgtcggtgcgatcacccagaatgatgtcaacctggccacggtcgacaaggccgttatcatcggtttcaacgtgcgtccgaaccgtcaggtcgcggacctcgccgagcgcgagggcgtggagatcaagtactactcggtcatctaccgtgcgatcgaagacatcgaggcatccctcaagggcatgctcaagccggaatacgaagaggtcgtcacctctcactccgagatccgcgagatcttccgctcctccaagttcggcaacatcgccggcgttatggtgcaggacggcgaggtcaagcgtggtacgaagtgccgtatcctgcgcaacggcgtggccacggtcaacgacctcgagatctcctcgctgcgtcgcttcaaggacgacgttcagtccgtcaaggaaggctacgaggctggtatcaacctcggcaccttcaacgacattgaactcggcgacatcatcgagaccttcgagatgcgggaagtcgagcgcaagtagtcattgttaagccccctctgacgagggggctgtcagccgcagactgactgggggagagacatggtagttccatgattttctctcccccagcctcactgcgttcggcagcccctcgtcagagggggctcaagtctagaaaaggaaattcctatggcaggaaccaacccgcgcgccgcacgtattgcggccttgattcagcgtgtcgtcgcctcctccattgagcgcgaactgcatgacaagcgactcgccagcatcaccgtcaccgaagttcgtgtgaccaacgatttgcagatcgccaaggtctactggacccagctcggccacgaaggccacgaggaaggcgaacgcaagcgcgcccagcaggcactcgatcaggccaagggccacctgcgttctctggtgggccacaaggctggcctgcgcctgactccgcagctccaattcgtgttcgatgaagtgcccggcgaggctcacgagatcgaagacatactcgccgtggccaagaagcgtgatgaagaactcgcccgtgctcgcgccaccgcccagtacgccggcgacgccgatccgtacaagcatgacgacgagcccagcgacgacttcgaagacgactctgacgaggagtagtgtgcttcatacaacacccagcggtctgctcatcatcgacaagccgcaaggcgtgaccagcttcgacgccgtcgccgccgtgcgcggcgcgttgcacatcaagaaggtcggtcacgccggcacccttgaccccatggccactggcacgctggtcatcgccttcggccacgccacacgactgctcaacgccatcgtggcgcatgacaaaacctacgaggccaccatacgcctcggcctgcgcaccactaccgacgatgccgaaggcgaggtgcttgtcgatggtgaagcccgttcccgctggcaaacgctatcagcgcagctgactgagggtggccagagcggcgaaccaacggcgttaccaactgcctcatggcaagacctgctcacacgcaccatcgccaccaatttcaccggcgatatcgaacaagtccccaatacgttctccgccatcaaaatcaacggccagcgtgcctacgacttggctcgcgaaggcaaggatgtggaactcaaaccccgcccggtcaccatcagcgaattcaccgtgctggatatccgcagcggattcgtagcaggggagcaggccgctgaaccattgcgggaagacgcgaacacgggagcgattcccgcacttgatgttgacgtgcggatcagctgttcatcgggcacctatatccgcgcgctcgcccgcgatctcggcaaagaacttggcgtcggcggatacctgacccgtttgcgccgtacgcgagtcggccgattcgcgttgccggacgatgccagcggacttatcgctcctgaggcgatgcttgacacgcgaacccataccgtcaccgcacataccgatcagaagacgttcactaatcgggaagggcaaaccgtcacgcgcaacaagtgcgtattggacactcctgaaggtcttgccggtgacgagcgccgcaactggctgcttgaccatgcccttaccatggaacaggccgctcgaggtgcgatgccggcgcttgacatcactcctgaggaggccagcgaattacgcttcggccgccgtattgagcgtacaatcagcgagcccactgccgccattgtgccgcaaacgcatgatgtggcggcgattatcgagcgtgcaaacgctcatcaggccaagccggtcaccgtattccccctcgcgtaaagtagacgcggtgaaaagtgcagcttgatacaggccgcgcacaacaacgtctatattgcatgaataacatcgcacggataaaaggaacagcacactgatggatatcacgcacctgacccctgacgccgaaggttcgattgaatggccctcgttcagtaacgataagaaggccgtggtgacattgggcgcatttgatggcatgcacttgggtcatcaggcggtgatcaagcgtgtggtggaactcgcgcaccagcatgatgctttttccgtggtgattctgtttgacccgcgccccgcattcgtgcacggctgggtcatctcgcaccatggcgaagagcccgcggttcagaacgtggatgccgaagccttgaccagtgtggatgatcgactgcaccgcatggaacagttcggcgtggaccacgtgctggtggtgcactacacgctggccttcgcagctatgtcatacattttcttccttggccgactcaccggcaagctgggtatgcgcacgttggtccttgggcaggatgccgccatgggcaagggtcgagaaggtgatgtgaagcatatcgccaatcttgccgccgccaccggtgtattcgaacttgatgtggtcgatgaccgtggcccgggtgaagtgcgtattccgcgcgatttcaagccggaagccccgagcgaatggggagagcccgtcgacccgctgaccaatgccaccaaggccgagcgccgcgcatggagcaagaagaaccaggccaaggcaatgcgcgcatggagctccaccaatgtgcgctacctgctggctcatggccgaatccaggacgccaacgccattctgggtgctccgcactccatcgagggcgaagtggtgcacggtgaggagcgtggccgcaccatcggattccccaccgccaatcttggctccgacattgcaggctacattccggtcgacggcgtctatgccggttggctggtagatggtgagaaccgttggcccgccgccatctccattggcaccaaacccaccttcagcgagaaaacagggctcaacgaacgcgtggtggaggcctactgcatcactgacgaatggatcgacctgtacgaccacaaggttcgcgtcgaattcgtcggcttcctgcgcccgcaggtcaagtttgatggccccgaccaactcgtcgacgaactcaagcgcaacgtcgaggagaccaagcgtcttaccgcctgaggcatatctcagggctatttacgcactcccaaggcgtctaatgcgtcggacaatgtgttggactccaccagccgaagtccctcgacatgcaccggcttgcgcagcggaggaatgaccgccgtcgtgaaaccaaggcgcgcggcctcgcgaaggcgatattccatacgcggtaccgggcgaacctgaccggtcagggaaatctcaccaatggcgcacgtggctcgcgcaatgggttttgacgtggcggcgctcgtcagtgccgccactatcgccaagtcggaaccaggctccttggcctggcccccggcaatagtggagatatacaggtcgttggacagcaggttgagcttgctgtgacggtagagcaccgcgaccagcatggcgatacggctggggtccacgccattgaccgcacgacggggtgtgggcagcaccgacgtggtgaccagagcctgtacttcgataggcagactgcgatgcccatccaatgtgaacgtcacgcaggtgccttccacgggtgccgcgttggccgcatcagggccgtctccagacaggaacaatccggcgggatcggtgacctcttcgatgccctcaccgctcatgtcgaaacagccgacttcatcggtcgggccaaaacgattcttcaccgctcgcagcattctcagcgcagtctcgctgtcgccttcgaattggcagaccacatcgaccagatgctccaatgtgcgcgggcctgcaatcgaaccgtccttggtcacatgaccaaccagaaatactggaatgtcaagtgtcttagcggtatctatcagcgcgcttgccacttcgcgcacctgagtcgaaccgccggaaatgccatcgacctcctgcgagacgatggtctgcgccgaatccacaatggccaaggccggcttgttctgttcgatcagccccaatactgtggacaggtcggtggtggaggccagtaacaagttcggctccaccgcattgatgcgggaagcgcgcaaacgaacctgcgcctgtgattcctcgccggaaatgtacagcacggtgttggcgtgtgttgatgatgcgttgccccgcatcggcaccgtgtttgatgtgccgccctgcgctcggcccgactgttgggcagaccgctgacctgcccctcggaacgtactgtctcccgccacaacgcgcgcgatattgccggccgtctgcaacagcaatgtcgacttgccgatacccggttcgcccgctatcagcgttactgaacccggcaccacgccaccgccgagcacacggtcgaattcggaaaacccggtaccgagccgcttgacgctttccgtgcccacttcggtaatcggacgggctgcagatctggcgttgttggcaaccgtaaccgactgcgtgcgtgatgttcggccgggagcggccgtgcgagagcctgccgccggccgagcctcgtgaaattcctcgaccgtgccccactgaccacactcggggcaacggccgtaccacttcggcccgttccaaccgcattcggaacatacatactgcacacttgatttcgccatggtctcaccctaacccaaacaccagcggacggtaaatttttaccgttcacaagagtttcacgcggcttgcgcacaacgactaaaatcacggccgcctagcgtcacgcggctgtgagagaatcggggcatgactaatagtgagaactcctcgaccacgcaatcccatggcaagttgattgcagtggtggttgccgcagctgttgtgattatcctggcagtgctttcggcctttgtgtggccgggttgggccatccagaagaatgatggcacctccactaccacccaaaacagccagcagaaaaccgaatcatccgagccgaccaagccgaccatcgacgccacagctttgccggatgatgccagtgagctgttgaaggccatgccgggcagcgtgctgaattacgcgcgtaccaaggcggatgcctccacgacgtggaattccgcgtcgccgctcgaggagtacactctgacctactccactggtgatgccgccaaggatgtcacgctggtcgccgcgcagtggtcgtcggcggacaatgccaagacccagtacgatgcgttggtcgctgcgcagaccggcgatgagtcggcatccggcaacgtcaaggtttccggcaacgtcacgggcgcgtacgtggtgaaggccgatgcctccaacagcaagaacgccgttgccatctggcagaacgataccgtggtcttccaagctaccggcaccaaggaagcggtcgatcgcttctaccagaagttcccgatgtagcatctagtatcggctgtcagctgctgcacaaacttatgaacgttggggcatccacattgctgatgtggatgccccaactgcgttcagggcatatgcggactatcggcaacatactggttccctctgtctggcaacacgtgtattattgtgcgagttgcaacttttacgattaatcgaaatggaggcttcagatgggttctgtcatcaagaagcgccgcaagcggatgagcaagaagaagcaccgcaaactgctgcgtaagacccgccaccagcgtaagtagtcttacctgcaatcaaggcattagaaaccccgtgatcgttatggtcgcggggtttctcttttgcttggctctttgccttgttcgggcaacagtaaagcccgcacctgcgatgtgcagatgcgggcttggaaaagcttagtgatgtgagacgatcacttgttggcgttggtcatcacgcgcgggccgttcgggtcgccgacgatgaccttgtcgaccatgttgaggaacaggccgtgctccaccacgccgaccgtgttgatgaggtcttcggccagctcctgcgggtgatcgatgcgctccaggtgcaggtccaccacgaagttgttctcgtcggtgcgcacttccttgccgtcggcgtcaagacgaagcaccggcttgtagccgcgggcctcgaacttcttgatgacttggccggcaccgaacggaatgacctcgaccggcagcgggaacttgccgatggtgtccacaaccttggactcgtccacgatccacacgatctggttggagttggtggccacgatcttctcccacagcagagcagcgccgccgcccttgatgccgttgaagttcttgtcgacttcgtcggcgccgtcaatggtcacgtcgatgtggtccacgtcgtcgatgtccacgatcttgatgccgtagctctcggcctgggcctgcgtgcggcgagacgtggtcacgccagtgaactcaagaccttcctcctgatgacggcggccgagctcgtccaccaggaacttcacggtcgaaccagtgccgaggcctgcgatcatgccgttttcaacgagcttggcggcttcgatgccggccgccttcttcagcgcatcctgctgtgccttatccatggtttctcctttgccatccttgcctccgccgcacggatcaacggcgtgaagccttatctcctatcctaacgcgaatgagcgattttgtgtcatcgtgtccgattgcggtacatattcgtgtgtttgggtgtcagtgtcgtacgaatggtgcgttggtgatggtcaggttgccgtcgccgtccacatagccttcgatttcgatgctgcctttgatcggcatcggctgcccgttgaaatacgggctcgttttcggcgcgggggagaaggtcagcgtaccggataccgtcagcccactgggctttgcggggggtacgggttgtgttgattgtacgggttgtgttgattgtacgggttgtgttgattgtacgggttgtgttgattgtacgggttgtgttgattgtacgggttgtgttgattgtacgggttgcgttgattgtacaggttgcgttgattgtacaggttgcgttgattgtaccgctaagggtgacgaagacttggtctccggccttgcggcatccgtctgatccgtcgccgcagccggcttgcgcaaacttgccgcatccgctttgccgtccaataccaattgcacgtctggaggcacatcggtgccatgtgcgtattcggagcccagcagcgactgccagccttcaatcggtagatagccgtcgcgcgcacccgaacggcaatcgcccgcataggtgcgtgccagttcatcgaccagctcattgccttcgttgccggcgtgacctttgacccatcggaaatccaccgggccagggcgttgtgagatttcgcggtcgatcgcctgaataagctctttgttcttcacaggttttttctgtgaatttttccagccgttcttcttccagcctttgacccacttggtcgagcaattgatggcgtattgcgaatccgattcgatgagcaatggctcagggcccggatgcgctcgcaaagcttccaacactgcgcacagttcgccaatctggttggtgccgttggtcgcgccgccggcgtcgtagccgtggtcgtcgtgcttatggccaggcttgccgccggcgttctgctcatgatcggcccaggcccagcccattggcccgtttggattccctaatgcggaaccgtctgtggatactgtgatagtcatgttctccaccctaacgcaagctgtgcaatctcttgctgaagtggggctgcccagcgcgaggcaaaacaacgtagtggagggtgtggataacatcacacctattgactttgcttgaaaaacatgccatcgcgcgtgaataggtgagcgctcacaagaaaaacaagacatttcctctctgtgggtgaggccggcaacaatggcgcatccggtatctggaatgagaataagggactgtacaaaaccagtgacggcaacatcgaaatcctcaaaccagaggcggacagcgatggttcgacctccacggccgcatccaagggcaccatgcttatcgcaggcaactccaaaaccgtggcactcggtccaggcggcatggccttggctcccggcctgccgctcggtcttggctggttcatccgacgccgtttaggattggatgcctccgacattctggaccgtaagctcggcttgaagtaacggctggttcggacgtgattgctgtcacgtcctgatcatgacgacagcgcgaaggtcctcatcggtttacgtcgatgaggaccttcgcgcgcattaggggagtctgttgcgggctgcgctacgcgggtcatgctgcgcgggcgtgctatgcgaacaaactacgcgaacaagtcgttcagtgcctcggcaatcgtcggatgcgtgaacaccatatcgcgcaacgtgctggccggcgcgtcaagatccatcgccaacttgacgatattgatcacctcgtgcgactcgacggaaagcagcatcgcacccagaatgcggccagtattgcgttccacaatcgccttcatcagaccatccggtcgccgcattacctgggccttcggcacagcggccaccggcaatcgcttgaccacataatccaatccagccgccttcgcctcgcgctcattcaatcccacgcgcgagtaaggcgtggcgaggaatgtgcttgacggcacatgcttgcggtccttcaccgtgtacggacggtcggaaccattgagctgcgaccacaccacgcgatagtcatccagcgaaatgtacgtgtgctgcgggccgccgttcacatcgcccagagcccaaatgtcggctgctgtggtgcgcagaagctcgtcgactttcacggcaccgcgttcggtgagctccacgccagctgcctcaagatgcagtccctcgacgttcggcgtacgtccggtggccaccagtaccgcgtcggtggtcaggcagaatcgggcttcagccggctcggcgaaccgcggctcgccatcgtctgatggtttcgtttgaacgtgtgacatcgtggcgtgatcggtcgggttgctagtggggctggtggttgttgtagtgtcggtggcaccggtgatatcggtatgagcgttcccggtgccggcgggggtggaatcgcaagcttgcgatgcgccgcgagtcatacccttcaccgcaacggacaacctgacgccgccgtcagcagcaggcgcgatggccttggtatccgcgttgaacaggaacttgacgccctgcgcttccaactgtgcgcgaatcgcggccgccacatccgcatcctcgcgcggcaggaactcggcattgtgctgcagcacggtaaccgccgtgccgaaatcggcaaacatcgaggcaaactcaagtccaatgaatcctgaaccgataatcaccagtcgctgcggcatatcgtcgagatccatcagtccagtgctggtgtagacgccgggcgtagtgtggataccgggaatatccggaatgcgcggcgtggcaccggtattgatgaagatcttgctggcggtcacggcgaccgggccctcagcggtggcgatttccacgctatgagggccggtgaagtgagcacggccggtgattacggtgatgttgtcttggtcggcgagcttgtgatagttcttgtcgcgcagcatcgaagtgacgcggcgcttctccttgatagcagcctcgaacgctgcttcgcgggtttcgggagtactgttcgcgccatcccgccgcgcctgttcggcggacaaaatcagtgacttggacggcaagcatccgatattgatgcaggtgccgccgtacatgtcggcgcttgcctcggcgacgacgaccttgcggccggctgcactgagcttggcagccaaggttttgccgcccttgccgaatccaatgatcagggcgtcggtggtgatagtgggggaggtgctgggtgtgctgatggcattgggtgtgctgatggacatggttacttccttacgtattcgagtgataagagtgcgttgtgctgatgtgttgtgtgccgtgcggcgtctgttttcttctttgactgccgaagcgttatcgactgatgctggctaggggaaacgcgcgggattattagcctttgcgctcgctgaatatctgttcggtgatgtcgtggatggtggtgtgttcgagttgttcgaggcaagtgcggttgagcccggcatagatgtcgttcatcactgcgcccattgaagatgacaccagacagtcctcgtgtacgtcgcccggtgtccagttcactttcacaaaagtggtgccggtggcttccgctaccgcgcgcaaagtgatttcggcggcgggccgggccagagcgtacccgccttcagcaccctctttagtggcgatgagtccggctgaggcgagcggtcgcattactttgcgcacgcgcgccgcattggtacatatgttctcggccaggatctgactgggcaggtgtgtggcgcgatggtcaaggtagaccaatgcgtgcactgccagtgaatggtcgccgttcatgaaacgacctccttaccgagtcgatactgtagctatgatgtgtacagttatgatactgtaatcatatcagatacagttagtgtgtcaaatcggggttgaagaggtgggtgactatgtgtataagtgaggtgtccacatggttatccacaatgaatgtgcgtaagtgaagctaggaccacatacctcggatcggcttccgtttccgcacccactacccatatggtggtgtcatgaacaggatgaccgacggcatcaccaactatggagctctgccaggctctatatacgatcagcctccggaagaatcggaggcagtttttgttccgcccgaatttgcggggtcattttctactgactcgaaatacccgacttctcgcgactcgtcatcgccgaacagtggtgcacatgattctgcagcgacaccgaccatgagcgaaagcctcgcccagcgcaaacgcgacatggtcgcacgctgcactgaggaagcgaaacgggcgggcaagaagctgcttttcggcatgaccacttccctcgctctgcaatccgtaccgattcccgccgattgcgacctcgactcggccaagctgcacactgtatccagcgttaagagcaagcggtttcgtacacgccatgcaccactgcaaacgcatatttggaaacatgcggctaaagccgccaatgtggaaatgaaccaacacgtgtttgcgctggacctgtttcacgtatgggctcaacttgccccgtatgtttcttttgagtccctgattgtgctcggggatgccgtcatcgctgctacgagcaaacagccagtattggccaaggatcgtgatgctgctgcaatctatcaggatctggtgaggttcgtggagcgatttacccgattcagagggcgcccgtcctgcgttcgagcattgccgctgatatcacctggtgctgattcgcccaaagaatcagaagaacgactctctctggtagcgcatgggattccacagccggttgcgaactatgtggtgccggatgcggcttttgcatctggagctcccataacgttggacttagcgtggccagagttcaaggtcgctgttgaatatgatggcgatcatcatcgtacgagtaaggctcaatggcgccgtgaccaagagaaaaggggtgtgctggtcgggcggagatggctggtcttcgtcgccacggcggcaagtatcgctaacgaggacgctcgtgctgaattcgctttcaacgtggcgagggcgcttgcttcgcgcggtgccgtattcgagtttcatgtagttgccatgtctcttgaagagttgtcgcagagcctgctgtgaccatgatgtccgaaatggactgatgtaaaggcaatatttgtacgacctgttgttgtggtgtgtgcttgatattgcatgccgttcgattgcgatgcctcgtagtgatggatttcgtgaatgactagtgttcgattgtggagggaaatgtgtcatagtggtcgattgggggggcggtgcattgggcgtggatttgcgccaatgggtgtgggacgctacgcgtgttttgccgatttttgcgtggcgtcccacggcccctcgggtaatggctgtgacgggtgtggcaggaatggcgtctttccggggtttccagtttgagtgtgtgggatggggaaaatgtaaaacgattgacttagctgttgtcccacgcttttgtgggatggcaactctggaatgggcaaattcgtcgtggcgtcccacaacgatgttaaaactcgaccatgatgcaagccgaccgaacgcttcggtggtcatctggccgctgtgaccccacaatgatgatgggaaactcggtcataatgtaggcaggcgaacgtttcgcggccatatggccgtcctgccctgcagtgatgttgagaaaatgcggtcacggtgcatgaggagaaccgttgacctgcgtgtttcagtggtcgcgaactgcatatgcgctaaaaaaagctctgcagtggattgcatgaatccaatgcagagccttattggttgctgtgaacgcggctaacgcagcgatttcactcgctcagggccttgtctaccacgacggtggcctcgtcgagcaccttgtccagagcctcgggggagacgaaggactcggcgtacaccttgtagatgttctcggtgccggaggggcgggcggcgaaccagttgtccttggtggtgaccttcagaccgccgatcttggcgtggttgcccggtgcctcggtcagcttggcggtgatgtcttcgccagccagctgcgtggcggccacatcatcaccggtcagcttggcgaacttggccttctgctccagcgtggtcggggtgtcgacgcgcttgtaccaagactcgccgaagcgctcgacctgctcctggtgaagctgggccgggttcttgccggtcttggcggtgatctcggcagccagcaggtcggggatcagaccatccttatcggtggtccacacgcggccgtccttgcgcaggaagctcatgccggagctctcctcgccgccgaaggcgacttcgccgctgaacagcgggtccacgaaccacttgaagcccaccggcacttcgatgaccttcgcgttgatcgatgcggccacgcggtcgatcagggaagaggagaccagcgtcttgcccacggctgcgccctcaggccagcccggacggttgccgccgaacaggtactccacgcacacggcgatgtagtggttcgggttcatcacgccccagttcgggcagacgatgccgtgacggtcggcgtccgggtcggtgccgccgaccagatcgtacttgtcccaagcgccggcgttgagctcgtcgaccaggcccttcatggcgtacggggaagacgggtccatgcggatcttgccgtcgtggtcgatggtcatgaagcgccaggtcgggtcgacctcaggacgcaccacgccgatgttcaggccgtacttctcgttgatgagcggccagtagttcacggaagcgccgccgagcggatcgatgcccagacgcacgccggagttgcggatcacgtcgaagtcgatgacgttctccaggtcgtccacgtagtgctcgcggaagtcgaagccctcgacgtactcggacttgatggcctcctcgtagggcacacgcttgatggacttgaagttgccgagcagctcgttggcgcgagcggcgatggcattggtggtctcggccggagccgggccgccggtgacggggtcgtacttgaagccaccgtcggtgggcgggttgtgggacggcgtgacgacgatgccgtcggcgaggccctcgccctcgaagcgctgggtgccgtcggccgcacggttgtgggtcaggatggcctgggagaccaccggggtgggcacgaagtcgtcacgggaatcgacgcgcacgtgcacgccgttggcgacgagcacctcgatggcggtcttcttggccgggccggacagcgcgtgggtgtcggagccgaggtacagcgggccggtgacgccggccttcttgcggtattcggcgatggcctgggagatggcgatgatgtgggcctcgttgaacgaggtcttcagggacgatccgcggtggccggaggtgccgaagatgacacgctgctcggggacttcgggatcggggacgaggtcatagtatttgccgataacctcatcgacattgatcagatctgctggggtggcgggctgacccgcattgtttgctaccatgctccctattctgccacgttttttcgccacgttgggtacgattatgttaagagttgtcaacttttgtgcgaatcgtgtgccggttgtctagcgcttggtcatttcctcctcgatttcctccagcgacttgccgttggtctcgggcaccaagcgcatcacgaacgggatggacagggccgaaaacacgccgaaaatcgcgaacgggccgcccacattgttgccgaacgcatcgagcagcacgaggaagaactgggagacgatgaagttgcccagccagttcgccgccgagccgaaggaggagccgatgccgcgcacgctcagcgggaagatctcgccgataagcacccaggcgatcgggccccacgagaccgcaaagccgaggatatagaaagcgatgagaatcatcgtcggcacggccagcacggccacgtcgcccacgaagttcatcacggcgagtactgcgagcgaaacggtcatcacgatggaaccgaagatcagcacgcccttgcgcgggaagcgatccatgataagcgtggccacgatggtgctcacgaagttcaccacgccgatgcccaccgacacccagattgcgtcgccttcagggaagccgaagcctttgatgaacacctgcggcaggaagtagatcaccgagttgatgcccacgagctgctggaacagcatgatgccaatggcggccaccagcgccggacgagcgatacggaacagttcgcgcacgccacccttggtgtcctgtgcggccacggccttgatttcgtccagctcaatctgcacctgggtctgatccacgtccttgcgaatcagcgtaagcactttgaaggcgttgcaggtgtcgcccttgttcaccagataacgcggggattcgggcagcagcaggccgccgagcagcaacaaggcggccggcaccagcgccgaaccgagcatccagcgccagtcgcggatgccgaagaggttgtggttcaggaatccgaggttggaggcgtaggccagcagaatgccgaaggtgaccatgagctggaagagcgtggacagcgagccgcgacgctccttcggcgccagttcggccaagtacgccggggtcagggcagaagccgcgccgaccgcgaggcccaggatgatgcgggcgcacaccatcatcgcgaatccggtggaggaggcgcacaggcctgagccgagcaggaacagcagcgcggagacgatgagcagcttcttgcggccgaaccggtcagacagcgcgccgatcgacaacgcgcctgcgcacgagccgatcagcaccgaggaggtgatgaagccggtctgggagacgctcaggccgaagtctgattcgataagcggggaggcgccggagataatgccggtgtcgaaaccgaacagcatgccgccgagcgcgccgaaggtgaagatgaatgcgctgttgagcgggaagcgcgtggagaagccgcgtgattcggcggcttcgaggtcctcgattgcgtttgctgccgcgtttgtggccgcgtccgccacctcggccacgccggtttcgatggtttcgattgcggtggccgctgcaccggttgcgccggtctcctgtgccgcggatgccgtctgcttcgatacgggtgatgccgttgtcgtcgtcattgccttgtcctttcgccgttgacgggccgcgcctgccgcgtggcccctctgccgcatgcaaggtcaggcttcgattgcctgaagtcgcccgaaaacaaaaaaagacctggaacaacgtggaattcgcatattacgatacgcaaattccacgtcactccaggtcttgcctcattttgagtaacaaccctgctacgcaacgtgtgtgaaagataggatacgactttctcggtcgcgacactccgaataggcggcaaaaaacgatgttttttgacaacgattgcaggattctgcatggtggaatgaagtcggaatgggcgctgcggcaaatacggagaacgggtgcggcggaacaccatagcggaacgctatcgcggagcaccgtagcgcatagttgccgtttcgcgatgctttgccggcattgccgtgcttttggggcacccagcgccgataatggaacacagtggcatacggcagcaaggaggaaccgtggcgaacgcatcgaacgcaacgcctgcagtgattgcggcgtgcatcgttgatgccgtcggcggctccgcgaacatcaccaacctgacccattgcgccacgcgactgcacttcgaactggacgacgccggccaggtcagccagcacggtctcgaatccatccccggagtcctcggcgcattcccgcgaaccggcaatcgttatcaggtcatcatcggcggagcggtcgcctcggtgtacgagcagatcgttcggatgcaggcagcgcgattgactccggcaacgcaattaccatcggcggcgtcgcggccaacgcagtccgcgcaatccactcagtcaacgcaatccactcagtcaacgcaatccactcagcctacgcagcctacgcagtccgcgccgaacctttccgacgacgtcgcaccattgcgcgataccgacaccgagcagagtcacggcccagccaatacatcccgtcacttcatgcctcgtaccatccgcgagtggggcagtgccgcccgtgcccgggctgccgcgtttttcgactacctgtccgactcgttccgcccgattctgggcgtgctactcggtgcctcgctggtcatcgccatcgtcaacgtgatcgttgcactcggcattgtgcctgatggcgagacgtccaccggttggatactactcaaggcgatttgggagggtgtgttcaccgttctgccgattatgatcgcttacaatgcggccaagaaactggacgtcgacccttggctcggcggtgcgattatggccgcgcttatgaccccgcagcttactggcgtgatgtccggaatgtccgggacgtccgtatccagcgctctctccggggagattcaatgctcggccaccgccgtattcggcgccgaaacctgcaccgtgtcggcgttcggcataccgattcaactcaacgactacagtggcaacatcttcgtaccattgctcatggccgccgtgctcgccgtggtctaccgcgggctgaagcgcgtcattcccgacagcgtacagctggtgttcgtgccattcctctcactggtcgtcgtttttgcgctcaccatactggttatcgggcctctgggaatatggctcggcagcgggctgggagcggccacagcatggcttaacgcgcacgtgccattcctgttcgcgctcatcatcccgatgctctacccgtttctcgtgccgctcggtctgcactggccgttgaacgccctgatactgatgaacattcagacgctcggctacgacttcgtccaaggtccgatgggtgtatggaacttcgcctgcttcggtgccaccgccggcgtgctcgtgctggccgtacgcggcaaggattcggccatgcggcagaccgcggtgggggcgttgctcgcgggattgctgggtggcgtttcggaactgagcctgtacggcatccatctgcatcaccgccgcgtctaccgctggctgctcgccggctgcgcggccggcggagtgaccagcgcggtgttcggctggctgttcccgtccgtgctgccatccggccagatggtccggggcgttacgactacggcattcgccttctcctcgttgctgacgattccggtgttcgatcggatgtgggtgtacgcgctgtccatcgccgttgcgtttgtaatggcgatggtgttgacggtgttgttcgggtaccgcacgccgtcgcgcgccaccaagacgcagatggtctcggcaaacgagaacgcacgcccgcaggatatggcgagggggattgacacgaccgtgtcggatgtggagtctgcggaagattctccatcgcgggctgcccctgatcgggctcttgactccaacgccatcttgtcgccggtcgccggccggctggtgaatctggaagcgactggcgatccggtgttcgcctcccgcgcgctgggggagggcgtaggcgtcgtgccggagacgaccggtgagacagccgtgctcgcaccggtcagtggcatgctgaaaaccgtggcccgaaccggccatgccttcggcattaaaaccgatggcggcatcgaggtgctggttcatatcggcattgacaccgtcgatatggatggcgagggattcgctgtggtcgtggctaaaggcgagcggatcgcggcgggagagccactggccaccgtggatttcggcaaagtcgcggcggccgggcacagcgttgtggtggtggtgacggtggtcaacgccgctgaactgaccgtggtcacgccgttgatcggcgacggtagcggcgacaacaacggcggtgactgcaaaaccgtatcagccggcagcccgatcatcgatgtggaacaatgacgttgcgaaaggatgccatggaaatactgcgagtgttcaacaacaacgtcgtgctcgccaaaggcggcgacggcggtgaggtgattctcaccggccgtggactggggttccaggccaagccggggcagacggtcgacgagtcgaaagtcgtgcgcaccttcgtgccgtcggacgggcgtgacccggaccatctggcgcagatgctggcggacattccgcccgaaatcatccgcgtggtcgtcgaatccatgcaggaagccggactgggggagcgtgagaccggcagcaccacgctggtcatggccttgtcggatcacgtggcgaatgcggtggagcgggtgcggcgcggcatcgacattacctacccgctgctcggcgaggtgagcaacctgtacccgcaggaatacgcgcaggggcgtgcgatgctcgcatcgctcaatgcgcggctcgacgtcacgctgccggacggcgaggccaccgcgcttgccatgcatctggtcaacgccggcttcgccaccggcgacctgtcctatacgtatacgatgacgggcgtgatccagcaactgcttgacattatcgaccacagctacggcatcacgttggaccgcagttccgtgaatgtgggcaggttcatcacccatctgcgttacctgttcgtacgcatccaccagcaccagcaactgacggatgagccggcaccggtgatgaaggtgattcgtgagtcctatcccgccgcgctacgatgcgcgcgaaccatcgcctccctgctcgaactgcgcctcgacacggatatcagcgacgacgaaaccgcctatctggcaatgcacgtcgcccgagtcaccggccacgcatcgtagcggatcagcgaatcggctcgagcgtgccggtcatttcggcgaaatccgaggtggcgtttgaggcagcggcctgtgcggtcttttccagcgcggaggcgtcgggtacgcgcacgatcagcgcgcgatgatccactgagaaacgaatatgtttggtctccggtagcatgtcgccgtccacctgcgctttggccggcttttccaatgtgatttcggcactgacgccctgaacctgttcgatggtcgagttcgtggacagcgggttctgttcgggcttgccgatgatcgtctggtgcaccacgtcgccgaacaggttggcccagccgaggatgccgccggtggtgtcgatgatttcgaagtccagcagaccatcgtcataggatgccgccggcatcagcgagaacatgggaatctggccgcagttgccggccatcaccgtgcggaaatcgagattcttgatggtgtgggtcgagccgtcggcgctggtgactgtcagcgtgccgcggaacttcggcgcgaacaggttcttcacgccgcccacgaagtaggcgagccagctgatgttcgccttgagctcggggttggtgtcgtcgatcatggccgcatcgaagccgatgccggcgatgatgaggaaggcgtggccgtggtcgtcctccgggtggtcgagcagggtgagacggcccatgtccaccaggcgggagccgtgggaggtggccacggtcagcgcggcgtcgatatcgtccacgggaacgcccatattgcgggcaaacaggttgccggtgccgatggggatgatgcccagcgcatggccggtgccggagacggcgctcgccaccgtgcgcaccgtgccgtcgccgccgaccgcgatcaccacgtcggcgccgtcctccagcgcctcaagcgcgcagaccctgccgtccttgtcaagctgggtgtcgtagaagcggatgcgattgagccccttggcctcgcagaacctctggatatgcagcctgcgggcttcggcctgcggtttggacggattcacgatgaaggcgtactgcacctcgtcgtcccggcgcttctccagcgtctgagccagcttgcggcggcgctgcgcgcgcagagcgatgacgatgacggcgatgagcaccaccacaatggcgattgcggcgatgatcagaaacacggtgagggcaggctgaggcatggctcctattgttatcggtggggaggtcgtttgcggccatggtgcgccgtacgtgaacatttcctgcacgcaacagccccgtggggcgtgattatggttcaatcgcgtctcatctgacgaaattggccgggtggacccgtccgcggactttcccgggcttccctgtgatttccgcgtgactcccgcgcattcggccattgtcggtgtctgcttacgcggctagtctggtgcccatgcttgatattcaattcatccgtgaacacaccgatatcgtcaaggaatcccagcgcaagcgcggcgagtccgtggagctcgtcgacgaagtgctctcctccgacactgcacgtcgtgaggcgctgaaggccttcgaagaggctcgcgcccagcagaaggaaatcggcaagaaagtcgcctccgccccggcggacgagaaggccaagctcatcgccgaaaccaaggaactgtcccagaaggtctccgaatacaagtccaaggccgattccgcagccgaggaatacaccaccgccatgtggaagctctccaacatcgtggagcccgaagctcccgaaggcggcgaggatgactacgtggtcgtcaagaaggttggccagattcgcgacttcgcggccgaaggcttcgagcccaaggaccacctgaccctcggcaccggcgtggccggcatcgatatgcgccgcggcgtcaaggtcggcggctcccgcttctatttcctgcgtggccaggtggcccgcatgcagattgccatgctcaccatggccgtggaccaggccgaagagcacggcttcacgctggccatcaccccgacgctcgtgcgccccgaggtcatgcgcggcaccggcttcctgaactcccacgccgacgagatctaccgtctgcgcgagcccgatgaccagtacctggtcggcacttccgaagtggcgctcgccggcatgcacgagaacgagatcctcgacctcggcaacggcccgctgcgctactgcggttggtcctcctgctaccgccgcgaggccggtgccgcaggcaaggatacttccggcatcatccgcgtccaccagttcgacaaggtggagatgttcgtttacgccaagcaggaggactcctacaaggagcacgagcacctgctggccatggaacaggagatgctcgccaaggtcgaggtgccctaccgcatcatcgataccgccgccggcgacctcggttcctccgccgcccgtaagttcgactgcgaggcttgggtgccgacccagggccgttaccgcgagctcacctccacctcgaactgcaccgagtaccaggctcgccgcctgaacatccgcgagcgtatggaagacggcggcacccgcccggtctccaccctgaacggcacgctggccaccacccgttggctggtcgctatcatggagaaccaccagcagaaggacggctccatcgagatcccgaaggccatgcgcgcctacatgggcggcaaggaagttatcgagcccacgaagtgggaggcctgagtctcatcgtgctttagctccctctgatgagggagctgtcagcgtagctgactgagggagagattactgagggagagatcgctgatagccagcaggcgaatccaagaccgaccgcactgccgaatatcaacatccctcccttctgtataatgaatacttgcgcgtgtgaacgcgcatcaggacaggtgtctgagcggcctaaagagacggtcttgaaaaccgttgaggggcaaccctccgcgagttcgaatctcgccctgtccgcgaaccgaggcctgggcaacatgcccaggcccttttttctttttctggaacctgtcttcttgattgccgccggggtgctgatatattggtttgtgatgccgtaacatgcggtgtccccgttgatatgacgggccgatcggcgtgagccgataagaaaaggcccgacgtttgcagcatcgggcctttgcgttgattaccggcttgcgcctttaatcaacaaggttgcaagatgaatcatatcacgatgcacggtagtctgaccgtgaacgggcgcaccgtgatcgtccatatgggcgatggcgaggcgaacgccacggttgacggcacgcacttcaacgtgcgtagcctgtggcagctctaccagttgctgagactgctcgtgtagcgtctcattaaggtgcggtgcccccctggtcgggtatcgcgccggcgacctgaaaaccgataatgttggcaagtgcttgcaatttgcggtggacgattgcaagctaacgtcttggattgttgccgctatccaatatctcattaggcctaccggtggaccaaaagtacgttgctttgtaaggggagttaatgaaatgaacaaactcgcacaatcgagcatcgaaccggtttaatgctactcgcctcaacgggacgcgcggtaattgttagctaagttgacaataaaagaatgagggcatacattagtaatcagtcatcacactgagatgatgatttcactacgaaggagtagagatatggtatctcgcaataagcgcatcgtggctgcttttgccgcggtagcagcaatgggaatgggcttggccggttgcggcagcgacactgccggcgacacgaagaccaccgatgatggtggcgtggtcaacatcacctacatgcaccgtctgccggattccgagggcatgactctggtcaacgacatcgttgccaagtggaataagcagcatccggatattcaggtcaaggccaccaagttcgatggtaaggcctctgacatgatcaagaagcttgagaccgacgtcaagtccggcgaggctccggatctggctcaggtcggttacgccgagctgcctgaggtcttcaccaagggtctgctgcaggatgtgacccagtatgccgagcagtacaagaacgacttcgcatccggcccgtacagcctggttcaggttggcggcaaggcttacggcctgccgcaggacaccggcccgctggtttacttctacaacaaggctgagttcgagaagctcggcatcaccgagattccgcagaccgccgatgagtttatcgccgctgccaagaccgctgccgccgctggcaagtacatcatgtcctaccagcctgatgaggccggcaacatgatctccggtctggctggcgcctccggtggttggtacaaggtgaagggcgactcctgggtcgtcaacaccgagaccgatggctccaaggcaaccgctgacttctaccagcagctgctcgacgccaaggcagccaccaccaacccgcgttgggatccgtccttcgatgcatccatcaaggatggctcgttgatcggcactgtggccgccgcttgggaagccccgctgttcatgacctcctccggtggcaccggctccggcgaatggcaggtcgctcagctcggtgactggttcggcaacgctggcaagaccggccctgacggtggttccgccgtggccgtgctgaagaactccaagcacccgaaggaagcaatggagttcctggattggttcaacacccaggttcctgatctggtttcccagggcctcgtgccggctgctaccactgaagacgctgagactccttccgagtggtccaccttcttcggtggtcaggacatcatgaaggaattcaagaccgctaacaacaacatgggtgacttcacctacatgcctggcttctccgcagtcgccgccaagatgaacgaaaccgccgccaaggccaccgatggctccggcaaggttgcagacatcttctccgacgcacagaccacctctgtggatacgctgaagaacttcggcctgtctgtttccgagtgacattaacggttagggttccttccagccgctgatatcctcaaccacacatcgaaaggccggagctcaacactccggcctttccttttactcgagttcggttcgtcattaattgtgtttgatctgactgcatcgattcgaactgcattacgtactttctatttctcactgttcttttgaaagacaggtttccctatgactgcaacaacaaaaacggcgaagacgggggtcgccaggcgtgccgataagccaaaggcttctgatgctgtgaagcgtgagaatcgtaccggctgggccttcatggcaccgtttggcatcctgttcgctctggtatttattcttcccatcatttgggctatttattccagcttcttccgccaggtcaccacgggcggtggcgcatacggcggcggggaactggtcgataagttcgtcggacttcagaacttccaatacgttattacttccggcaacttctgggctggcgtgggcagggtagtgctctacaccgtgattcaggtgccggtcatgatcatcgcggcacttgctctggcaatgctcatcgattcctatatcgtcaagcacatcaccgcattccgtctgagctacttcctgccgtacgccattccgggcgtggtcgcatccatcatctgggtgtacctctacaacggccagatttcccctatcgttaagggacttgccgccatcggcatcaaggtgaacttcttcggcgacaatgtggtcctcggctctatggccaacatcacgacctggaccttcaccggctacaacatgctgatcttcctcgccgcactgcaggccattccgcacgatctgtacgaggccgcacgcatcgatggcgccagtggcttccagatcgccatgaagatcaagctgccgaacgtgcgtgcagccgccctgcttgccatgctgctctccatcgtcggcaccatccagctgttcaacgagccgcaggtgatgtcgatttccgatccgagcatttccaagtcgtacacgccaatgatgatggccctcaatacctcgcagggcacgctgaccccgggtggtgacggacctgcatccgctgtggccatcgttatggcactgatcgctggcgtactcgccgtggtctacacgctcgttgaaaggaaggtgaacgcagaatgagcaccgtagaagctactgataaggaatcccgcgcggtcgcacgcgctcgtaagaaggctgacaggattcgcgacaagcatgccaacgacctgcctcgttccatgcagccttccgcgctggtcaagaccatcaccatcgttgttctggtcttcgcgctgatctactttctgttcccgatttactgggccatcatcgcctcgaccaagacgccgagccagatgaccggcagcaacggtctgtggttcgccgtgggtctgagcgatttgcctgccgccatcgccaagaactatggcacgctgattggttggacccgtggccagttctggcgctgggtgctgaactccctgatctactcgggtgtttccgctctggtgggtacgctcgtggctgtgatggcgggatacgctaccgcaaagttcaacttcaagggtaagaaccttgccattggcgtgattatgggctgcatgctgatgccggccgctctgctgaccattccgcagtactccatcttccatgccatgcacctgaccaacacgatgctctccatcatcatcccgtgctgcgtctctccgttcggcttcttcctgggccgcgtatacgcgcagacctcagtgccgaacgagctgcttgaggcggcgcgtatcgatggtgcaagcgaagctcgcatcttcttcaccattgtgttgaggattctggctccggcaatggtcacgatcttcctgttcctgttcgtggccacttggaacaacttcctgctgccgttgatgatggtctcttccgacaccttgaagccggtgaccttgggtctgtacggcatggtctctctggctaccttcactgatcgtggcgctctgatgatgggtgctctgctcggtgtgctgcctgtgatcgtgctcttcctcggtctccagcgctactggcaggccggcctcgccgctggtgcggtcaagggctgacgcgttaagcggacagcccggtgggctgtctgtagcgtcggcccgagcgaggcggtagccgagcgaaggcagcattgagtctcgccgtaggcgagtccttaattgcaggggccgaaggcgacgcgttaagcggacagcctaagaccaataattcccgccgtccggtgcctcgtgctactccttccggcgccggacggcttctcaacaataagtagcacgcaaccataccgatccagagccttcctgattcttgtcatgagattgtcggtgaaactgaccgggaagctccggtgatgttcaattcgctcttccggcgttgccgtggggctactctcaaggatttatacagtcaggatcctggacgcccgacggttgtgtcggattcttgttttatatgcatatattgtttacaatttaattatccaaaaaaataatcaatgtcctcaaaggagagactatgactagcaccggccgcttcaccttgcctagcgaggagaattttgcggagaagaccaaggagcttgccgaactgtggggagcggacgccattcgtaactccgatggcacgcatctggatgaggctgtgcttgccttgggcaagaagatttacagtgcgtatttcccgactcgcgcgcataacgagtggattacgctgcatatggatgagacgccacaggtgtatctgctgaccgatcgcattctcgccgaatcggatacggttgatattccgctgatggaaagcttcttcgctgagcagctgaagccgaatcgtgatgccgaccctcacaagtattgggaggttgtagaccgcaccaccggcgaggtcgtcgattcggcgaactggacgcttgacgcggacgaggacaccgtgcatgtgagcggcgttgccgcatggcatgagtacacggtgagtttcctggcctacatcatctgggacccggtcgagatgtacaaccatctgaccaacgactggggcgacaaggaacacgagatcccgttcgacatctaccatccggccacccgcaagttcgtgttcgacacgttcgagcagtggcttaaggacagcccgcagaccgatgtggtgcgattcaccacgttcttctaccagttcacgctcctgttcgatgaaaagcgccgcgaaaaggtcgtcgactggtttggttgcgcctgcaccgtaagcccgcgtgcgctggatgatttcgaagccaagtacggctaccgcctgcgcccggaggacttcgtggacggcggtgcctacaactccgcatggcgcgtgcccagaaaagcccagcgcgactggatcgacttcctctccggcttcgtgcgcgaaaacgtcaagcagctcgccgacatgtcccacgccgccggcaaagaggcgatgatgttcctcggcgaccagtggatcggcaccgaaccgtacaaggacggattcgacgaactcggcctggacgccgtggtcggttccatcggcgacggcaccaccacccgcatgatcgccgatattccgggcgtcaagtacaccgaaggccgcttcctgccgtacttcttccccgacacgttctacgagggcaacgatccgagcatcgaaggcctcgacaactggcgcaaggcccgccgcgcgatcctgcgctcgccgatcagccgcatgggctacggcggctacctctccctggccgccaagttcccgaagttcgtggacacggtgacccatatcgccaacgaattccgcgacatccacgaccgcaccggtggggtggccgccgaaggtgagctcaacgtggcgattctgaattcctggggcaagatgcgctcctggatggcgttcaccgtggcacacgccctgcccaacaagcagacctactcctactacggcattctggaatccctgtccggcatgcgcgtgaacgtgcggttcatcagcttcgacgacgtactcgcgcatggcatcgatagcgatatcgacgtaatcatcaacggcggcccggtcgacaccgcattcaccggcggcgacgtgtggaccaacccgaagctcgtggaaaccgtgcgcgcctgggtgcgtggcggcggcgcgttcgtgggcgtgggcgagccgagctcggcaccgcgcttccaaacgggccggttcttccagctggccgacgtgattggcgtggacgaggagcgctatcagaccctttcggtggacaagtatttcccgccggtggtgccggaccacttcatcaccgccgatgtgccggtcgacccggcggcccgcgaggcttgggagcaggccggctaccgcatcccgctgagcggctgcggcggcggccagtccatcaagccgttgggcggcatcgatttcggcgaacccgtgctcaacacgtatccggtcaatggaaacgtgaccctgctgcgcgcggacggcggccaggtacagctcgcgaccaacgattatggcaagggccgcggcgtgtacatctccggcctgccctattcggcggccaacgcccgactgctggaacgcgtgctgttctacgcttcccacaacgaagacaagtatgcggcctggagctcgtccaatccggaatgcgaagtggcgcacttccccgagcaagggctgtattgcgtaatcaacaacaccgatcagccgcagaagaccacggtgactttggccgacggtaccaccgaggacttcgacctgcctgacagcggtatcgcctggcgtgaagcctgatcccgcgttttggagaacggacccatcatgactgaaagcaatgaagttttattcggcatcgcctcgcattttgcgctggaaggtgccgtgaccggtatcgaaccttacggagacggccacatcaacaccacctatctggtgaccacggacggcccccgctacatcctccagcagatgaacaccagcatcttccccgatacggtgaatctgatgcgcaatgtcgaactggtcacctccactctcaaggctcagggcaaagagacgctggacattgtgcccaccacctcaggcgccacctgggccgagatcgatggtggcgcatggcgcgtctacaagttcatcgaacacaccgtgtcctacaacctcgtgccgaacccggacgtgttccgcgaagccggcagcgcattcggcgacttccagaacttcctgtccgaattcgacgccagccagctgaccgaaaccatcgcccacttccacgacaccccgcatcgtttcgaggacttcaaggccgccctcgccgcggacaagctcggccgcgccgccgcatgccagccggaaatcgacttctatctgagtcacgccgaccagtatgccgtcgtgatggatgggctcagggacggttcgattccgctgcgcgtgacccacaatgacaccaagctcaacaacatcctcatggacgccaccaccggcaaggcgcgtgcgatcatcgatctcgacaccatcatgcccggctccatgctgttcgacttcggcgattccatacgctttggtgcgtccactgctctggaagacgaaaaggacctcagcaaggtgcatttcagcaccgagctgttccgcgcctacacggaaggcttcgtgggcgaactacgcggcagcatcaccgcgcgcgaggccgaactgctgccgttcagcggcaacctgctcaccatggaatgcggcatgcgctttctcgccgactacttggaaggcgatatctactttgccaccaagtaccccgagcataatctggtgcgcacccgcacccagatcaaactcgtgcaggagatggagcagaaggccagcgaaacccgcgccatcgtagccgacatcatggaggctgccaggtgagccgtcagccgaaccatacccgaaccagcatgatggaggcagagcaatgaacgatcagctgaccgaggtatacgccagcatcgacgccctgatcgattatgccttggcccatcttgaccttgacccacgcaacgcagactggacccgcaaccaaatcttcgccctcttccgcctagattcctaccccggacccaaaaccacaacgtcggcggcgtcagtgtcagacgtagtccaagacattgttggcagccgaagccaggccccctatggcgaaaagacccccgaccccctgctcgccgccttccgcgccgccgccacaaccgccggccttttcaagccggaggaaggcccggcctacgccgacaccatcatgggcatcctctccgccaaccccgctgatctcgacgaccgattcctgctcgtcgagcaccgggatggcggcatggccgccatgcaatggttctacgactactgtgtggccaacaattatgtcaagcgtgcccagctcgaccggaacccgcgcttcgactcgcacgggctgacggtgaccatcaacctcgccaaacccgaattcaagaacatgaagaaggcggcggccggcaacgccgtggccggcggctacccgaagtgcacgatctgccatgagaacgagggcttcgccggacgtgacaagcgcacgctgcgcaccttgccggtcacgctcggcggcgagtcatggttctggcagttctcgccctacggctacttcgaccagcacggcatctgcgtgaacaccgaccacacgccgatgcatgtggaccgcgacaccttcggccatctgctcgacttcgtggaccgtttccccggatacttcctcggatgcaacgccgcgctgcctcgcatcggcggctcggtgctcgcccatgaccattaccagggcggcggcgaactgctgccgatgcacaaggccgccacttgggccgccttcacacttgccgactatccggacgccgtggttgaaatccttgactggcccggcaccgccgtgcgcgtggtgtcgaagagtcgccagagcatcatcgacgtatccgacatcatccgcgaggcatgggtcggttatgacgacgcggcgaacggcatcgccagccatgacgcggatggcaaccgccaatccgccctctcgcccagcgcgatcatcaccgaacgcggctatgagatgagtctcatcttccgcaacaatgcgatcagcgacgagtacccggaaggtattttccatgcacaccccgaatactggccggtcaagcaggagccgatcggactgatcgaagcccaaggcctgttcatcctgcccggacggctcgtcgaccagctcggcatcgtcgaggaggcgctcgccgaaggccgcgatttgcccgatgaagtcagcgaattcagtctcgaatggggcgaactcgctgaaacattggccggaaaccgcgaccgcgaggccatccaccaagccgtacgtgacgagctcggcagcgtctgctaccgcatcctcggcaacacggccgtcttcaagcagaaagccaccacgcaaacattcctcgaaagccttggttttgccgctaggtgaaacaggtcaagtgaagtaagctcaatactgaaggaaaaaccgaaggcaagtccttccaaaggagggaatatgactactgttctggttacgggcggtgctggattcatcgccacccacaccgacatcgaactgctcaacaagggctacgacgttatttccgtagataactacggcaactcgtcgcccgtggcgcttgagcgcgtcgagcaaatcaccggcaagccggtcaagcgttatgacggcgacgtgcgcgatgaggcgctcatggaacgcgtcttcgctgaaaacaacatcgactgggtcatccacttcgccggtctcaaggccgtgggcgagtccgtggccaagccgatcgaatactacgacaacaacctgtactccacgcttgtgctgctcaaggtgatgaagaagcacaacgtcaagaagatcatcttctcatcctccgccaccgtgtacggcacgccgaaggaactgccgatcaccgaggagacgccgaccggcggcaccaccaacccgtacggcacctccaagctgttccaggagcagattctgcgcgacgtgcatgtggccgatccgtcctggaccatcgtgctgctgcgctacttcaacccggtcggcgcgcacgagtccggcctgctgggcgaagacccgaagggtatcccggcgaacctcaccccgtacgtggccaaggtcgcggtcggcgagctcaaggaagtccaggtctacggcgacgactacgacacgcccgacggcactggtgtgcgtgactacatccacgtggtcgacctggccaagggccacgtggccgtcattgaccacatcgacaaggaaggcgtgttcgtctacaacctgggtactggccacggctactccgtgcttgaggttatcaaggcttacgagaaggccgccggtcatccgattccgtacgcgatcaagccgcgtcgccccggtgacatcgccgcctgctacgccgacgcttccaaggcggagaaggagcttggctggaaggccgagctgaccatcgacgacatggccgcctcctccctcaactggcagaccaagaaccccaacggtttccgcgacgcggagtgatatgagcagatgagctccctctgatgagggagctcatctgtcgtttatcacacaatgcgcctatcggcggcccagcgggtgagctcggtgcgattcgaaagctgaagctttcgcaacaccgagctcacgtgcgtttcgaccgtcttgatcgaaatgaacagttcggccgccacctctttatacgtgtaaccacgcgcgatcagccgcatgacctcctgctcgcgggcggacagccggtccagctcctcatcatgagcccgtgccgcaccatcagcgccgccatcagaccccgccgccggcacaccctggaaggtcgaaagtacaaaaccggccagttttggcgagaacacggcatagccctcatgcacctgcttgatggatgaaatcaaatcagcgccggtaatcgtcttggttacatagccctgggcgccggcgcgaatcaccgaccccacatcctgcggcgcatccgaaaccgacaatgccagaaacacggtagtgggggagtagggccgcgatttggcgaggatctcggcaccgccgccaccctcgccgccgggcacatgcacatccagcaacaccacctgcggcttggtctgtgcgatcatcgccaccgaaccgggcacgtccgccgcttggccgacgatatcgaaggaatcgcgcaacgtggcgattacgcccgcacggaacatctcatggtcatcgaccatggccacacgaatcttggctgtctcgttctcgctcatcgatgttctccctgcgccgctttcagcgcgatcggcatatgcattctgacctcggtgccccagccggccctagacactatctccactgtaccgccgcgccgtttgatgcggccgataatcgattcgcggatgcccagccggtcgggcggaatggcgtccatatcgaagccttcgccatggtcgcgcacgaacacttcaaccatcgtgtcgctggcctcgcaatacaaagacaccggctcgccgccatgcgtgaccgcattgaccaacgcctgacgggtggcgtccagcagcgcatcggtctgggcgctcggccgcgcgtcgcccacggtgaccacctcaatcggcttgccgtgctcgtcctccacctcggcggcgatctgcttcaatccggctcccaccgaacgatccgatgtggaacgttcctgatacagccattcgcgcagctcgcgctcttggctacgcgccagggcgaatacggtggtcggttcctcggagttcagctgaatcagcgccaacgtttgcagcacgccatcatgcagatgggcggtcatgtccgcgcgctcctcttcgcgctccttcaatgcctgctcgtgggtgagtcgttgcagcatcgcgttcgcccacggcatcaccgccaccacgataccgacgatcatcacgaatccgctggcaacaatgcgtcgaggagaggtgccccacccaggaatgctgacattatgcacatacaatgcccatcccatgaaaatcagtgcgatgccgcccaacatagacaacagctgcgtgcctcgcggactaagattcatccatgccagtgcgatgccgcccaaccctaccagcagcggaaacacaatctggacatccgcaccggtgctggtgagcaacagtccagtggccatcaacgcgaaaccggccaatgccacgacggccggtttcggagcacgttggatggcctcggacaatgattccggtgcggcagccgattcgtcgtcatgagcggcaagtggctgattgcctcgcgcaagcggcgcctgattaacgggcactgtgcgagccgcagccgccaccgggtctccggcaggcatgaacacccacaggaatacataagcgatgatgcctgcgccgtagaggacggtcagtgcgatgaacgcaatccgaacccatgccacgccgatgcccaagtgcagggcgatgcccttgcacacgccggtgagccaacggccctgccgggggcgcatcaacggcatgcgcgcgggcagcaatggttcgggagatgacgtcatactcctattgtgccgcgctcagggcgttgcggccggggttttacccggtgttcagggaacaatcagggtgttccccgagcgttgtggcagtggtcgggcggtgtaatggaatcatgagcaatccaaacgcgaatccatatcagccacagccgcagcctggtccgcaaaaaaacaagacatcgcgacgcttcttcacttgggtgcgatccagtggactggttcgcggcgacgaccggtggatcggcggcgtatgcagcggcatcgctttacggcttggctggagccccacattagtacgtgcgttggtgattgtatgtacattgttcttcggttttggcgcagctctgtacgcactcggctggtttctgatgccggatgtacgcgatgggcacatcttggccgaggacctcattgccggccaatgggactggaattgtctgggatgcttcctgttcctcgccgtggcaatcgtgattccaggtgcggggtggggttgtattgcgctcgccgccttagcgctatggctgttggccaaaagcggcattcgccagcaggaagggtacggattcggggcatctgcgccgcgaccggtttcacagcctgtgtcatatccagccgcgcaaccagtacctcaatctcctttgtattcagctccgcaaccttttccacaacctgtttcacaacctgtttcacaacctgtttcacaaaccgcgcctagtgtttcacagcctgtttcacagcctgtctatcagtcgatgcccagcgtgatgccgggtactgtgcccggcgcgatgcccggcacagtacccaacgggccgtttgcccccgaccgtatgaatgcgacggcctatgcccccaccgagtccaagcgccgcaagccggcgggcccaatcgtggtcttgagcatactgggccttaccttcctctcctttgccggtctgatgggactgatttgggtaaacgacatgggcattatcggcattatgcgtctgggcaccatctggattgccgcagtatgcatagtgatggggctggtggtcatcattctcggattcagaggacggcgtaccggtggtctgattcctctcggactggttgccggtggatgcgcgctctgcatgaccatcatttcaggcacgtatggcgtgtactaccgtgatcttggtgccagcggcatcaatactgttgtttcactgagccaatctgtcagtgcgagaaacagcgacggcatgaacgatgtgcaaaaggatggcatcttcgttgccgatgccagcgatgccacgtttgaaacattgcagcaaggtgtggcgttcagcggtgaaaactacaacaccgatcaggcaatcattgattggtccgattgggacaagacacatggaccgcacacggtgaagatgctggatggcaaaacttccatcagtaattgcccggtcggtaccatcaccatagccgcaacacaggcgcaagtgcatatcgttctgccggattcctgcacttacgccttcggcaccgccgactcctactactccacttcgagtgacgttggcggcaaatacgagatggtatacaacaactacatgggtccaagctttgttttcttcgaagctgaaagtgccaccaatgggcctgatcacgaatggttgtataaggaatccgccatgccggacaacggcccagaattaaaaatcaatattccctatgtggtggaagcacgtgtcaacgtggtgtacgcctccgattgggaaggctctacgttccagccgcttgccgatatatacgacggcaacagtacaagcaagaacacaaccgaacaatcggaatgatcaagccgttgcaactaggagatggaatcatgactgatgaaaccaaggaattcgcctccatcgaggaagcgacaccgaccacggccataccttccgaaaccgacgcgaccaccgcgaccacaaccatggtgaccgtcgatgaccgaaccgataccacggtgctgccatccgcagcggatgatgacgaaacggctgtgctgcccgtccccgacaatcatgcggatgcgtcggtctcggatgtggatacgcaggcaacagctgcctctccatcgcccatcgaaccaaccacagatcggattgccctggaaacagttgccgatgccgtggagggagatggtgggccgattccatctgccgatgatgtgccgatgtacgcagcatcttcagcacgacctccctatgggcagtctcagaccgccggcaaaccatgccagcctggggggagctccaagaacgtccagagcgccaagaacgtccagaatgctaaggatgtcaagagtgccaagaacatccagaaacagagcaccagcgcgcctactgtggtattcggactattaggcgtgattatcggcgtgatcgcgctggttttcgggtacatatctccggatcggatgatttcgttgttctcgccgaatccgcaattgctgacggctattatttgcgccgtagtgggactgattctggtaatagtggccgttgtatgggccatagtcggtgccgtcaagaagagaaaatagcgttacaaaccattgcattacggtcccagtagaagcacattatgacgggagccgaccgataagagccgaccgttctatgctgatggggggaggcatagtaactatgaagcggatttcggtgcggcgggtagcgagcgtcatcgtcaccgcgatggcgatgacgctggtattcgccacacttggctgggcgatgatgccgcaatggaacacacggccctacaccaagcacatcgttatcgcttctgccgacaccaccatcacccctgcccatgcgaacattccccacgaggggcgatatcgtacgcgtgaaacccgactatccatcaagaccggcgacggcgtcacgctacccgccgtactacgtgaaccggtcggcgctcccgggccacgcccggcttgtctgttcattcacgggtccggtaccagtggtgccgaggatttcggcgatattgccaacgccatggcctctgccggtatcgtgaccttggtgccggccaagcgcaacgacaactacaccgtgctgcatcgcgactacccgcgttttgctcgcgaatacgggcgttcgctcgacgtgttgcgtggcagaatcggcgtggaccccgccaaaaccggcatctacgccgaatccgaaggcacctggatcgccacgattctaacctcgaaacggcaagacattgcctttgccatacttacatccgcaccggtgttcaatggacgtgagcaaatggccatggctgtcagcgcctatacgcatgaggccggcgcgcccaagcccgtggtcaaagacatggccaaattgatgtcgctggactacgcgccatttgatctagcctatgccgactttgatgccgaccggtatctgaaatccctcaccatgccggtgctggtgaactacggcacctacgatacggccatgcccatcgaacagggggcgcagcggatcatcgctacggccaacaagtccggcaacgagaacgtcaccgtacgctattttgccggcaaccatcagatgcgggctggtgagggcttattcaccccgaacctgccattggccgaaggctatacgcaagcgctggaaaattgggtgaacggtgtgactgccggaaccaaagccgatggatgggcaacgcctcaagtcgccggtgcgacacctcaccagcgcttcgccgcgtcgcaacgtaccagatccggtatcgtcggctcgcttggcgtgctggccggtctgatggtggcagggcccgtgctgatcgtgatggcggcgatattaggtattggcttgactgtgttttcttggctacagacgttgctggccgggcgacgtagtgtggcgactgtgcgggccgtgcatgcgacgccgagtgagctgggggccgcccagcggcgcatgttgcacggcattgccggcttatctgccggtatcggcacagcggtgatggtgattactgggctgttgtacggctatatgagcgccgtaggcgtatcggctgtattggttatgcctcaaccgcggctgtttgccgtcggatgggtggtgctgcgaatagcgaccatgctgttggtggtgctgtttgcttgggaaatggaacgtgtctggtattgccgcgccgatatcgtcggtgtgcggcgcgtcatatgcgtgatggtagcgctcggcactctcgccacactgatgacactggcattttggggcctattctcgctgtaattctgccgatgtgcgctggtaaatggggcctggcgggcaggctgcgttggtggtctgggtgtggccggccgacgtacatcagtcggggtgtccgatacacagtgaatggctgagtattacgcttgggaggcttcggcctcctctaaggtgtcgaaaccgccgagctggactgtgtgcaacaaggtttcctcagtgatattgcgttgcgggctggctacggcgcgctcgccaatcatcgcttcgtaacgttcgaaggtctggtcggaatacgtaccaagctcgccgcgcagataggtttcgaatgaggtggcagatggtgtgtcttcggtggtggtgagtgcgcgcatcgcctcgccgagcttggggtagcgctcgcggaaatccttggcccaggcgacctgctgggcgatgacctgttcctgacgggccgcgcgctcttcagagagacgcggaatatacggctctatgttcttcgtgaaattttccgatgcggtggaggccatcatgcggccgtatttttcggtcacgaggttgcggcccacgtggtcggccgcgtcaagatcagcggcatagctggtgagtaatggccgctcccatgtgaggaactgggccaaccgcatctggtggaacaccggccagttgccttggcatgccgcgcgtccaccctcattgttggtgcgctggaactgatcccattcatgacgcacaatagcctcgcgcagttcatcatcagtcagttcgttggtcatcgacgttcctttcgctgatacctccctctgatgagggaggtggcacggcgaagccgtggcagagggagcttgaatctacaaacttttaagcaccggatcatcagaggcgatgtggtcctcgacatacgggcgctgccattcgaggaaggtctcgccggacgtggtcaggtgttcgcgtttgagttccttgacgatatccaccgcaatctgctccacaatatcgttgattttctcgattgctggagccgcgcccttgccgccttcgccaaatccggccccgccatagcaggctgccgaactcaatcgcatcacggtttccaactgttcgcccacgttcggcaacagcgcgaacatcgagccagacagcttgcgcaatgctgcgaactgccacttgtaatacggcatatagcccaccaccatcggcacgttaaccaggaacaccaacgaggcggtggcctgcacgaactcgtggatggacagccatgcggccgcgccgtcgccgcgcttcaacgaacgcggcagattatattgaccggcctgggcgatcatgccgagtcgcttggagatcagcgcgagccgcacatcgtcgggcatgttcttgaacccttggcgcgtcttggaaaacagaccggtgggatcggcgaacacctcgccattggtggcggcggccaaggtcgattcctgaagcattagccactcatgcggcgcggtctgcgccggcgcagtgcgatacccggtgatcgactcaaagaagtcaccgatgcggaacacgccgtcacggcgattcgcgccctgtgcgcgcggcgtgacgggggagagcggtgcatcaatcggagtcgtcatcgcttccgccacatcagaggacgccgcgcctgactcggcagtggcggtatcgtccgtagcggtgccgggggtgggtgcgtttgccgcatcgggtatgacggtggagcctgcacctgcggaggggaatgctccggaagcatcggacctggcatgcgcctcgaacgtcacgcggccttgcgcatccacgctgaacttgcgcggcagtgcctcgtaatcgacctcaagttgctcgccgatcgccgcgtaatcctcatccgtaagccacaggcagaagcgcgggccgaaatcgtggtcctgcgaatacgcatcatcgaatccgtagcattccgagccatgacccaccagaccggcggcgatacgcccggtatactgcggatacttcgccgcaatcatcggcttgcccatctgcgtccagaacgcgcgggccagcttcagtccggacaccgggcatgcggaaacggcctcggccgcgtccgcagaaccggtcgacaccgaaacggtggatggggaagatgccgcgttcgcaccggtcttgccctgtgccgggctgttcggcagccgcgagccggactggggcagcgcgcctgcatcgccagcaacacccgcattgtcaaccgtcaccccggcctgcgccgccgcttcctcggcctgccgcagattgtcggcggtgatacgccagtaatcggtgtccttgccgtaacattcctcgatcacggccagcgcatgccggtatccagtaaccgcatccgcataccgtctctcggcaaagcacacctgcgcgaagcccgccagtgcggaggcataatgcgcggaatgttccagatggccggtgcgatagatttccagcgccttggctgcatgccaatgcgcgtcctccaacttgtgttcggtcagcagagtcaacgccagattcgtgtgcgagctggccacgtcgatatccgcgtccgggttcacgctcgaggcttcgataatgcgcagcgcttcacgcaactccagttccgccttgtcgggccgattcgtctcgctgtagagcatcgacagattgttgtgcagtgctgcgagcctacggtcggtgggtgccagcgaatgccggcagacactctgcgcctgatgatacaaatcctcggcctgatcgtattgtttggccgcgcgcatcgaggtggcgcaattgattagcgtggtggcccacgcctcggatgtgccggtggtcaagcccatacgagcggccagttccagcgctcgctgcacaatccactgattctccttgtgccgaccttgcgagcgatagaagcccatcgtttcgttgagcacggtgagcagtccggcctcgtcgccggcgttttccgcgtccaccatcgcctgttccaagtatgggccggcttcggtggcagccgtgtggcgatcgaaaatcgcgtccagtccgttcaggaattgttgggtatcaaaggttgcgggcgattgatcggcatcgtccgcaacctggttcgccgtggaatcggcaccttgtgctgcggccgccgcatcggtgtcgtcggcatcgtctggaccatgcgcgaattgcgcggcgaattgtttgagcagtgcttcctcatccataccgccagacctccctgaatcgtgtctgatttcagtctattaatactgtgaacaaacacgtcagggagtttgctgtgagcttggtctcagtccaccttggtttcgcgcatgcggtgaatggcgtcggtatcggtttcgcagcgccacgagtagaaggccagcagccctacggcaagcagagccagcggcataccgcccaggccggtatagcgatagttcatcgagaaggtggtgagcatcgcgccgccgacaatcgagccgatggcattgccgaagttaaacgccacctgtacagccgcgccggcgatcagctcgccgccgccctggccggcttcggtcatcagcaattgctgtggagcggaagtaaagaacaatccgatggcgatccagaacgtcagtacagcggtcatcggctgattacccggagtgataagcaccagcaacaagccgaggcaggagatggactgacctattgcggccgcgccggcatgcctccaatggtcggtcagacgacctccaagcagaccgccgatgaccataccaaagccggcaagcatcatcagcatcggcaccagggaagacgaccatccgccggttttctgcagccaaggggagacgtagctccaccagcagaacacaccggcattgccggtgaacacggcggccaaaatcacccacgggccacggcgggtgaggaacttgaactgaccggcgatgcctgcgtccttgatcggtgcaacgtacggaatccacgccaacgccagcacaattgtcattgccgcccaagcggtcaaaatgccgaaggcaagacgccaggaaaggaactcggccatcaaggtgcccgccggtacaccgagcatattggccacggtctgtccggtgaccatcacggatacggcctgcgcctccttgcctttctccgccagagtcttggcgatgagtgtggctgtgccgaagaatgcgccgtgcggcagaccggcgacgaatcgtgcgacgaccagcatggcggcattgacagagaatgcggaagccagattgcccaccaaggcaatcaccataaacaatatgatgaggctcttcggcggcaccttgcggccgaataccagaatcagtgtgccgaagcacacgccgatcgcatacgcggaaatgtaatggcctgcggtggggatgtccacgccggtggcggccgcggcctgcggcagaatgcccatcatcacgaactcggcggcaccgagaatgaacgcgcccgaagccagtgcaagcagactcttcttcatggttcctctaattacttcagtattacttacaaaaacagtgcggcaatcgattgattcgagcgatatattacggtggtctgccaacaaatacgggggcttgccgtgatgtggtttgtcgctgtgtgcggcgggttgtttatcgctgttcgatcgcttggtttgattgttgggacaggaaacgaaaaaccggattgctgattcctcaacaatccggtccagttgtcgggctggcgggatttgaacccgcggcctcttcgtcccgaacgaagcgcgctaccaagctgcgctacagcccgtttggcaacagacgtagatattacattgtggtggtggacaatgcaaatcggcatgtcgcgagtgttgcgtgatggtggattcgccatgtgtacaggtctctcaagccttgtgcagagccggttttgcgtcatgtgagcgggtgttcagatggccgtgcggtctgccgggctcataatcgccggccttgcgtacactgatgaatcatggctgaagttgtcgaaaataccgaaaacactgagaatgaaaccccggccgtcccgcagatgagcaccgtcgaacgtgcggaaatgctgctcaagcaggacgccaccatccgcgagaagatcaagtccggtgccacgctggacgaagccgtggacccctccaacaaggagttcggcccgctggctcaccccgagcaggtgcagatgcgcgtggccaagcgcgcgatgatgcttgaggccggcattgccccctacccggtgcacttggacgtcaccgacaccatcgaggcggtccgcgccaagtatgacggcaagctcgaggctggcgaagagaccgaagacatggtcggcattgctggccgcgtgctgttcctgcgcaacgcgggcggcctgtgcttcgtgcagctgtccgccggtgacggcaccaagattcagggcatgatctccaagaaggagattggcgccgattcgctcaagcagttcaagcagctcgtcgaccttggcgatcacttgtacctcaagggccgcgtcatcgcctccaagaccggcgagctgtccgtattcgccactgagtgggctatcgcctctaaggccctgcagccgctgccggccctgcacaaggacctgaacgaagacacccgcacccgcaagccgtacatcggcatgatcgcggacgagaacatccgcaacatggtgcgcaaccgctccaaggccgtggcctccctgcgccgcacctttgacgaccacgacttcctcgaggtcgaaaccccgatgctgcagaccctgcacggtggcgcggccgcccgcccgttcaccacgcacatgaacgccttcgaccttgacctgtaccttcgcatcgccccggaactgttcctcaagcgctgcctggtcggcggcatcgatcgcgtgttcgaaatcaaccgtgacttccgcaatgagggcgtcgacgccacgcacgcccccgaattcaccatggtcgaggcctaccaggcctatggcacctatgattccatcggccagctggtcaaggagctcgtgcagaagaccgccatggacgtctacggctcgcacaaggtcaccctgctcgacggcaccgaatacgacttcggcggcgaatggaagaccatcagcatgtacgactccctgtccgaatcgttgggcgaggagattgtgccgaacggcggcccggacgcccccggcacctccgttgagcacctgggcgccatcgccgacaagctcggcgtagagcgcgacgacgtggagaaccacggcaagctcgtcgaacacctgtgggagcacttctacgaggacaagctttacgagcccaccttcgtgcgtgacttcccggtcgaaacctccccgctggtcaagggccaccgcaccaagcccggcgtggtggagaagtgggatctctacgtgcgcggcttcgagctggctaccggctactccgagctcaacgacccgatcgtgcagcgtgaacgtttcgtggctcaggccaaggacgcgctcgctggcgacgaagaggcttgcgacatcgatgaggacttcctcgaggctctcggcgtgggcatgcctccggccggcggtatgggtatgggtattgatcgactgcttatcgccttgaccggtgccacgattcgcgagaccatcaccttcccgctggtcaagccgctcgttggctgattaggcatactctggctcccctcagagaggggagccgagttatatatgaaaggattgcttatgtccatcggcttgtgggttcggggcgcgcgtcccaagaccttggccacttccatcgcgtcggtgatggttggggcgacgatggcatacgcgcatatcgagcagtcgggcacctgcatcgcaatatatcccgaaccggcctcctgcgccacggcccgtgaacagcagaccctgctgatggaccgattctggccggtgaccatcctgtgcctgctagtcgcgctgttcctgcaaatcgccgtcaactatgcgaacgactattccgacggcatccgcggcactgacgccgggcgtgacacggacgaatcgaaatcaggcaaaccccagcgactgaccgcatccggactggtaccggccaagcatgtactgttcgcggcgatgatttgcgccgccatcgcctgcatatgcggtgttgtggcggtcgtgctcgcccaagcatggtggttgctggccgtgggcgcggcctccttgctggccggctggttctacaccggtggcaagcatccgtatggatacgtcgggctgggagaagtcggcgtgttcctgttcttcggcttggctgcggtattgggcaccgaatacgcgctgtgcggcacggtggacgtcggcggactattgggtgctgtggcggctggcctgttctcctgcctgatcatgatggtgaacaatatccgtgacatcgacgaggatcgtgagcatggcaaacacacgttggccgtacggctgggggagtccggcgcgcgtacgctgctgattgtgtgctgcgtcatcgcatggatcatcgccctgctgatgtgcggcacattatggtggccgtggggtgcggtgctgttgctctcgggcactggaatacctgtgcgcatggtctccagcgtgaataaacgtcaattccgcccggctctgcccgccgccagcttccagatcttgctgtttgcggtggtgctggcggttgccgtggcgctatgagagcgaaataataagacgaatactcgtgtttgggcgcacgcggctgtagactgaaccgtatgacttataaactagtactgctccgtcatggacagagcgcatggaataaaaccaaccagttcaccggctgggtcgacgtaccgctgaccgagcagggtgaagccgaagccaagcgtggcggcgagctgctcaaggagaagaacgtccttccggacatcgtgttcacctccctgctgcgtcgcgccatcaacaccgccaacatcgctctggatgccgcagatcgtctgtggattccggttcagcgtgactggcgtctcaacgagcgtcactacggcgctctgcagggcaagaacaagaccgagatccgcgaagagtacggcgacgagaagttcatgctgtggcgccgttcttacgccaccccgccgcccgagatcgacccgaacgaccagtacgcccagaacaacgacccgcgctacgccggcgatccggttccggaagccgagtgcctggccaacgttgttgagcgtgtgaagccgtacttcgagtccgccatcgagccggagctcaaggccggcaaaaccgtgctgattgccgctcacggcaactccctccgcgccatcgtcaagatgctggacaacctgtctgaggaagagatcgccaaggtcaacatcccgaccgccatcccgctgctttatgagctggacgagaacttcaagccgatcaagccgcgtggcgagtacctggacccggaggctgctgctgccggtgccgccgctgtcgccgctcaaggccagaagtgagcctaagccgctaacacggtacaagctgtaaggggagtcgcacataatgtgtggctcccctttgctatgcctgccaaatcccccatggggcggtgattaccccatggggcggtaaaaccctcatggggcggtatgtcagaatggcttaattccgcggtttcacatatccttcaaaccgccccatgggcaagttaccgccctatgggtgttttgccgccccatggatacgccggtgtaccgcccaaaagcaacaaaaaacggcgtccagccgtagccggatcgccgctttcgggcatcctcctcaaaccacaggagaacaagtgttcagttattcgcccaatgtgagaacaagtcccaatcagtcgatgtcggtgccctcgtcgcgggtcggctccttagtggggtcgaagccggagacgatgtacaccacacggcgggcggcggacacggcgtgatcgccgagacgctccaggaagcggcccagcagcacgatatccacggtctgctgacgggtgatgtcatcggacagcgctagatcgaaggtctggtggtgcagattgtccagcttgtcgtcagccaggatgatggcctcggcggtcttggcatcgcgatcgaagagcatggccaccagctggtcagcggtgttgtccaggaagtcgatcatctcggcgaacaccggttgagcggattcaggaatcgcggcggccggataggtgcggcgagcggcctcggccacgtggcgggcaagatcgcccatacgctcgaacgtggaagccagacgcatggtggaaacgaccacacgcagatcggtggccaccggattctgcttggcgagcaacttgacgcactggtcaatcacagaggactccagggcatcgatttcgatgtcgccgtcaatcacagtctgtgcggcttcaacgtcctgattcagcagggcttccccagcgcctttgatcgccttgcgtacgttctgcgccatacggtcgaggtcgtcagcaacctgcttcagctcctcgttgaaaataacgcgcatttctctagcctttcatgcttgcttattgcaacctgtaccagtgtattattccagtacttgttccccacttcaacgtaggtaatggcaacctcaagttgttctactgttcattgggttgttcacctgaaattcatgttaccggcgtgccggcaaaccgcaatcccggcgtgtggtgtgaaagaatgggggcatgacacagatgccgctcgtcgccgcgattgctcttattgtcacggctgttttatttgtggtaggaatcatcacgctcatcgtgggatttgcgacacatcgagtgtccatggaatcgccgctggccgatgatgacgacaatgacgatctgtccgacgacaccgccacgctgctgtccatgctgccaggtgcgtccgtggtggtcgacgagcacgacgaggtggtccgctgcaatcccgccgcctaccgcctgggtgtggtgtcagatgacgccattgcccagcagcatgtgctggatgccattcacgaggcgcgcaagtccggtggcaagcgccagttcgacttgaccaccgatactccggagcggtacgtcgcagaccagaacaagggcgatcacgtcgccacgcagtccgtccaccgccccaactggctgaaggtgactgtagggcgtatcaacgagcagttcgtcatcgtgttgattaccgatgtcagtgatgtgattcgtttcgctcaagtgcgtgactcgtttattaccaatgtgtccgagcaattgttgggccccactgaggctctggccaaactcgccgattcgctggagtccggcaatctggacgaacagcaggtggctgccgacgctcgccaggtgcgttccagctgcagcaagctcaaccacatggtgtctgatttgctgctgctcatacgcgcgcaggagccgattacgccgtcttccgccaaccgactgaacgttatggaacagctcagggccacggcggcgcgactggagccgcaggcagccgaggctggcgtgcagctgaacatcaagggcgacgatgatctagtcatcaatggtgaggcggaccagatcgacagcgccgtgaccaagctcatcgaaaacgccatcggctattccaaggaaaatggcgtggtcagcgtgtccgcatccaaagacaaggatggcgaccgcgcggtgattcgcgtgattgaccaaggcacgggcatcgctaagaaggaccaggcgcgcatcttcgagcggttctaccggggcgtggaacagagcaatcgcacggcggatggcgtgggcctaggcttggccatcgtcaagcatgtggcgctgacccatcatggcgatgtgaccgtatggagcgcgcccgggcaaggcagtacgttcagccttacgttgccgttggcacagtgaggtaaggaattggtggcatgccttgcatgccaccaatgctgtttgatgagcgacctgcggccgcggtctctccctcaatcagctacgctgacagctcccgtcatcagagggagcttgtgttgcgttactgtccgaggcggcggtagtcccagcggtcgaagtattcccagaccagcagtagcaagccaataatgacgccggccacgcacataatcaccaacggcattacgctgtagcccacggccagcagaatcagcacgacaatcaacgccacaatccatagaccggtaccgatggcaaacaccttacgcagatccacccgtacgggcttgggtgcgggtttgcggacggcagggtcaatgagaggcgcgaacttcatactcatgcactgtagtaagagtagggaggggcgtcaaacatccctccctacgatttattcaatcggcatcagttgagaccgatcaatgtgcatggcatatatggtcggcaatgcggggcatatatgccatcacaggtgctcgaccacgtagtcgacgcacttggtgaaggccatgacatcagccggttccaccgaggggaacacgccaacgcgcagctggttgcggcccagcttgcggtagccggcggcgtccacaatgccgttctcgcgcaggatggacagtacctgagaggcctggactcgctcgtccagatcaatggtgaccacggcgttcgagcgtgcgtccgcatcgacgacgaacggagcggcgtattcggagcgctcggcccacgagtacaggatggatgcggacttggcgcaacgtgtggtggcccaggcgaggccgccgttgttgttgagccagcgaatctggttttccatcatgatcagggtggccacggcgggcgtattcagggtctgatccttgcgggagttgttcagtgccgtggtcagcgagaggaacggcggcacccagcgatgtgcgccttccagatgagcgcttgattcgacgcctgccgcacgatcgatagcttcgggggagaggatggcgacccacagaccgccatcggcaccgaaggccttctgcggtgagaagtagtagacgtcggtctggctgatgtccacaggcaaagcgccggctgcgctggtgccgtcgatgacggtcaaggcaccggcttcacgacttccggccacgcggcgaatcggggcggccacaccagtggaggtctcgttgtgagcccagcaatatgtgtccacgccctcggtgagctcaggcagacggtaagtgcccggctcgccggggaacagcaccgggtcttcaaggaagggtgcgttcgcggcggacgcggcgaacttggcactgaacgagccatacgtgccgaatgcggcgcgacgggtgatcagcgaagcgcaggcaatctcccagaacgcgctggcgccaccgttgccaagcgccacctcatacccttcaggcaggtggaagaactcgcgcagaccttcacgaatcgaagcgaccagttgcttgactggtgcctggcgatgtgatgtgccaagcagggtggtggcgccggcgtcgagcgcggcgatctgttcggggcggattttgctggggccggagccgaagcgaccatcttcgggcttcagcgactcgggaatactcagtgtgatagtcatggtttcaagggtagaccagtgttggggaatatcgcggataatgctcggtgtgcgggattactgcggggttactgcggaattccggggtgccgggcggcagtggtggcaatgcggaatgcagtgcagaatgtacgcagcacatcatggctacggtgtgtcggaatgacatgagttagtgattcttccgataaccggatagtgaggttcgtgaacgggcggaaacaaggcagttttttcacccggccgcacggttacgtaaatcgtttgacacacccggatggtgggggatcacattgaggattgacctctgttcgttgtacagtactcaattgtgacggtcatacgaggtcatcgaaatgaccccgccgaacccatccaaggagttaacgtagtatgaagcatgcttcgcataaagcgaccacggtctcgcgccagaagttcagcttagcgaaggcattgtttgcctccggcaagggttctcattccgttcgtgctgtgcgtgcggtgcaatccgctggtagcgacgccgttgttttggggcttgatccggccattgccgagaagatcaacgaaatcgctccccagacccgccgttccattcgtgaggccgctcgtgccgctgaacgccgtagccatattcttgcctcggcctcactggccgctctggtcggcacggccgcaggtgctctcgcattttccaacaataaagacgccacgaactcgttcgtggctgatccggccacgacgaccacgcagattaagcgcatcagcgatgtgactgcggcttctcgttccgaagcacgtactgatctgagttcatcctccgttaccgcacagtccaccaatgaaggcggttgggggctgagcaattcagacagcaccttggacgccaagctgatgaatcgcaataatgcgaacaatcctgtggtgtcggctctcatggatgccgatggcgatgctgtgccggctggcttcaacccgaaccatgccgttggcaccaactccaacaactatccgtggggtcagtgcacgtggtacgcgtaccagcgtcgtgccgaactgggactgccttccagcggcaacttcggcaatggtggcgagtgggcggcgtcagcttccgctctgggctattgggtggacaacactcctcgccatgtcggtgatgctgtggtgttcgctcctggccaggccaatgccgatggcacatacggccatgttgccgttctggaaaagatcaatgccgacggctccattgagatctccgaatccaatgccaagggattgggtgtgatttcgacccgtacgttcagcgccgccgaagccggtaagttccagtacgttcactactgattcatttcattggcttacattcggtgattactgttcggatgtgacgtcgccctatcggcaatcgttcgcgcgaaatgacatttcaagtgttgcggccgcgtattagtccgaactgacctgtgccgacacgccgatatatcccaatagctccggggtgttttatttcttccatcctgtacgagttaatgcgcaccgtgtagggtgatggttctatgaagaccaaaactgtagcttcttccattgttgccgcgattgtctcctgtgcctgcttgtttatgtttgttcctacagcaactgcagctgagggtgttactgtgacttccaccaagtccttcccctcgtacacccaggtgcgcaaagatctgacgactgaagccactgccacgagcgttgaggacaatgctgattggggcggcattgagaacctcgatgtgccgcagacggaatctcaggcggaaaaggatgccgcagcggccaagaaggctgccgaagaggaggccgagaagcaggcggaggtcgaggctcaggcgacccaggagcaggccaacgccgcgagccgtaatgagtctcgctcttctgttacttattccgatgccagtggttcggtttccgctggtgccggtgcctctatcgaccgtgcgtattctttgatcggacagagcatggactgcaccgcattggtcagtcaagcgttggcggcccgtggcattaacttccacggttggcctgaagagtacgtcaatgttcctggtggccacgtagtcacagacggatccctgcagccgggcgatattctgatttatgccaacaccggtggatggaacggtggtgcacactacgatcatgtggcgttgtatgtcggcaacggtcaggcggtccatggtggatggaatggctatagcgtggctctcgctagtgccatgaccgaaaagctcaccatcgtggtgcgtatcccgtgatgcagtcttattgattgatttattgcaggcctcggatgccgatcggtatccgaggcctgttgcgttctcctgccgaatgatgcacccgcgacatcatcttcgaaatgctattcctgttatgaaatcgacccatgtgtgctagtgtatggcgttgatgatgagcgttaagactattatttccacatcagtggcgattatcgccacgggtgccatgtttgcgtgcgtagccccgtttgcctctgccgattccgcgcagacgagtgctgtggtgtcctcacgttctttcccgaaggcgagttcggtgaagaagaatttgttcgccgaatccacctccacctcggttgatgagaactctaaatggggtggcatcgagactcttgatgtgccacagaccgagtctcagggcgagaaggaagctgctgcagcggcggcggctcagaaagccgctgatgaagctgctgcagcccagtccgctgctgctgcggcagccagccgctctgaacagcgtgcgtcgattccacaggttgacttgggtaaaatgactggcactggcactggcgctgagcttgctagcttctcactgaagttccaaggctatccgtatgttgccggcggcaacactccggcaggatgggattgctccggttttgtgcagtacgtcttctcccagtttggcatctccctgcctcgtacctctggtgctcaagccaccgtgggtactccggtcgcaagcttggcggatgccaagccgggtgacattcttgcgaatggtactcatgcggccatttacatcggtaacggacaggtgatgaatgctatgaacccggtgcagggaacggcagtaagcgacgtttccgtattcggtggagctggatattccattcgccgcgtgatgtgacaagaattatgcggtaagcgaattcgtattaaggcacgtcctttggggtgtgcctttttcgtatacgcggatttctttttgagcggaggataccggccaaaccgagtgtcgcggggtattgttgagatacgcggtattcgtgccgcaataacttcaaggaggtcgtcatgattaacgacaaggctattctcgtcggcgttgacgggtcgcatgccagttacaaggcaacatggtgggccgcgaattatgcaaagcacgcggggctgacgctgcagattgtctgcgcatattccctgccgagctatgccgccgtttcgttcgatgccacttacacggcgatgggggacgataacgccgcgcattccgatgctcaggagattctgtccaaggccaaggccatcgcagacgagcagggcgtcgaagccgccacactgattgttaccggagatccggcatcggtgttcgtcgaattgtctcgtaactacaatctgatcgtcattggcaaccgtggcaagggcggtctggccgagcgcctgctgggcactacgtcctcatcgctgccggcatatgcttactgcccgattgtggtggtgccgtacaccgatgatgacggtaacctgatgcacctgaacaacacgatcaccaaggtggccgtcggctccgacgaatccaagtggggtctgaaggcgctggacattgccgccgacttcgccacgtgctggggtgcggaactggacgtgatttccgctgtgccgaacctgaagggtgtggacggcgaggacgccgtcatggagtcctacaaggacgatcttgaggtgcgcatcaagccgttgcaggaatcgcatcctgatctgaagatcaacaagcagatcgtttccggcccggccgtgagcgccctgaccaaggccagctacgatcacgatgtggttgttgtcggctcccgtggtcgcggcggcttcactggcttgctgctgggctccaccagccagggcctgctgcagcatgcggtcggcccggtgtacgtggtgccacgcaagtatgttgaggccgcggaatcgcgtctcgacaccgtgccgagctcgcccgccgaagtgcctaccaagtcgctggaggagattgccggcgtcgaggagattccggtgtccgcagccgagcccgaagtcgcccagcagatcgaaaagaccatcgatcccgatcgccagtaaagtccgaatatacggaaagaggctcccgccagggagcctcttcaatttatatcccgtctcagtgcttgacggtgacgttcatgcgcaccggggtctcctgcacgtaggtgtgcttgaccgtgcaacccttgtcgatatggcgggtgacgcgctccttgagcttgtcggcatcctcctcggacagaccggcgtcggaagcatcaatcaccacctgctcctcgaaaccggtgtaggcgtcgttctcagggtcgtacgtgccatccaccacaatcttggcacccttgccctcacccagcgtatgttcgatggcgaactggctggacagcgcggcgcaaccggccagcgcgaccttcatcagatcgcccggcgtgaactggccacgatccttgccgaacttaatgtgtgcgccatcgtcgctgaacgcatcccacgaaccgtccttgttacgctcaacccacagtcgcttacccatagctgctcctttattttcagccgccggcgatctggcccatcgccatgccagcgggggagcgcggcacctggccgctctcccgcatcagtggacttctctattatgcccctaagctacactggtgcacatggctttgaccgaagaacaactcgcagatattcgctcccgtatccccgcacgtcccgaaacggacattccgatgccctatgaggacctggtgcgcaagatcctgaccgaaggcacgctgaagtccgatcgcaccggcaccggcacgatttccctgttcggccagcagatgcgctttgacctgtcgaagtacttcccgttgctgaccaccaagaccgtgttcttcaaaggcctggcctatgagctgctgtggtttttgaagggttcctccaacatcaactggctgctggagcacaacgtgcatatttgggatgagtgggcggacgagaacggcgatctgggcccggtctatggcgtgcagtggcgttcctggcccgcgccgacccccgaggacccgaatcgcaccatcgaccagatctccaatgtgctcgacctcatcaagcatcatccggattcgcgccgcatgatcgtctccgcgtggaatccggccgaggtggagaagatggcgttgccgccctgccacgcgctcttccagttctacgtggccgacggcaagctaagctgccagctgtaccagcgttcctgcgacatgttcctcggcgtgccgttcaacatcgcctcctactcgctgctcaccatgatgatggcgcagcagaccgggctcaagccgggcgaattcgtctggaccggcggcgactgccatgtttatgacaaccacgtcgaccagttccttgagcagctgggccgcaagccctacccgtacccgaccatcgagatccgtaaggccgattccctgttcgactaccagtatgaggacttcaaggtcgtcggctaccagcatcaccccactattaaggcacctgttgcggtctgatgctgattaccatttcgtggacagtgaagactgtgaaggtgacggcccccgagtcttcgctgtccactacactaaggcccagttccgcaatccaggaggagtaagcgaaatggagcatgacagtagccgtagcggctatcacgaacccgagcccggatctgccgggctgtctgccactgaagaagactggggtgacgattatcccaagaccttctcggtgaatcttatctggggcgaagcccgtgacaaggaaggtcgcgccggtgccatcggcctcaatggtggcatgccttggcactgtgccgaggatatgaagcatttcaaggagctgaccgtctcccatccggtgattatgggtcgtaagacctgggaatcgctggggggcaagtaccggccgctgcccaaccgcgacaacatcgtcgtttcccacgatccgatgtaccgtgcgccgggggccactgtggtcaccagtcttgacgacgcgctcgatatggcccgtcaggaggcgattccggacgacggtctggaccgttcggagatttggatcatcggcggcgcccagttgttcgccgaggctttgccgttcgcggacaaagcctatgtgactgatctggccgccaccgtggatgccgacagctacgcgcccgatatggcgtcgctggtcgaggccgggatgtggcgggaagccgaagtgggcgagtggcatacgcccgccaaggaggagtccggcatcgattcctatcgtttccgtatcttggccaaaaccaagtaagcatgcgaatccggcttatgccctttatagcggcatgagccggattcatattcattcgaccccaacaatacagtcgggccgtgtgcggcccggtgaagcccgattgaggattgattcaaagctatgagcaatacccagccctacaccgtaatgaccgtctgcaccggcaatatctgccgttcgcctatgggtgagatcattctgcgtcacttctttaatgagcgcggtcttggcgaccaggtgaacgtggaatccagcggtgtgtccgacgaggagtggagccacccgatcgacccgcgtgccgtgcgcgtgctacgcgaacgtggctatggtgatgagattccgcgtgaccacttcgcacaccgcatctcgcgtgaggaaatcgaccgtaccgacctgttcctgccgatgaccgcctcccacatgcgcgccctgctgcgcatgctgccggccggcaagcgcgccgaagtgcacatgtaccgcagcttcgacccgaatctgcccaagccgaagcccggccgcgaagatcagatcgatctggtggacccgtggtacggcggcaagcacgagttcgaggtcgccatcgaccagattgaggaagtcgccccgtacatcgtcgattgggtggcgaagcagctgtaggaatcggcctgtggccgatgctgtgtgtttcgcagtcttacgactgcgggtctctacctccgtcaccgcttcgcggtgccgcctccctcgtcagaggaaggtacagaagattacctccctctgtaagggaggtgctgagcatagcgaagcggagggagagactaacgagtcgggtgcctcagaacaccagttgcaccagcaacatatatacaattgtgccgccggcgattgaaagcagcatattgcgtttccatacgtgcagcagcacgatgacggtgcaggcgatgagttccggaaggccgtgtgaaccggtcagaatcggggtgttgcgcagtgcgtataccaccagtagaccggtcatcgcatagggcaggacctggccgaaatactcgatgatgcgcggcggctgcttggactcgggaaacaccagaaacggcagaaaacgggtgcacatcgtgcccagcaccaccgtcacgatagtgattgcgccttgccagatggtcatcgtcatcgcgtctgtccttccttctgctggtccgctgcgtggctcatggcatggtttgccgtggcttccggggcgtcggcggctggccgcaacacgtccagatgcgggcgcaacgcgacgaacagtatcagcatggcgatcatcgagggaatcatgaaatcattggccccgaatatcagcaggcaggccagtgatgtcagcacaccgatgacggcggacagtcgctcgcgatgcttgccgtcgagccactgatcgaggaaaatcaccagaaacagcgcggtcagtacgaaatcaagaccgtcggtattgaacggcagatgcgcgccgatcagcccgcccagtgtggcgccggtcacccaatacagctgattgcacagcgtaacccagaagtagaaccagccacggtcgatgccggcggggattttcgcggtggagttgatggcaaaagtctcgtcgcacataccgaaaatcaggtatgggcgcttccagccgagccctttgaatttgccgagcatggatagtccataaaacaggtgacgggcgttgaccatcagggccagcagaaagccggcgagtgggttgaacgcggagagcagcagattcaccgtgacgaattccattgaaccggcgaagatgaacgcgctcatacacatcggccatacgaaggagaagcctttggtgcccatgagaatgccatacgaggcgccgagaaacaggaaccccaggcaaatcggtatggtcagcggaaacgccgctttgagcgccggcagccaggcgttggtgttggcgttggcggtgtctgccatgtggatgatgttctccttgtacaactggtctgccggccgatgttcgccgatgatgccatatgcggttatacacgcatggtgtcgataaacggggtgagggtggcgtcgggaccctgtgcgcgaagtcacagtgtggaggatgtcacattgtctacggtgggatagtccttgtggcgggcgcgaacacgtgctgagatgaaaccatgagcacatatcaagcgggccgaatgctttcagacctggtcccgcgaatacgaaaagacctcggtcgctatgaccgaggtctttagtgaagtacccccagagagagtcgaactctcgttgtcagattgaaagtctggtgtcctaaccgttagacgatgggggcgaacaactcgaattactttacgggaggttgttcggttatgcaaatcgacggcatttcggcgtgtcgcaatcagttcagggtaacggcctgataggtgaagtcatgaatcacgcggccggcggccaggcccttcttctcgaagttggtgagcacgcggccctcgaatcgctcggattcggtgaagtcggcgtgcggcatatcggcggccatgtcggcattgcccttgcccacgtgctccagcggcaggctgacggttacgctgcccaggttcttccagccatcgaggccgtccatcacctcgtgcacgtgcagggcatagtcctcgatgtcggtggcgatacgccagacgccgtctgtgaccagcgcgcgatgaatgtcgccggccatggccttctgcacgatgcggcgcttgtggtgcttcttcttgggccaagggtcggggaagaaggtccatacctcggccacggtgccggccgcggtcaccttgaacagctcgggcgcattgacctgggccacgcgaatgttggtcagcccctgcttgccggcgagcagcagcgtgtgggccacgccggggtcatagacctctagagcaaggaagttcgtctccgggtgggctgcggctgctgccactacgttttctccctgcccggtgccgatttccacaatgagcggattatcgttgccccatgcggactccacgaacgcgcggtcgagcgtgacgccttcgcgcacgtccagcaggttgccggccgcaatatccaacagatatgtgccggcatagttgtcccatgcgcgctgcaggcgatcgtccaaacgtccggagcggcgtacgaaggagagcaccttgtgcagggggtgcgccggtgcctcggtgtggtctgtgcccatcgcggcgacgggatcgattgctgtggattcgggattggtcatatattcctcggattttccttgtgcgccgcaccgctgttcattcattaggtcgatttggcgttcattaggtaggtggtgtgcgataccaaccaccatatcaagccgtttacccggtgtccgtgcgggccggctccgggccgacctacctaatgaacgccaaatcgacctaatgaatgcagatattgccggacgacaccaccgttttgtgcgattatgttcgtgtgatatactcaaattgtttcaaaaggtaacaaagcggaccaaaagtgaacagccgctgaactccccacggccgacacttgcaacccgcacaaggaaaggtcaactatgacagttctcgtcaccggcggctgcggctacatcggcgctcatgtcgttcacgcactccatcaggccggcgaaaaggtcgttgtcgtcgacgatctgagctacggcaagcccactcgcatcgaaggctcccgcctgtacggcatggatatcgccgccccgggcgccggtgagcgtttggccgaaatcctcgatgccgaaggcgtcgactccgtgatccactttgccgctcgcaagcaggtcggcgaatccgtggagaagccgctgtggtactaccagcagaacatcaacggcatgctcaacgtgctcaccggcatgacccagtccaagaacgccaagaagctcgtcttctcctcttccgccgccacctatggtgtgccgccggtcgatgtggtgcctgaggatgtcgtcccgatgctgccgatcaacccctacggccagaccaagctgttcggcgagtggatggcacgcgcctgcgagcagccgttcggcatccgcttctgcgcgctgcgctacttcaacgtggccggctgcggtccggtggagcttgaggatccggccatcctgaacctcatcccgatgctgttcaatcgcctcaagcagggcaaggctcccgccatcttcggcgacgactacccgactccggacggcacctgcgtgcgcgactacatccacgtctccgacttggccgacgcccacatcgccgccctcaagtacctcgaccgtgacgagcgcaagtacgacgccttcaacgtcggcaccggcgaaggcacctccgtgcgccagatcgtcgacgaagtcaagaaggtcaccggtctgccgttcaccgaggctgtcatggcccgccgcgccggcgacccgccgcacctgatcggctccccgaagcgcatcaacgaggagatgggctggcatgccaagtacgacgtggaagacatcgtcaagtccgcgtgggatgcctggcaggccaaccccgaacaccacatcgacgtcgacacctggaagcaggctgactgagattgacggtcactttgcggtggatgccgcgaagcgtttccgtccataagggcgtggccggggttccggtcgcgcccttcgtcgttttgtggatgtttgtgacagacgtgttcgcgtgctggtgatagcaaaaaccttgaaattatgcggaacacgccgaagtttgcatgactggcgaatttcagtaatatatacatctgttgcctcacgcaagtgagaacaatggccccgtagctcagttggttagagcgccgccctgtcacggcggaggtcaccggttcaagtccggccggggtcgctggaatggttatgaagcccggattatccgggtttttgactgttcatggctctgtagctcagttggtagagcgagcgactgaaaatcgctaggtcaacggatcgacgccgttcggagccaccacaatgaagccccgccttgtgcggggcttttgcatatccgtcacgtatctactccggcgggctggccggtcaatgcaaaggctcgcgttcgccaacaactgtcttcctcgccgcaactatgcacgccaacagcaccaatgcgaacatcgggttagggttaaataaagaaacgtgggtcttatccgcgcgtgtcatggtcggtgcgatcgtccgccccagccgtttctggggctgtggcgctcatagagtcagtattgcagaaaaagcacctgcgaaatgcgcgtgcgaagggaatcgtgtgggacggcacgtgattttgccgattttcgacgtgccgtcccacagcgttcgaagaacgccctcagagctgagggcaaagaacggctctattctgcggttctcggcttatgtcatgcgggatagcagatacgtcaaacgattgatgtatctgctatcccacacttctgtgggacggcagatgaacaatggtaaaaaccgcgtgccgtcccacaaaaaggaatcaggcctgccaccattggcgcagggggtaccacttgccgtccgggtgggccacgcgatccggcttgacggccaagaactggtgaatctggatgccgtcgagctcgaagttcagagcgcaggcggccatgtacataccccataccttggcgcgttcaaagccgacctgcttgaccgcgtcgtcccaatgctcggagaggttctggttccagtgatgcagggtgagcgcgtagtgctggcgcaggttctcctgatgcaccacgttgaagccggcgtcatggatgcacgattcgatgaagccgggcgcgccgagatcaccgtccgggaagatgtaacggtcgaggaattcgtcggtaccgggcttgccgtgaggcttgtcatggctgatggtgatctggtggttcagcagtcggcccatcggcttcagaaggcggaacatctcttcgaagtagctctggtagttcttgacgcctacgtgctccatcatgccgatcgagcagataccgtcgaagtcgtgctcaggcacctcgcggtagtcctgcacacgcacttcggccagatcctgcagcccttcacaggcgatccattcgttggcgtacgcggcctgttccttggaaagggtgacgccgagcgccttgatgccgcgacgggcggcggtgatgaccatcgaaccccagccgcagccgatgtccagtaagcgctggccgggctgcaagtccagtttgtcgagaatcaggcgcagtttgttggcctgtgcgtcttcaaggctcatgtgttcgttgtcgaataccgcgcaagtgtaggtcatggaggatccaaggaagtcggcgtagaactcgttggacatgtcgtagtggaagctgacggtttccgaatcggccttttcggtgtgcggcatcaggccacgcttgatacgggcgaacttgctcgggccctcggtggcgggcaccggcggcttcttgaagccatggctcaggatgccggcagatacgcgggcaattgatgtgggagtgagtgggcgaacgtatttggacagcgacaccagcttgcgcatcgccggatacgggtcggcgtagtcaatgccgtccacgtcgaaatcgcccagaatgtatgagcgcacgatgccgatttcattcgggtgcgcgagtagctggtacatgcagttcggcgtggcgattttgaccttcaaatccgcgtctgccgggccgaaatgcgagccgtcgaaagcgtcgatacgaacgggagtggcggggtcgagaaacagggacgccatctcgccgaccgtcatagccttgccatttgccattatctacctcattctcttatgatgatcaccccaactgtcgaggtatcttagtcctcttcaggagactgaaaccgttgaatacaccatctggtgaaccagttcgcgttcggctgatgaagcacgaatggaattaggcatctcgcatattgattgcgctacgcgcgaagtaggcggatgagagacgagtttctcggagagcgtcagatgactccggaaaatggtcttatcgttgagatttcgggcgatggaactggtttggtcaatggacaataattcgacaagtgcggaattccgccatttcttgccattattttcagtgttgttctttcagcgtgttttcaggtgaatgctcatgcgcggagtagactggggaaccgttggaccactcaaagacagagtgaaccaccagttaagacactagctcaaaaggagagcccctatggtgtaccgcatgattttcaaccagactgcatacttcggacgtggcgcgatcaaggagattccggccgtcgccaagcagcacggcttcaccaaggcatttatcgtcaccgacccggtgctgctggagaccggcaccgccgagaaggtcaccaaggttctggatgaggccggcctgccgtacgaggtgttctccaacgtcaagccgaacccgccggtcgagtgcatcaaggacggcgtcgccaagttcgccgagtccggtgcggacttcctgatcggcctgggcggtggctccccgcaagacacctgcaagggcatcggcatcatcaccgccaacccggagttcgccgacgtgctttctctggaaggcgtcgcggataccaagaacccgtccgtcccgatcttcggcgtgccgaccaccgccggcaccgcctcggagacgaccatcaactacgtggtcaccgacacggccaacaagcgcaagttcgtggctgtcgacccgcacgacatcccgatcgtcgctttcgtggacccggatctgaccgactcgatgccgcgcggcctgaaggtcgccaccggacttgacgccctgacccacgccatcgagggttacattaccccgggtgcctggagcctgtccgactgcctgtccatgcagaccatccgcatgattgccaagaacctggccaagtccgccgacggcgacattccggccggcgagcagatggcctacgcgtcctacatcaccggtatggcctactccaacgtgggcctcggtctggtgcacggcatggctcacccgctgggcggccgtctgggtgtggcccacggtgtggccaacggtattctgctggccccggtcatggaatacaacaaggacttcaccggtgagaagtaccgcgacatcgccgatgcgttcggtgttgaggacgcctacaccggcgacctggagaaggtgcgcgaagaggccgtgcaggccgtccacaagctgaccgtggatctgaagaacccgaccacgatttccgaagtgggcgccaccgaggccgaccttgagccgctggctcacgatgccttcaacgacgtgtgtacccccggcaacccgcgtcaggcaaccgaagaggacatcctcgcgatttacaagtcgctgatgtgatcagtcaatgacagtaaacattagctccctctgatgagggagctgtcagcgtagctgactgagggagagaagttgcggcgtagccgctgaataataggtatcggcctgcgtccgattcaatgttttagcgactgcgtcgcagtctcttcctcagtctcacttcattcgacagctcccttatcagagggagcttgcataagcagagggggctcgtatatctagctacttttcgtgcttttcgtcgtagacttcgtcggtgggggtctcgtcgtacagctgcttgccttgcgcctccgccagttccatctgctcgttgatccacgcggcttcagccggattgatatccgcggaattcagcactttctgccacaccgggtagaacatatgcatcgccggatacatggcggtgaacaacacctccggcttatgcgtgcgcgtatgttgcggatgcgcatcaaacgtattcttaaaacgtcgcatgtagctcaggaacgaactcaacgacgtatccatccgtcgcgcactcatcgcggcgatcatgcgcggcgagtacacggttttcagatccttgcccatcagatgcagggaaatatcgatatcctcatgcatcacatcggccttatcccggcagacctcattcgcaatctgatgccaggccgaagcgcgcaaggccatattcgagccgaacagcagcggctggccgccatcggcgcggtagattcgcttgcgtaaggaattgtcgcccttcaacccgaaatggcgtgagggcatgtcgtaatacatcaccggaccagtggcacccatcgcggccgggtcttcggtgaagatgccggagaccacctccacccagtcaggccggatcatacagtcggcgtcaaaacggcccagcacatcgccggtcgcggcgttcaggccaaagttgcgggtgggaatcagcccctgttcatcgttctggtgcaacagtttgaccggggcctcgggatgttcggcaatgaactgttcgacaaccgcacaggtgttgtccgtagaacgattgtccaccaccagcacctcatgcggcatgatggtctgacgggtggcgttcagcaggcagtcgcggatgcgttcggcttcgttccacgctgggatgatgatcgaaacgttgagcataacatcaacaatagaaaagcgggtgtacgccgccggcgtatccgagcttcaaacccctcgctacaatggggagccatgagcgaacgcgtgcgaaacgtaaacagcaccgacacgttgagaaccggtgccgcagaggccggggcagacccggacgacgagaatcgtatcgactttggtactttgttccccgccaagggagattcccgtaggccaccggaatggttcggccgcgcgctgctgtatgtggcccttgccgtcatcgtattcatgttctgctggcgctcgtggggcgacatctcctatctagtgctcgacatcatcatctcgctgttcctggcgctggccgtcgaaccgttggtggtggcgctggtggctcatggctggaagcgtggcgtggcttccgccgtcagcttggtgggcgtggccgtggtcgtgggtgtgctgctcacgctatttggcaacatgttcgtacagcagatgattgccatggtccgcggtttgccggccatgtatgagcagattcgtgagttcgtggaccagtatgccacgttcaagatgccggaaatcagcaatctcggcatggaaatcttcaacaatatccagacctcgtgggtcaccgattttgccggtaccgccatgagtacggtgggcggcctgttctccttcctgctgaacctcatgaccgtggtcatgaccacgtattacatctccgccgccggccccaaactgcgccgctccttctgccagtggctggcccccaacacgcagcgccgattcctgctggtgtggaccgtggcccaaggccagatttcgtccttcctgttctcccgttcgattctggcgttgatcaacgccacctgcactgccatcttcttagagattctgcatgtgccctactggctgccgttggccctgttctgcggcgtggtatcccagttcatccccacggtcggcacctatatcggcggcgcgctgccggtgctgttcgcttggggcaaccgcggatggacgtacgccgtggcggtgctggtgttcatcatcgtctaccagcagatcgagaacctgattctctcgccgaggatttcgcagcgcacgatggatatcaacgcggccgtcgccttcctcgcggtgctggcgttcggctcgctgttcggcgcgtttggcgcgttcctggcgctgccggtcaccgcatcgctgcaggccatcttccgtgcgtacaccaagcgctatgagctgattgactcaccactgatgaacgatccgactccggagaagaagtccaagatcgtcgaggcgtccgaagcgttcggcgagcatgtgctgcagccgatcggcgagcacatgccgcgtgcggccaaggggtccaccagccgtgtgccgatgaatgaggaactgcgtttgctgcaggaacagatctatgcgattccgccacacgagacgaaagaatccgatttggacgattccgccaccgtggcgattccgcagcgtggtgccgcggatacgcagcagtctgagcagcccaagcaacgcaagcaaaccaagcagtctgatcaatctgcctccagcaatcctagggcggggtggcgctgatgaccctgctttccgtactcgatattcttctggtaatcgtcggtggtgccggcatgatatatcagggactgtgcatcgtgatgtccctgttcgccaagcccgtgcgcttccccgacgccccgatgaccaaccggtatgccgtactgatctccgcgcgcaacgaagaaaacgtgatcggcaaccttattgggtcgattcgcgatcagacctacccgtccgacctcatcgacatctggctggtggccgacaactgcaccgacaacaccgccgacgtggtgcggtctttgggctgccatgtggtggaacgccacaatcttgaactggttggcaagggatatgcgctgacgtatctgttggggcatatgctcgacatcggtgtggccgatgattatgaggcctacttcgtgttcgatgccgataacaagctggacaagcattacttcgaggaaatgaacaaggcgttctgctccggattcaagattctgaccagctaccgtaattcggtgaatctggcggatagctgggtgtcttctggttctgcgctgtggttcatccgtgaatcgcgattcctgtctaactcgcgtatgattctcggttcctcttgccatgtgggcggtacgggattcatgttctcccgcgaggtgatgaagcggaacaagggatggaagttccacctgctcactgaagatcttgaattcactatggattcgattctgcatggcgaccgcatcggctattgcggtactgcgatcctctacgacgagcagccggttaccttctcgcaaagttggcgtcagcgtttgcgttggagcaagggattcctgcaggtattccgttattatggctcggcattgctgaaacgcgcggttcgcgaacgtgatttctcctgcatcgacttcaccttgatgctgtgtccgtttaccgtgttgggcgtgattcgcgcggtgatgggcttgctgttcgccgcgtgtggcttcgtgagttggtcgagccagctgcaatcgctggccggttggtccagcggcatcatcacatcggtgttgggtctgatggcattggctgcattgaccatcattgtcgagcacgaccagatcggtgccacgaacaaggagctgctcgcctatgtgctcagcttcccgatttacatgctcagctacgtgccgatttccttccaggccatcttcgccaaagcccagtggaagcccatcgcacataagggctgaccgagtccgctagtccggagctgctcagcggggcaatccaacagcaacccgggggtgctgcgctgagggttgactggtgggctagagtagatgcatgagcttagacaatactcaaaggaatgtcggatttcagccgccgatgatgccagccgccgctcccgcgtcttcgcagtcgcaacagccacagccgcaagcatggccgccgaacccgaatacggcggtgtccattcgcggcctgttcaagcacttcgaccggaagatcgccgtcaacgggctcgcgcttgacattccaatcggctcgttctacggactggtgggccctaacggcgccggcaaaaccaccacgctcaatatggtgaccggtctattggtgccggacgccggcaccgccatgattctgggccatgacgtgtggagcgacgtgaacacggccaagcgcatgatcggcgtcatgccccagcccgaccagatcttcgaccgactgaccggtttgcaattgctcgtctactccggcatgctgcgcggcatgagccgcgaggagaccacgcgtcgcgcccaggacctgctcaatgctttcgacttggccggggccgccaacacgatggtcaccgattactcggccggcatgaccaagaagatctgcctggcctccgcgatgattcacagcccgcgcattctggtcttggatgagccgtttgaatccgtggacccggtgtccagcgccaacctcaaagacattctcatcgaatacgcgaagactggcggcacggtgatcatctcctcacacgtgatggcattggtcgaaaagatgtgtacgcatgtggccgtaatcaacgacggtctggtatgcgcggccggcacggtggacgaggtcgctgctggcgaagaactcgaagaccgcttcctgcaactagtcggtggccgccacgaagccgcccatctcgcgtggctcgatggcgggcaggcccaagcccaagcaccaacttcggcccagacgattcagccgattctgcctacgcccgccacacccaccgatgaggcccgccaatgatcaagaccgccatcaccctggtccgcctgcgctggacgctcacgctcgccaccctgcgaaaatcggcgtggcagaccgtcgcctatgtcttttccgctgtactcgcggccggcaccatcatcggcaccggcgtgctcgcatggttcatcggcatactgccgcccttcaccgtgaacgcggatggctttccgctgaacatccttggtcccggaggcatcgtcaacatagtcgtcgtgctggtcggcgcgaccatgaccatcttcatcggcttcatccagctcatgatgcttggcgaaggctccaccatgaacccacgcaaattcgcgatctacggcatcgccgaccgcaacctgcaattcggcttgctgctttccggcctgtccggcatcccctcccttactggcgtggcctcactgatgctctggacactggcctatcggcatatgggaccagccgtaatcatcagttccctcctcgccgcagtgctggccgtcatcaccatgatgagcatctccaaactggtcatcgccctatccaccacgctggtgaccagcaaacgcggcaaaggcgcgttctacatcttcatcgtgctgactttcgtcatcatctgccagttgccgaacattctggtcaactccggcatagccttcagcctcaacaccgagacctggggcgcggcgaccgccatcgccgcatggacgccgttcggtgcggccttccaactgccgttcgacgcgcttaccggagcttgggcggtgctgatcgcccgcatcgccatccttgccgtcacatggatcgtctgcttcgccgtatgcacttggtgtctgaggcatgaacggctcaccatcggcgcaaacagtccgtccgagaccgccaaaggcatcggcgcattcgcatggatgcccgattcggcatccggcgcggtgtccgcacgcctgatcacctatctcaaacgagacccccgccaagccatgaccttcgccatgccggtcctgttcctgatcatcttcgccttccaggcgcacggcatcagcgcggtcgtctggcagtcgctgatctggtgtggctggttcatgtcagtggtggaaagcaacgggctcgcatatgacggccgcggcttcaccatggaagtcatcgccggcgtgcgtggccggaccgacagaatcggccgcgtgcgcgtctacgtcggcatcatggtcgtctacatggtgctgctctatctcgccggcatcgtgctggtcggcgcactgaccggccgctgggcgcagcccgatgacctcgtcaccggcctgatcttcctcgccgtgggcatgggcgtcgccttgagcggcctgggcgtggccgaagtcacgtcctgtgtgctgatgtacccggtcgcctcaatggacaagccgttctccgcgcctcaaggccgcgccatggcccaaggcttcttcccgttcgtctacgtgcttggcagcctgctgctgatgctgcccaccggcatcgtggcgctggtcatgctgctgacgggagccgaaggcggcatatggctggcgattattccggtcgcactggccaacggcatcggcatcctggcactcgggacatggctgggcggtaagctgatggatgcgcgaatgctttcgattgtggcagcactcgactcgttcgcctcattgcagaaatgatcgccttggcataaggagcacgatggtatctacagcggtatcacgccgtcagcggcgtgaagcgcaacggcggacccaacgatcgcatcgccgaacactgaccgtcatcatttccgcactgaccaccatcgccctgttcgcggggtactgcgccgccgacatcaccgacgtggcccccggattattgacgttgaagcccgtcgccgcacctgtttttgccgatccagccaccgccaaatcaggcggcaccgtcgccggcaccttgaacgcgaacaaggccattgattccacggccgcttctgcgctggtcaacgaattgctgtccgcgcaaggcgtgggaaacgatacgtcggtgatcattgaagacgcccaaggcaccgtcgctgccgaacatgagtcgaacactccacgcgagcctgcatccacactgaaaacgctgaccgcgctcgccgcctcatccaccctgaatatggcatccaccttggatacccaagtgttcctcacccaatccgatgacggcaccaatacgttgaccctcaaaggcaatggcgacatgctgctgtctgcaggcgattctgacgccaaccataccaacggacgtgccggtctgaacaccttggccaaggccaccgtggccgcgctcgcccagcgaggcatcacttccgtcaatctcgagtacgacgacaccctattcggcgactcacgcattccggcaggtctgtcggaaggcggcgcagtcttaagcgactacaccgtctacttcacgccggtctcatcaatggcgattgatggaggccgccaatacaccgccgatacgcctgcgccggccgaccccgatgattcggccggatacccggaactgtcccagcacgccgccagcgacgtggccacgaaattcgccgaactgctccaatcgaacggcgtggccgttaccggagacgtgacggcaaacaccgctccatccggcgaaacgcctttgtcttcggtgagttcggcaacactgtccgaaatcatggcatacacgttgcggcattcggacaatacgctggccgaggagttcggcagactcaccgccttggcgaaatcagcgacaaacagtcctgaaggcggcacggaagcggtcaaatccactctgaacgatctcggtctcgacacatccggtctgaccatggccgattgctccggcctgtctcccggctcccggctcaccgtacgcacgctggcggccgtccaacaacgtaatctgaccaccgagagcggtgctgctggtgcggaaggtctatccatcgcgggattggtgggcacggcgcaggatcggtatacggatgatgccgtggctggtctgctgcgcgtcaaaaccggcagcctcggcacggttacgtcgatggccggcaatgtgtcccgcaccaatgggggagcgttgtcgtttgccgtggtggtcaacaatcctgaggattatgccgccgcgcgtagcgccatcgactcgtttatcaccaagctcgcggggctgtaaaagaggcatcaagggccatcaagggctacaaaggccgtaaacgtccataaacgcacgagtgcctataaccagaaaaaaggtggtgagtacatggcatattccgcacgattgcgcaaggccgtaggcgcggtccgcgcaacgctgagtgccgtggaactatgcgatgtgcaggctcccgaattcgcgcagcatggggaccatgccgttgccgccgatgcgccgctcgtgctcgtggcctgttcaggcgggcgcgattcgatggcactggctgcggtgagccatatcgtatgcacgtccatgggcgtgcgttgcggtgccgtgattgtggatcacggcttgcaggcaggctccgaacgggtcgccagcgaggccgcggatcgttgccgcgcgttgggactgggcccggtcatcttgcgcaacgcaaccgtacaggcgcgcggcgagggcctcgaagcggccgcacggcaggcccggtatgacgagctgtgcgccgcggcgcatgaatcgggtgccattgccgtgctgttggcccacactatggacgatcaggcggaaaccgtattgattggcctgctgcgcagtcgaggcgtggatgcgttggctggcatgccgcaggtcttcacacgcagtggcgcgacttttgcgcggccgctgcttacccttactcgagccgaaaccaccggcatctgtgaagacttaggtgtggaatattgggatgaccccaccaatggcgatgcggtagacggcgagttgccgaacgactatccgttgcgctcgcgggtgcgtcacgacctgctgccggccatcgaacgattcgctggattcaatgtcacccgccatttcgccgaaagcgcacggttggccagaatggataaggagtatctggatcagcgatccgacgaggtgatgggggaggcggttgcggcagttgattggccggcatcgtcggcagcggtatcgaccgatgcgccacgagcctgtgtggcaggcgataccaacgattcgagccatggcatcggcctgatgatcagcgtcaaacgtattgcacgtgagccagaggcgattcggttgcgggtcatcgctcacgcgctgagccaagccggtgtgaacgccagtgctgcccagattgccgccatcgaccggctggtcgtcgattggcatgggcaaggcggcgtctcacttcccagaggttattcagccaatcgcaagaaacacgtcattcgcgtgtgccaagatggagcgcatgcgaatcgctgacgttgaggaagatattgaccacgagctggtcagcaaagaacagattgatgccaagatccacgagatggctgctctcgcgagcgaggattaccgcgataagaatccgctgctcgtcgcggtgctgaaaggggccgtgaatacgctggtcgcgttcacccaggccatgagcattcctgtacagatcgacttcatgagcctgtcgagctatggctcgggcacagtgtcgagcggtgaggtcacagtcaggcaggatttgtccgccgatgttcgcggacggcacattttgattgtggaggatattgttgattcaggacgcacgctcgcgtggctggtcgcagaactgaaacgtcgtggtgccgcttccgtggaagtcttcgctttgctgagcaagccttcccgccgagaggtggacgttgatgtgaagtacgccggctatgagattccggacgagtttgtcgtcggcttcggcctcgactttgacgaacgctaccgcaacctcgattcgatcgcggtcctcaagccgtccgtctaccaaggagtgcaagcatgagcttcccgcaagggccgggtaacggcaataacccgaacccgaacaacaaccgtaacaacggcaacccgttcaccaacccgttcaaccgtggcaataacgggaacaatggcaaaggcaacaaagagaaccgcccgatatggcagtccccctggctgtggggtgccgtgctcgtggtcatggttgtgctgatgttccagatgttcgccggcggtggcaccaaaaccatcgatactaaagatggtttcgcgctgatcaatcagggcaaggccacatacgccgagatcacggacaacaagcaggtcgtccgccttgagctgaagaatgactacaccaagaagaacgccgacaccggcaaggtgaccaactacggcaagaacgtgcagttctactacactttcgcccagggcgcacaggtggccaaggccgtggagaacggcgatctcgaaaagggctggacctcgaatatcgagcagaccagtgtgatgagctacctcatcacctcgattctgccgttcgtcatcatcctcgccttgttctggtggctgatgagccgcatgggcggtgccggcggcatgctcggcatgggcggcaagaagaacagcggcaagctgctcgagggccagacccccaccaccaagttcgccgatgtggccggtgaagacgaggccgtggccgaagtcgaggaaatcaaggacttcctcaaggatccgtccaagtacaaggcgctgggtgcgcgcatcccgcgcggcgtgctgctgtacggccctcccggcactggtaagacgttgctggcccgagccatcgcaggtgaggccggcgtgccgttctactcgatggccggctccgacttcgtcgagatgttcgtcggtctcggtgcctcccgtgtgcgtgacctgttcgatgaggccaagaagaacgctcccgccatcatcttcatcgatgagatcgatgccgtgggtcgcaagcgtggctccggtatgggcggtggccacgacgagcgcgagcagacgctgaaccagctgctcgtcgagatggacggtttcgacaacgacaccaacctcatcatcatcgccgccaccaaccgtcccgacgtgcttgaccccgctttgctgcgtccgggtcgattcgaccgtcaggtgggcgtggccgcccctgatctggaaggccgtgaggcaattctgagggtgcacgccaagggcaagccgttcgtaccggacgtcgacctgcatatggtcgccgtgcgcacgccgggcttcaccggtgccgatctggccaacgtgctcaacgaagccgcgttgctgtgcgcccgtgccggtgcccagttgatcgacaaccgcgccatcgacgaggccatcgaccgcgttcaggccggaccgaagcgcaagtccaagggcatggctctggaagagctgcgcaacaccgcataccacgagggtgggcatgcgctggtagccgccgccctgaacaacaccgacccggtgaccaaggtgacgattctgccgcgaggccgcgccctcggctacaccgccgtcatgccgacctccgaccgctactcgcagtcgcgcaaccagctgctcgaccagatggcctacgcgatgggcggtcgcaccgccgaggaaatcgtcttccacgacccgaccaccggtgcctcgaacgatatcgagaaggctacgaacatcgcccgtacgatggtgatcgaatacggcttctccgacaagctcggtgccatcaagtggggttccgacgatgaccagaccactgtgatggacggtctgcagccgcgcaagtactccgaccgcaccgccgaagtgatcgatgacgaagtattgaagctggtggaaaccgcccacaccgaggcgtggaccatcatcaacgacaaccgcgagatccttgacgagctggtccgccagctgttggtcaaggagaccctgaacgagaaggaacttgcggcgatcttcgcgccgatcaagaaggctccggttcgtccggtgtggttgtccaacgaccgtcgccccgactcggacaagccgccggtggagatccccgaaagccttaagcgctcggtcggcatgaagccggaagagtagacacgatgacgattcggcccgacctgttcatgtggtttctcacgtacgcaggccggtccgacgtcgttgtggacaatgacaagggagagatgagatgaacgaatatatagagtcttgccatcgggagaaacacacatacgacgaggaaggcgtgcgcgaggccgtacgcctgttcctgaagtcgattggcgaggatcccgagcgcgagggactggtggaaacgcctgaccgtatcgcccgcgcgtgccgcgagctgttcgccggtctgcaggcttccccggccgatgtgctggagaagcacttcgacgtggataccgacgagctggtgctggtcaaggacatcgaactgtattcggtgtgcgagcatcacctgctgccgttccacggcgtggcccatgtgggctatattcccgccaaggacggggtgatggggctgagcaagctcgcccgactggtcgaggtgtatgctcgccggccgcaggtgcaggagcgtttgacccagcagatcgccgacgcgctggtcgagtatgcgggcgcacgtggtgtgattgtggtgaccgaatgcgagcacctgtgcatgtcgatgcgcggcatcaagaagtcttccgcccgcacggtgacctctgcggtgcgcggcatgctgcgcaatccggccacccgagccgaagccatgagcctcattttggataaatagtgtctactaagctccctcatcatagggaactcacttgggacctacatagaaggggaaacataatgactgatttgcaggcgttgcatgacagtacgcacaccatggtgatgggtgtgctcaacatcaccgaggactcgtcctcggacggcggcctgtggttggacccggccaaggcggcacagcacgggcgcgacatgatggccgccggcgcggacatcatcgacatcggcgccgaatccacgcgccccggcgccaagcgcgtgtctgaggccgacgaattggtccgcatcaccggtgccgtcaagacattgattccggccggtgccatattgtccatcgacaccacgcgcgcatccgtggccgccgctgcgctgagcgagggcgcccagatcatcaacgacgtttccggtggcacgctggacgccgaactgccgcacgtggtcgccgaccacgactgcctgtacatcgtgcagcattggcgcggctggctcgccggttccaagggcgcgaaccccgatcaagacacctccgtctacgagcacggtgtattgaccgacgtacacgacgaactcatgcgccaagtcgacggtgtgctggccgccggcgtaaagcctgagcgcattatcatcgacccgggcctgggcttctccaagcccggcatcgagcacaacctgccgctgctgaccggactcgagaccttccgcgccactggatatccggtgctgatcggccagtcccgcaaacgcttcatctcggcgatgcttaccgaggcgggcgctgccggtgctgatgggccgatcatggcccagcgcgatgacgtgaccgcagccttgtccgccctgtccgccgaacacggcgcatgggccgtgcgcgtacacgacgtggccaaaagccgcgccgccgtcatcgccggcaacacctggcgcgaatacgcatgattcccctggctccctgttttggttgcttctaggccttggctcccctcgggcgaggggagctggcgccgaaggcgactgaggggagcatttgagcagaaagccttaccaatggacaccatcacacttaccggcgtacatgccaacggcacccacggtgtgctcgccttcgaacacgaacggccacaaaccttcgtcgtggatgtcaccctgcaccttgatctggccgcagccggtcaatccgacgatctcaacgacaccatcgattacggccgtgtggccaaggacatcacggctgtcatcgaaggccctcatgtggacctgatcgagcgtctggcccaacgtatcgcggataagatccttgccgatgcgccggccgtcgcctccatcgacgtcaccgtgcacaagcctcacgcacccatcgtcgtggcttttgcagatgtatcggtctccatctcgcgcgtgcgtgccaccgataatggacgcactgctgaagagcatgccatccataacgcggtggtggccttgggcggcaatgtgggcgaggtggaatccaccttgcgagccgccgttcgggagattgacgcgttgcctggcacacaggtgaccggtatctcaccgctttaccgcacggccgcgtggggcatggccgacggtacgccggatttcctgaacgccgtggtggagcttgaaaccacaatgggcagccacgaattgctcgccgcgttgcaaagcatcgaggcgaaccatgggcgaattcgtgagaatcattgggattccaggccgttggacttggacattatcgactttgatggcatcaccagcgcggatccggatctggcattgccccatccgcgtgcttggcagcgtgcgtttgtgctggctccttggttggcattgaatccgaacgccaaactcgccggagcccatgaggggcctgcagccgatttgctggccgccgcaccggaccgtaacgccgtgcagctcgagagcgaagactggatgctcggcgggcatgcagtcaagcaaaaatcagcgtcggagtcggcacccgtctcacgcaaggcgattatttcgctggattccacctcgcaggatgtcgaacggctgttccgcgaaaccatcgtttccatcgacagtgttcctggcaatcaggtacagggcatctcgccgctctaccatgtcagccatttcgacggcccggacgcgatgagcgcggtcatccaaatcgaaaccaagttgccgcccgccgacctgattgccgtattgggcagcatcgaaagtgttcatgatctggcagtcgaccttgaccttgtcgacatggaaggcgtgacttccgacgagcccaactgcagcattccttggccgtcggcccgtaaccatgcgtcggtattggcaccttggctggatatggacccgaatgcttctctgggcggcgacccggtggccttccttttggccatggcaccggatgccggacaggtcggattgctatcggacaactggatactgtcgaacagttgagctgatggcggaaccagttacgaacggtaggctagaaaccagacggtgacggaccagtctccggcctcgaacagccgggcacggcagtgacgaaaaccaaatcaagatgaacagcccaggcgcgagggccgttcgcaaacagcaaacagcaacgcaacgataaggaggccggacatgaaaacacggcgaacaccatggtggcagtatgtgatcggtgccgtgctgggcctgttggcgggtatcggtctggcctcctacggcgaaagctcgggactgtcgctgattggtgcgccttggattgtgaccggattgctggccgtgctgggcgttatcgtgctgatcttggccctgcaagtgcataaatacgcgaataccgaccccaagaagcgtccgcatagcttcatcaatcccactatcgcggtgtatacgctggtgctggcaaaggcactgggattggcgggcgcaacgcttgccggctggtatggcggtcagattgtgatgagcctgagccatatcgaggcggatttctatgcacacgccgtcaccgagtgcgcaatcgcggccgtggtgtgcatcgccgacatgatcatcggcattatcggcgaatggttgtgccagctaccgccgaacgaaggccccgaaaacccgaaaatcaaggaagccaagcgccgtagcgacatagcccaagcctacaaaagataatccgtgataagccccctctgacgagggggccgtaggcgtagccgactgggggagagaagaaaaaaccacaccatcggccaagccgattcccgctattcctgcggcacgcgaaccatagcttcctgagcgatggccgccaccaagtcgccattctgcgcatacactttggcgatgccgagtccgcgcccgtgcgcggcgataggcgtatcctgcacatacaaatgccattcgttgatatcgatatcctgataccaccacatcgaatggtcgatggacgcataggaaatgcccggtgtggaaatcgacagtccggcgcggcgcagcaccggctccatcatcacctgatcgcagccgagtgccagcatcgcacgatgcatgacctgcggcacatcgacgtggccatcggccttcatccacaccatctgcttgccggaatcatgctcggcggaatctttgtccgcgcgcagcatcacggtcggcgtcacgtggcggatatcgaacggcgatttctcggcatagtaattggcgaacggcgacttttcggcgaacggctgcatgagttccttggcggaagtcaacgtttcgggatcgggcaggttttccggcatcggatcggcaaattccacaccctcctgaccggtctcctggaaggaggcgatggccgtgagaatcgacccctcggcttgggtgacgttgacccgacgagcggagaacgagcggccgtcgcgaaggttctcgacgtcaaacagcaggtcttgacgaatatcgccggcggcaatgaaatagccatgtaccgaatgcggcaggcgtgaagggcccacggttttggacgcggcaatcaccgactgggcgatgacctggccaccgtagacgcggccggtggggaagtacatactctcgccattgatgtatgtgtgattgcggtaagcggaaggctcgcccaactccagcaccttcaccagatggtccaatggagttacggtggttgcctgagccatggcgttcctcgattcttgttctgctgtgttcgatattcggttatcgtattccaacctatggttggcagtctatccggtgggggttaagagttccgggagcgaaatgtaacgagactgtttggaaggtaaacggttggttatgcggtgcgttgtcgctacgttgccgctacgttgctgctgcgctgccggtgtgttgccgtaggcgactgtgggattttatgggatgcggtgcggggcagccatggggcaattatggggaaagccgcccctgagggacggctttcgacgtataaagcacgttgtggcactaatgccggcgtatctcagccgcgcacaagcttcttgtgcaggcggtgcgggcgggccgcatcctcgccgaggcgtgtcaccttgttctcctggtaggcctggaagttgccttcgaaccagtaccacttggccgggttgtcgtcgtcgccttcccacgcgaggatatgcgtggcgacacggtcgaggaaccaacggtcgtgggaaatcaccacagcgcagccagggaattcgagcagcgcgttttcgagggattccaaggtctcgacgtccagatcgttggtgggctcgtcgagcagcagcaggttgccgccctgcttcagggtcagggccaggttcagacggttgcgctcaccaccggacagcacaccagtcagcttctgctgatcggcgcccttgaagccgaagctggccacataggcgcgggtcggcacctccacaccggccacctcgatgaagtcgaggccgccggacacggcttcccacaggttcttgttcggatccaggccctcacggttctggtccacgtagctgattttgacggtgtcgccgatcttcagctcgccgctggtcagcggctccaggcccacgatggtcttgaacagcgtggacttacccacgccgttcgggccgattacgccgacgatgccgttgcgcggcagcgtgaaggacaggtcgtcgatgagcacacgctcgccgaaggccttgtggatgtggttggcttccagcacggtggaacccaggcgcgggccggccggaatctgaatctcggagaagtcgagcttcttgttgttgcgtgcctcgttttccatctggtcgtaacgctccagacgggccttgttcttggcctgacgggccttgggggaggagcgcacccagtcgagctcgttcttcagtcgcttggcgagcttggcgtccttggctccctggatctccagacgcttggccttggtctccaagtaggtggagtagttgcccttgtacgggtacaggtggccgcggtcgacctcgcaaatccattcggccacattgtccatgaagtaacgatcgtgggtgacggcgatgactgcgcccttgtactggtgcaggaactgttccagccacaggatggactcggcgtccaggtggttggtgggctcgtcgagcagcagcaggtccggggcctcaagcagcagcttgcacagggccacacggcggcgctcgccaccggagcacacgttgaccggggtgtccggatcggggcactgcagggcgtccatcgcctgctcgagctgggagtcgaggtcccagccgtcggcggcgtcgatctcggtctgcagcttgcccatctcttccatcagggcgtcgaagtcggcgtccgggttggccatttcctcgccgatagcgttgaatcgggcgaccttctcggcaatcgggccgaacgccatcttgatgttctcgcccacggtcttggtgtcatccagcggcggctcctgctgcaggatgccgaccgtgaagcccggggtcagcgtggcctcgccgttgctcacggtctccaggccggccatgatcttcagcagggtggacttacccatgccgttcgggcccacgacgccgatcttcgcgccgggcaggaagctcagggtcacgtcatcgagaatcacgcggtcgccgtaagacttgcgggccttgatcatctgaaatacgaattctgccatgttgtgcagttactccttaaaaaggggttgaaattccgctgtttctttagtctttagtttgtgatggatacgctgtgtgcagcgcggagcacgcccccgaatcacggatcgcggtgcgccgcgtcaggcctgtgccgccctgtccgcataacgatcgaatccacgccaaaccaccgcccaccatggtatcggaagggctggaatggcgggcgtcgctatggcttggaggggtaatggatgggcctgacattgccgtggcgcgacgcgccgggcggcgcgccgtggtccagtgatgctgtagtatatcctcttgtgcttcattgaggtacagatggccccgtagctcagttggttagagcgccgccctgtcacggcggaggtcaccggttcaagtccggccggggtcgccaccaagctcctgacaaatgtcaggagcttttttgttcttttgccgtatttcgtggtgtagggcgaaatatggggttataggccaaaatgtgtgtctggtgtttagtcgtttgatggccattcgactctggcatggaagctgtttcagtcgatgccgatgccgtatcgcatggaaataccgaaggtttcgtgctggccttggggctctgctcgacacgccgatagtctgaatgacaacgtttgctattgaatgacaacgttagcgttaacagtgcttataaatggtgaaaaacgtgtgcagggtcacattggcagaacgtgcgcgagatatgacaaatcatgaaaaatacgctatgggaggtcatggcaactcgttactattttcgctgtctcgtacgccacacaagccttcaaggagtaagccatgaccacgctcgccattgatatcggaggaactaagatcgccgccgccgtctgcgatgaaaacgatagcatcatccagcgctggcgcgtccccacgccgatggatgccgacgccatcaaccagcacatcgccgaggtgtaccgcgaggctgtggccgccggacacaccgatatcgaggccatcggcatctccgccgccggcaacgtgagcgccgaccgcaagacgctcaccttctccgccaacatcccggcctggatcaactacgacctgtccgagcacgtcggcgcgctgatcgaccatgccgtgccggtcgttgtcgagaacgacgccaactgcgccggctggggcgaatacgtgcacggtgccggccagggcagctccaacatggtcgccctgaccgtgggcaccggcctcggcggcgccatcgtgatcaacggtcagctgtaccgcggctccttcggcatggccgccgaactcggccacctgccgatggtcccggacggcgaccactgcggctgcggcctgcgcggctgcgccgagcgctacacctcgggcacttcgctggagaacttcgccaagtccgccgtgcgccgtcgtccgcaggatgccaagcgtctcatggagctgtgtggcggcgacatctccaagctggaaggcccgatggtctcccaggccgcccaggaaggcgacgtgctcggcctgtacgcattcggcaagatcggcgaatggctgggccgcacgatggccgcagtctccgccgtgctcgatccggacctgtttgtgatcggcggcggtgtggtggccgtcggcgacattctgctggagccggcccgctacaactaccagcgtttcctggaaggcagcgcctaccgcggccatgccaagatcgtcgccgccaccgccggccaagacgccggcctcatcggtgccgccaacctggctctgcgctgacgatgccgctccggcaacggggcgttagtctaatggtgagtcatggccggtgccatggctcactgccgcgctgatagtgcggtcgatgagtttccgctgcctgaccatggaatcgaatttcgggttctcggcgatttcctcatactcgtgttcggtggtcacgccggcgatttcggcgataatctcctcataggacgtttcgacggttcgatgcacgccggtgacgtgcccctgacgtatcacgacaatgcggtcggataccgcgaacacatccggcagatcgtggcagaccatcaccacggaccggccttcggagcgcagtcgcttgatatatgcgagcacttccgccgactgcatcaccgacagtgcggcggtcggttcgtccagcagaataagctgcgggtcattgagcagcgtgcgcgctatggccacggtctggcgctggccgacggataaggatgcgataggggagccgacccgaatcgccgagctcagggtcttcagcacggaacgggcacgcgagttcatcgaatcgtcatcgcgtatgccaatctgattgatctccttgccgaggaacaggttcgaggccacgtccaggttgtcgcagaactcctgcccctggaacaccgatgcgatgcccatgcggtccgcctccctgatcgagggaatggtcacctgttcgccgttgagataaatatggccgaatcccggctgcagaaatcccgcgatgaccttgatcagagtggactttcctgcgccgttatcgcccacgatggcgatgacctcctggcgctggatggacagattcaccgatttcaacgcctcgacgaagccgaacttcacacagatgtcctccagccgcagcagaggaggtgtgctcgaattcctcatggtgtgttccttcttatcactcttctcctggtaccggtcactggctgacgtcattgcgaaccgagaactcgatggcgcataatgcgccgcctagcgcgcaattgtcgtccgggtgggatgacacgagtacatcgatgggtgccacggcatcagggaacagcatgcgctgcaacgcttcattgaacggttggatgaatacgtcgccggtcatggccagcttgccgccgagcacaatgacctccggatccacgctgatgcacagatcagccgccacctgaccgatacgcacggccgtgtcggcgatgatgcgacggcaaccggggtcgccttcgttggcaaaggacaccagatcatccagcgtcatattgccgtgtgtgacgctgagcaactgcaccagcctgttttccgccacgacggtgtcaaggcagccgcggttgccgcacgaacagatggcacccagcgggtcgacctggatatggccgatttcaccggccaggccggtcacgccatgcatgatttcgccgttgatgacgatgcctgcgccaaccccgtcgttggctgagatatatacgaaattgcgtttgcctgccgccacgcccatacgggattcgccgtatgccgcgaaattcgcgtcattatcgacgtatacgggaacgttgaacgccgtgcgcaacggggccgtgatatcgacgccgtcccatccgggcagaatgccgggaatcgctatggtgtggtcgctggtggccaccggtgcggccacggccacgccgatgccgaccagctcgctggcttcggcgtcgatgctgctcagggtctcattgatgagcagcatggcgcgttccagcgttgtgtccgccttgtggcccaacggcagggggagcgtgtgctcagcgatgattgacttcgagaagtcaacgatagaaagcgtgagatgacgtcgcgcgatccaaagcccgacgccgaggccctgatgccgtgcaagggtcaccagagtggctctgcgaccgttgcgaacggtgtttttggtctccagctggtcttcgtcgacaagctgatggacgagcgtggacacggtcgcagtggacagtcctgtcacctctgccagttcgacctgtgtcatggcgccgaacttgtggatactggccagcaagttggcgcggtttgcctcgcgaagcgaggtctgcgaaccgaaaagccttgttgccataagaatccagtgtagtcgttaccggcatgaggcacagcgaggcgcagagcgtggatttttcggcgtgtcgccttgtgatgcgcgaaaaatcgccattgcgttcattggtcgaacataaacgacaggaaattcgctttcttgagtttgacaacttaactcaatacggtattctatgagatgaacctgaggttattctcaggttcgggcgaccaaggagggttcgccatcccctcgaagatgaaggagaacaaatgaagttcactaagaagatcgtcgccgtggtggcaggcgttgccatgtgcgcgggcctcgcggcctgcggtggcagccgtagcggccaggcaactggcggtgatgccaagatcgaaaagggcgccactatcggcatttcgatgccgaccaagtccgaagagcgttggaacaaggacggcaacaacctgaaggccaagctggagaaggccggatacaaggtcatcctgtccttcgccgacgataagccggcccagcagaacgctgacatcgagaacatggtcaacaacgacgccaagatcgtcgtggtcgcttccaaggacggcaccgcagtgggccccgccgttgagaaggcccgcgatgcaggcgccaaggtcatcgcctacgatcgactgatcatgaacaccgacgccgtcgactactacgccaccttccagctggagcaggtcggcgtgctcgaggccacgtatctcattgaccagctcaagcttaaggatggcgccaccggcccgttcaatatcgagctgttcaccggttccccggatgacaacaacgccaagtacttcttcaagggcgcttgggatctgctgcagccgtacttcgagaagggcgtgctcgtctccccgtcccagcacggtcagggtggcgtgaccaaggacttcaccgttgaggattggcagaagatctccgtgatgagctggaagaccgagcaggcgcagaaggacatggaatccatccttgactccacctacgcccacggcgagaagctcgacgcggtcctcactccgtacgacggcatcgcccagggtgtgatcaacgccatcgaatccaagcgtcccgacatgaagccgggcaccgactcctggccgtacatcaccggtcaggacgccatggagatcgcagttgccaacatcgccaaggataagcagggcgagaccgtgttcaaggacgtgaacaagctggctgacgccgtgtacgacatggtcgtcgagatcgccgagggcaaggaagtctccggcctgaacggcaagttcaacaacaacaacatcgacgtcccgtccaagctgcttgacccccagaacatcaccaaggacaacctccaggatctggtcacggccaactacatcacccaggatcgcttcgacgagctgactaagtagtcctcatcaggcaatccgtaaacaaacacaatgacatgcggcgcatagccgatatgcgccgcatgtccatgaacacagaactgtgacgaggagtgatgacatgtcatcaaatgacaccatcttgacgatggaaaacatcacgaagacgttcggtccggtcaaagccctcaccgatgtgaatctttccgtcgatcgcggcgagatccacgccatctgcggcgagaacggtgcaggcaaatcgaccctgatgaacgtgctttcgggtgtgtacccatacggtagctattccggcaaaatcacctttgatggcaaggaatgcaaataccatactattaatgattccgaggccgacggcatcgtaatcattcatcaggaactggcgttgagcccgttcctgtccattgcggagaacatcttcatcggcaacgagcaggccaagggtggcgtgatcgactgggacaagacccgcgccgaggcgaagaagctgctcgatcgtgtgggacttcccgaagacccggataccagggttatggacatcggcgtcggcaagcagcagctcgtcgaaatcgccaaggcattgtccaaggacgtgaagctgctcatcctcgatgagccgaccgctgcactgaacgatgaggattccgcccacctgcttgacctggttcgtcagctacgtgacgagcagggcgtgaccagcatcatcatcactcataaactcaacgaggtcgccgccatcgccgacaatgtcaccatcattcgagacggttcgaccgtcggtgtgatgtacgtgacgccggagacgccgctcgaccaggaagaactcatccgcaagatggtgggtcgtccgctgcgcaacctgtacccgaaccacccctccaataccccgggcgaggaatacctgcgcgtcgaggattggaccgtgcatcatccgctcgacgcggagcgcgtgatcgtagaccatgcgaacatcaacgtgcacgccggcgagatcgtcggtctggcgggtctgatgggtgcgggtcgtaccgaaatggccatgtccatcttcggccactcttacggttccaacatctccggcaaggtgttcgtcaagggcaaggaagtcaagatgcccaacgtgcagtccgcgattgacgcaggtctcgcctacgccaccgaggatcgtaagggcaacggtctgaacctgctgcagaacatccgagagaacgcatccctggcctccctgaccaagatcagcaagggcggggttgtggacgacaaccttgagcacaaggaagtcgaacagtaccgcaaggacttcaacatcaagtgccatgacatcgatgtgaatgtctccaccctctccggtggtaaccagcagaaagtgctgctcgccaagtgggttatctcgcagccggacatcctcatcctcgatgagccgacccgaggcatcgacgtcggcgccaagtatgagatctacgaaatcatcgataaacttgccgatgcaggcaaggccgtcatcgtgatttcctccgagctgcctgagctcatcggtatctgcgaccgcatttacacggtgtcctacggtgtcgtcaccgacaatgtcgagaagaatggatttacccaggaatacctgatgaagggtatgaccaaggaaagggaggtggcagcctgatgagcgccgcaactgcaacacctgcaaagaaagaagaaaagaccggcctgctggccacggtcgccaacaatgcccgtcaatacggtattgtcggcgcactgctgatcatcgtcgtggccttcgagatcctgaccggaggcgtgctgctgaagccgaactccttcgtgtccctgatccagcagaacgcctacgtgatcatcctggccattggtatggtgatggtcatcatcgccacccacatcgacctttcggttggttccttggtagccttcatcggtggtgtgtgtgcactgctgatggaacgcgccggagtcaaggggctgcggacgttttcttggagaccgaacggaaggattttcgtatgttcagtcttgaggaacgagagcgtgcggtggagttgtatttcaccacgccgatgacgacggcccaggtggtggagcatc

SEQ ID NO: 18 - DNA, 193260 bp, Bifidobacterium longum
gatgagtacatacgctggtacaaccacgagcgcatcaaacagtcgcttggttggatgagcccggtacaataccgtcaaagccaaggaatggctgcgtgattatctccaagaaaatgtccgcagccccaattcgtcttactttttttgcgcagtttttccctgcgcgtgtcgcgatgatgcgaatatagatgtgaaggttaacaacgtagtcgtttattgggttttgtgatttcactcacgttgtaattcaatgtcaaatatgtggcgattctccgtatttgctgagattgcttttaagaatagcttcttgtaaagtgtcttatcgtaattgcgagtgcgtattcttcaatgaagaaggcatctgcttcacctcgaagaagagattaaggaaaatatagttaatgaaaaagaagaagactatatcggctgcgctggcaacagcgttagccttaacctgcatgggcagcgggggaggtactgcgttcgcaatgcccctgtctgatgctgacttgcagactttggcaagtcagattcagcaaatcaacgatacttctgattctgcaactgcttccgagactccttccgcacaagccgatgcggttgaaggctggactattgattccaacatcgctcagggcggcgaaatcctggagatggcaaacggttggctgcacctcaagtccactgcctttaacggtaatgcggcagcgaaccccagctccagcaacaactggccggcagtagccgtatggggcacagattacgacttctccaaggccggctccttccacgccaccatcaaatccccgcaggaaggctccgccaaccgcttcggcttctacctgggctacaaagacccgggcagcggcctgttcatcggctacgattcgggcggctggttctggcagacctacaccggtggcggtagcggcagctggtacagcggtgctcgtatcgctgctccgagcgccaacgaagagcacgacattcaggtctcctggaccgacgccaaggtcgccacactgaccgtggatggccagaaggcattcgatgtcgattactccgcaatgccgaacctctccaacaagcttgccatcaaggccggctcctggaaggagctgaacgaggtcaccgacgtgtacatcaaggacttcccggaggttgtcgaagccgccaagcacgcggtttccggcaaggttgtggacgctgaaggcgctgccattgaaggcgcaacagtgcgtttggataagaccaaggtgaagaccggtgcagatggcaccttctccttcgccgacattgaagaaggcgaacacacgctttcgattgccaaggaaggctatgaggacgtctcccagcaggtggcggtctccggcgcggaccttgccatcgatcccatcaccctgaacaaaaccgttcaggtcgcctccgaaacgctgaagaccgagaagatggaagttcagattaagaagaacttcccctctgtgctgcagtacacgatgaccgacggcaaggtgatgtacggccaaaccaaggatgtgcgcaccgttgagatcaacggcaccaacatcgaactgggcgatgacgacgtgaccttcaagaaggtttccggtaccgaagccacctacacgctgaaggtcaaggatgaggccaagaagattgacgcggtgatcaccgttcagatcacggtcaaggtcaaccagctgcacctcaacgtcaccaagatcaagaacaacctgtccgaaggcattcctgagggcaacggtgtggaggagaacgccatccagacgctgtccttcccgaaccagagtctcgtttccgtgcgttccagccaggaaaatgcccaattcactggtgctcgtatgtcttccaacacgcagaagcctggcgataccaacttcgcagtgaccgaagatactaacgtcaccgatagcgactacacctacggcttcatctccggtgctggcctgagtgccggcctgtggagcaactccgagcacgatggcacctatgtggcggctcctgtgcgcggcggcagccagaacacgcgtgtctacgccaccacccagcagactggtgacgccacctccctgggcctggccagcgctccgtggtactaccaccgcacggtcaccgattccaagggcaagaagtacaccgtggccgaaaccgctctgccgcagatggccgtggccatcgccggcgacgagaacgaagacggtgccgtcaactggcaggatggcgcaatcgcctaccgcgacatcatgaacaacccgtacaagtccgaggaagttcccgaactggtggcatggcgtatcgccatgaacttcggctcccaggcgcagaacccgttcctcaccacgcttgacaacgtcaagaaggtggccttgaacaccgacggcctcggccagtccgtgctgctcaagggctacggcaatgaaggccacgactccggccacccggactacggcgatatcggccagcgtctcggcggcgccgacgacatgaacaccatgatggaagagggctccaagtatggcgctcgcttcggtgtgcacgtcaacgcctccgaaatgtatccggaagccaaggccttcagcgaggacatggtgcgccgcaactctgcaggcggcctgagctacggctggaactggcttgatcagggtgtcggcatcgacggcatctacgatctggcatccggttctcgtgtaagccgtttcgctgacctcagcaaggaagtcggcgacaacatggacttcatctacctcgatgtgtggggcaacctgacttcttccggttcggaagattcttgggaaacccgcaagatgagcaagatgatcaacgacaacggctggcgtatgaccaccgaatggggttccggcaacgagtacgactccaccttccagcactgggcagctgatctgacctacggcggctacacctccaagggcgagaactccgaagtgatgcgcttcctgcgcaaccaccagaaggacagctgggttggcgactacccgcaatacggcggcgctgccaacgccccgctgctcggcggctacaacatgaaggacttcgaaggctggcagggccgcaacgactatgccgcctacatcaagaacctgtacacccatgatgtgtccactaagttcatccagcacttcaaggtgacccgctgggtcaacaacccgctgctgaccgccgacaatggcaatgccgctgccgtgtccgacccgaacacgaacaacggcaacgagcagattaccctgaaggattccaacagcaacgttgtagtagtctcccgtggttccaacgacacctctagcgcagcctaccgccagcgcaccatcaccttcaacggcgtgatggtggcttccggtgctgtctccgcaggcgatggttcctccactggtgacgagtcctacctgctgccgtggctgtgggattcctccaccggcaagctggtcaaggattccgaacagaagctctaccactggaataccaagggtggcaccaccacttggaccctgccggacagctggaagaacctctccagtgtgaaggtgtaccagctcaccgatcagggtaagaccaacgagcagaccgttgccgtctccggcggcaaggtgacgctcaccgctgatgccgaaaccccgtacgtggtgtacaagggcgaggccaagcagattcaggtcaactggagcgaaggcatgcacgttgtggatgctggcttcaacggcggctccaacaccctcaccgacaactggaccgtcagcggctccggcaaggctgaagtcgaaggcgataacaacgccatgctgcgcctgaccggcaaggttgacgtctcccagcgcctggccgaccttaaggccggccagaagtacgcactgtacgtcggcgttgacaaccgcagcaccggcgacgcatccgtcaccgtaaccagcggcggtaaggtgctggccaccaactccaccggtaagtccatcgccaagaactacatcaaggcatacggtcacaacacgaacagcaatacggaaaatggctccagctacttccagaacatgtacgtgttcttcaccgcgcctgagaacggcgatgccacggtaaccctgtctcacaagagcaccgacggagcacacacctacttcgacgatgtgcgcatcgtggagaaccagtactccggcatcacctatgagaaggacggcacgctgaagtccctcaccaacggattcgaaaacaacgcccagggcatctggccgttcgtggtctccggttccgaaggcgttgaggacaaccgcatccacctctccgagctgcatgctccgttcacgcaggccggttgggatgtcaagaagatggacgatgtgctcgatggcacttggtctgtgaaggttaacggcctgacccagaagggcacgctggtctaccagacgatcccgcagaacgtgaagttcgaggcgggtgccaagtacaaggtgagcttcgactaccagtccggttccgatgacatctacgccatcgctgtgggccagggtgaatactctgccggcagcgtgaagctgaccaacctgaagaaggctctgggtgagaccggcaaggccgagttcgagctgaccggtggcgtcaacggcgattcctggttcggtatttactcgaccgcaaccgcacctgatctgcagggttccaccggcaatgcacaggacttcggcggatacaaggacttcgtgctcgacaacctgaagatcgagcgcatcgagtcccagacccgcaccaaggccgaagcgcaggacaaggtcaaggaaatccgcggcaagtacgattccaagcgtgctgagctctccgatgccgcatggcagcagtatcaggacaccttggtcaaggctcgcgtgctcatcaacaagaatggcgcaaccgctgaggacttcaccaaggcatacgacattctcgtggccctcgacgagtacatgaagaccgctcccggcaacgagagcagcgacaagtacgacgtggcagctgacggctccgatgagctgggtggctacaccgtggccacgggcagcgaagagcctaccgcaggcctgccgagcgaaggcccggccgatctggcacaggatggcaacgacagcacccactggcacaccagctggagcgagaacgcagtcggcaacggcaccgcatggtatcagttcaacctcaacgaaccgaccaccatcaacggcctgcgctacctgccgcgctccggaggtatgaacgccaacggcaagatcaagggctacaagatcacgctcactctggcggatggcaccaccaaggatgtcgtcaccgatgctgagttctccaccaccaccatgtggcagaaggccagcttcgacgccgtcgagaatgtgaccgccgtacgcttgaccgtcctgtcttccgcaggccagagcgactcccaggccaacaagttcgcatccgctgccgaactgcgtttgaccacggaccgcgaggttgaggaagagactgtcgctccggacaagaccgacctcaacgacaccatcgccaaggctaacggtcttaaggaatccgactacacggctgaaagctggactgctctggtcaaggcccgcgaagctgcacaggccgtggcggataacgataaggccaccgcttacgatgtggctctggcgctgacgaacctcgaatccgctatcgctggtctcgagaagaccggtgaggagcctggcccaggcccggttgaggtgaacaagaccgacctgcagactgcagtgaacaaggcaagcaagctcgagaaggccgattacacgaccaactcgtgggaagctttcgccgaggcactgaaggctgcacagcaggtgctcgacaacaagaacgccacccagcaggatgtggataccgcactgagcgctcttcaggacgccatctccaagctggaagctgccaccgagccgaagccgaatccggaaccgggcgtggtggacaaggctgctctgaacgcgaccatcaacaaggccgccgccatcaacctgggtctctacaccgacgactccgccaacgctctgcgcgccgcgctgaagaaggcccgtgaggtctccgacaacagcaacgccacgcagaagcaggtcgacgcagctcgtgaagccctggagaaggcaattgccgctctggtgaagcgtcccgctgccaagggtgatggcaacgttgtttccaacacgggctccgatgtcgccacgatcgctctggctggactgctgctggcaggtgctggcgccgccatcgcctaccgtcgcaatcgcgagcaactgtgaaagcgaggttatagcctaagcagtaataaataaggaataatccttatcctctcggccggcgccgggcagcaatgcctagcgccggccgctttcgtatgtatcagtgttctccagtcacccggcagacatcggaatacgcacgcgatgtcgctgctaggcgatgaatcgcaaatatgtgcggtcatcgaatgattcgtaattcgcagtgaatcctttggtggattggtactcgctgacgagttccggatcgtcgcgcttgagtcgctgcagttcagcctcactggccgcaagcatagggcgcaacagttcgccatgaattcaccctcggttcgttgggtgagcatgccccggttacatgctgacgttatatctgactgtaataccgatgaggctaggaaaaggaatgattatgcagtcagataacagccatcatgaagcacatcagaacgacctgaactacagcagtgagtaccagtacgatatgtatatgtatgccgagtacggcatcgagtggtgattgagagccccgagtgagaattggactcacgacctcttccttaccaaggaagtgctctaccactgagctatcggggcgataatgtgcgcacggcttagggccgttgaacggcttgcacaacaatacacgcaatcgcgtattacgcaaatcgacgggtgtgcgaggaagtattcgggtgctctaagttgtacacatgagcgcaatattggctattttgcgctcatgtggcattcggatgtgccacgtaatcgcattttcgtgtttttatgcgctgttgtggcacgaaaattgtgggaattcggtcgtctcggaatatgtgccatgccacgccactgcaaaaacagtgaatgtgcacgattgtgcacatatttggaccgctgcgtatatgcatgtgggtgcggataacaaaagggttttgacaaaagccaaaaccctgatggcggaggatacgagattcgaactcgtgaggctgttacaccaacacgctttccaagcgtgcgccatagaccactaggcgaatcctccatgcactgcagtgcttgctagaagtaagctccgtaggcaactcgaataagctaccacagctttcggataaatgcacattcagtgccggctgcggcgtgtcgctttgtggacaaggaccaccaatgagtgcctgcgctgatgtgcaggtcgttcgtacggcgtgtgcaacaggtgatctcaccgggggatgaaccagtgcaaatcaaagcgactcaaggcaagtcagcaaacccgaggcaaaccagaatgaacatgcgcatgccatcgcgtgaattattgccagcctcttgccgtgatgcaacatagtgattttaggccatgaaccttggtgaaacagttggtcatgcaatatgagggatggggagtggccagtcgcggggagttcataattcgggaagtctcccatctgtgagcgggacaatatcgaatattgagacaatctgcggtaataattgatcgaaaaacagtgcctaatacctcttaaatcctaaaaaatcaagactgttcctcaaaaaagtttttctttatattgagtagttggtttttgattacttagccgcgcagagagagggataggcatggttcgtcgcgcccaggctgctcttcggtccgttgaacacaccagcgtgaggcagctgcgagttctggctgcgattgtatttctgttcgccatggtcatcgccactgtggctcctgcagtcacggctccgatggccttcgccgacagcagcaccagctcgtccagttcatcaagctcgtccagcgttgactacgccacctgggccgaagtctccaaggcgatggacaagcagctgaacagcggtcttgagacgtacaaggatggcaacaccgctggcgccacctccgatttcatgggcgcgtacaacaagatttacgtggcctccaacttcaccgcggtcgtgcacgacaccattggcgcggacaagcagctcgcccaacagcaggcattccaaagcgttcagaatctttcctacacgcctagcaacgacgatcaactggctcagcagattgatgcgttgaccgccgatcttgacgccacggcccagcagctcgacgccaacgccgatctcgccaagccgaaggcgtacgccgaagcgctgcaggcgcagctggccaaagagcgcaaggagctcgacgccaagaaaaagaagaacccgggcaagggcaatcgttcatggaccgacgtggccaacgaaatgaccccgattctcgacaatgcatacaaagcttacgaaaagggtgatggtgccaagggcgccacgctcgtgaacaacgcgtactaccagtattacgagaagctcggcttcgaaaagaacgtgatgaacgccatcagcggcaaccgcgtctcgcaggtggaataccagttcaagatgtgccgcaagtccatgaacgccggcgcatccctgaaagacaccaagaagctgatcgacgacctcaaggccatgctgatcaaggacgccggcattcttgacggtggtgccgccgataaggaagacggtttcaccaagctggtcaccagctcctccggccaggcgttcctcgtgcttatccgtgagggtcttgaagctctgctggtggttgcagccatcgtcgcctacttggtcaagtccgataacaagcgcttcgtcaagtggatttacttgggtgtgctcgtcggtctgctcggcgccggcttggtggctgtgatcttcgtgttcgccttcggcggctccggcccgattcaggagatcatggaaggcacttgcgcactgatcgccatgggcatgctgctgtggacgagtaactggatgctgaacaagtccagcgtggaagcgtggaaccgttacattcgcaagaagaccgaggctgctgtggctgatgccgaagccgccgcaagtgccgacaacgtgacgttgaaaaccgtggtctcgctggctatgctgagcttcctcgccgtgttccgtgaaggcgctgaaaccgtgatcttctacgagtccatctacacgatgagtcgcgatactcgcggtatgtggatcggtggtctgaccgccgcggtggtgcttgtcggcatcttcctgctcttccgcttcacctccgtgaagattccgattggtccgttcttcctggtcacttcgattctgatgtctgtgctggtggtggtgttcgccggcggcggcgtccactcgctgatcgagggcgacttgctgcccgccttctacctgaacggtgtgccgacgaacgattggcttggcctctacccgtacgccgaatgcctagtggcgcaggccatcgcagccgttgcggttatcgcgctgttcgtggtcggcttcatcaagcagcgcaagctgaaggcgcaggctactgccgaggtcccggccgtgaaggcgtagcccgtctagctcgtccgtttcctcccataactgcagacaactgacagacttgcggcacggcctcggatcgatgccaattcctccagcccacgccgcacttatctcataactgaataattgcaattatctaagcgtgaatcctaattcaccagagatagagaaaaggaataacaatgatgaagaacaagaaactggccgctctgctcggcctgctgctcgccggttccatgaccgtgtccatggctgcctgcggttccaccaactccgcatccgacactaaggctgactcctcctcccagtcttccgactcctcttcctccgattcttcctccgattccggcgccggtttcgaagaggttccggttggcccgtccggtactgctgaagagcaggatcaggacgccggcccgctgaccgtgggcgctgtgtacttccagccgatcgatatggagccgtcttccatgggcctgaaggctgctgacgcttccttccacctcgaggccgacatccatgccaaccagaagggcaccgagctcggctacggcaagggcgacttcgtgccggatctgaccgtgaactacaccatcatcgataagtccaccggcaaggaagtcgagggcggcaccgccacctccggtaccttcatgcagatgaacgcttccgatggcccgcactacggcgccaacgtcaagctcgacaaggctggcacctaccagctgaagctctccatcgaatccccggcctccaagggttggatgctgcacgttgacccggagaccggcgtcaagggccacttctggaccgagccgatcgaggtcaccttcgacaactgggattacactcctcgccagtggtgattgactaagcagaaagccccctcgtcagagggggctttacgccgctttagggagataattcttaggacggtctaaaactcccctcagtccgcttcgcggacagctcccctcagagaggggagcctaaggtgaacagagaaaggacgcgaatgcttgaacaattcgtggcagtgatgccgggcactttggcccccgcattgctggtgatgagcctgagcgtgatgctcacggtcggcgaggggcgagataagccgataagctcgcattggcgtctcatcggcctgatcgtcggtctgatcgccgccatcgtattcgccggcctgcgcgcctcggccgtgatcaatcagcgcacgttcgtcaactacccggtgttgtggtgcgcgatcattgccgacatcctgaccatcgtcgtggtggtgttcgcacgccgcatcaccaccaattggcagcagcacaaggtgttcatgcacatcgctaacgccgtggccgccatcgacatcgcactcaccctgttctacgcgctgccggacgtgattctgcagctcaccatctgggtggaaccaggggagaccgcattcacttcggccatgctgctgcgcgctcttggtttcctgcttggcgtggccatgtccattattgtggccgccatcttccgcacgatgcgcaccactgccgtgcgctgggcgttcaccgtggccgtcgcggccatgatggtgattctgctgattcaacacttcactggtcttgcccagattctgcaggcgcgaggcttcccgatgaaccatacgatgttcgtggcgctggcttggtccatcaaccagaactccacgatgattatggcgcaggcgctggtgttcctgattcccgccgtggcctccatcgtggccggtttccgtatgaaaacccatgatgtgccgggagccaacgaggccacgttgcgccggcataaggtattccgccgccacgccatcgccgctgccgtgtggagccttatcgcagccatcggcgtcacagcaaccctgaccgtgggcgttgccgcgacccatcagaccatcaccctttcgccgccggaagcctactcgctcaaggacggcgtggccaccatccccttcagccaggtcgaggacggccacctgcaccgcttcgaatacaaggccaaggacggcaccgtcatgcgcttcatcatcatccgaaagaacggtggcgcgtacggcatcggcctggacgcctgcgagaactgcggcgacgctggctactacgagaaggacggcaagatcatctgcaagaagtgcgaggtggccatcaacctggcgaccatcggcttcaagggtggctgcaacccgataccattcccgtacaagaccggccacggcaagatcaccattcaaactacggatctggacgcgctgagcgcccacttccggtgagtcaggcaggagacaagaatcatgttctttctgcgcatgattactcgctcgttcacccgacagctgcgccggcgcctgcttatcgcgctgaccgtatgcctgtcggcgaccgtgtccgtatcgatgctgggcgtcgtgttcgacgtgggcgacaagctcaacgccgagctgtccacctacggttcgaacatcaccgtgcagcccaaggcggacgcggtcgtttccgacctgtacaacaccgagtcgggcggcgcgacgtccaccagcgacccgaccgcctttctgaaggagtcggacgcggccaagatcaagacgatcttctggtcgttcaacatcaccagcttcgcgccgcagctcaacatccacgccacggtggacggtaccaacgtgccggtcgtcggcacgtggttcaacaagaacctcaagatctccaccggcgagactaccgtcgtgggcgtggaaggcatgcgctcgtggtggcagctggacggcaagtggcccaaagacgattccgaccagggcgtgatcggcaagacgctggcctccgaactcggcgcgaccaccggcgacaccatcaccctcaacaaaaccaccgcctcaggcaagaagaacgagcagaaaatcaagctcactggcgtctacgattccggcgacgaggacaacggctcgctctacatcgcctcctccacggcccaggtgctcgccgacctgcccgattcggtcgacaaaatcgaggtcaaggccctgaccacgccggagaacgacctggcccgtaaggccgccgcgaacccggccgcgctgagccaggaggaatgggagacctggtattgcaccgcctacccgagctcgatcgcctatcagatcgaagaggtgattccgggcgcggtggccaagcaggtgcgtcaggtggccgcgttgcagggcaatgtgctgcaaaagacgcaggccgtgatgattctgatgacagtgctgagcctgatcgccgcagccgtggccgtggccaacctgatggtcgcctcgatcggcgaacggtcgggcgagctggcgttgctcaaggcgctcggtgccaccgatgccgcggtatcccgcctgatgctggccgaaacggcggcaatctcgctgctgggcgcgattgtgggcgcgctgctcggttccggcgtggcccagctgataggccgggtggtgttcggttccggcattacgatgcggccgatggtgttcgtgctggtgttcgtgctgctggctgtcaccgtgctgctggcgtccgcctcatcgattcgttcgattctgaatctcaagcccgcggaggtgctccatggtcgctgagtttatctacgtaggtgtggaaggagggaaccgatgaccaacaccggtatgttcttcagaatgctgttcagcgccgtgttccgtcggcgttcgcgcgcggtgatggctgtggtggcgtcgctggtcggcgcagccacactgttctgcctggcgatgatctgcctcgctgtgccgcagcagatgaacgaggagatgcgtgcgtacggcgcgaacctgattgtcacgcccgccgaatcgaccaatgctgacggcaaggccggcatcgacaaggcgatggtgcagcacaccactgaaatggtcaaggccaagggttccgcgaaatacgccacctaccgctacgagaacgtgcgcgtcaacgcctcgccgtacgtgatggccggcgtgaatgcggcgcaggtcaagaacctcaaccatcactgggtggtcgacggctcgtggccgaccgacggcaaggtgctggtcggacgcgacatcgccgacgccatcggcctgagaatcggctccgccatcaccatcggataccgtgcatccgataacgccagcaccaacggcacttcgtcgaactcctcgatcgaccagcaaaccaaagacggccgtgtctccagtgacatcatggacacctccggtaccgaattccgcgtggccggcattgtggacaccggcggcagcgaagactcgatcatctacgccaccaacgtcgacgtcaacaagctcaccggcatcacgcgcggcgtggacgtcatcgagtattcggccggcgccagcgacctcgcaggtctggtgtccagcatcaacgacatgacctccatgcacgtcaaggcacagcaggtcaccaagatcaccgcctccgacacccgcatcatcaccatgctgcagacgctgttctggatcgtctcgctggtggtgctggtgctgacgctcgtcggcgtcggcaccacaatcagctcgatcgtctcgcagcgacgcaacgagattggcctgcgcaaggccctcggtgccagctcgcgtgccatcggcaccgagttctacatcgaatcgtcgctctacggcctgattggcggcctcatcggcaccgcaatcggctacggactcgccggttggctgtgcatggcggtgttcgaacgctccatcggattcaactggtggctggcgctgatttccgtgctgttcagcgcgctgatcgccatcgtcgcctccatcccgcccgtccaccgcgccacccgcatcgaccccgccgtcgtgcttcgcgaagaataaagaaagagaaacgtcatgctacttgaactcgaccacatctcgaagatctacggcgacctgcatgccgtggacgacctcaatctgaccgtgccggaaggcgaatggctcgccatcgtcggctcatccggttcaggcaagaccacgctgatgaacatgattggctgcatggacacgccctccaagggctccgtgaagctggaaggccgcaagctggaggacctgaacgccacgcagctggccgacgtgcgcaagaacctcatcggactggtgttccagaagttctatctggttccgcacctgaccgccgtggaaaacgtgatggtggcccagtactaccattcggtggtcgatgagaagcaggccatggaggcgctggaaaaggtcggcctgaaggaccgcgcccaccacctgcccggccagctctccggcggcgagcagcagcgcgtgtgcgtggcccgcgcgctgatcaacgacccgaagctgattctggccgatgagcccaccggcaacctcgacgagaagaacgagaagatcgtgctcgacctgttccgcaagctgcacgagcagggcaccacgattatcgtggtcacccacgatgcgctggtcgccagctgcgcgcagcgcgagatcatgctcaaccatggcgtgctcgtcggtgagaagtggaatgacgaggatgcgcgcaaggcctacgaggcggccggcggcaagcccgcctccacgggtgcacaggtcgagggcgcgcagaacggcgagaccgccattggtttcgctgaccccaccaaggccgcgaaaaccggcggcgaggagtagggccgtcaggggtatcgagcagtatgtgaggaatacatggcaagctgatggtctctcccccagtcagcttcgctgacagccccccctcgtcagaggggggcttaaggagcgtgaatatgaccgaaaagaatatgttgaagaaatccgcgacattggcggcggccggactggtcgtggctggcgcgctgctggccgggtgcggcgaatccgaggccacgccgatggacgatgcgtacgccggcaactcgggcgagaccgagaagtcgcaggaagagcagtcgcaatcccagtcgaacggctccgatagctccgacggctccgattccagctcgtcgcacaacgacccgtccaccaccacgtccgacaagaaggacaccggcaactacaaggacggcaactactcgatcaacggccagtacggcccggtaggcgaggattccatcgacgtccatctgaccatcaaggacggcaacgtcgagaccgtcaatatcattgggcacccgttcaccacgatttccaagaaccatcaggacgacttcgccaaagccattaacggcgtggtggacggcaaacctctgaagggcctcaaagtggacaaggtcgccggcgccagttggacctccgacgccttcaacaaagccctcgaagtcgcccgccaggaggcttcgattcaggagtaagaccgctacttcagcaatgctggccacagcagatcggccatgcgcgaggcccaggcggtgtcgtcgtccattgctttgccctcgatggcctcatacgccaccaaagacccgataatcgtggacaacagcaacttctcgtcaacgtcctcgcgaaacacgtcctgcgcgactccctgcttgaggaacgcccccacatgctccagccacggggtcaccacctggtcgacgatgtgctggaagaactcggcctcgctggacaatacaatgcccacgcgcttgacgtcgatgtcgttgtcgcgcacccaatcgaccaatcgctgcaatagttgcgtgaaatgctcacgcgtggggctgggcactgggtcggaatccgggatggccagatacatcgcgctgatctcgcgcagcagctcgtcggcattatggtatcgacggtaaatcgtggttttggccacaccggagcgccgggccacctcctcgatggtcacgccgctgatgccgcggtccaccgcaatctgcagcgtggctcgcatgagcttgcgatccgtcgcctcgcgcgtgcgctcaccgcgcggtgtcgccgtcgtacctgtcatctccgtcatctcttctctccgaaatatgctcccgtacgctcccgttggcgggagctggctggcaaagccagactgagggtggtaagtccatgccgtttgtaggcaacccccggataatacctactagcccagcactttagtgctctcgactttggccacataccactggttgaaccgcaccagtggcttcctgagcaacagtccaagcaacagtagcggcggcacgaatgccagcagcattccggcggcccgccagtaatccatgtcgtagatgccggcgatggccgcacgcatcatcgtcaccgcatgggtgagcggcaagaacggactgactttggcgatgaagtcgggcaacatctgcaccgggtaggcagcgttcgcacccgaaatctgcacgatgagcataagcacgccgattgccttacccacattgccgaaactcaccaccatcgtataggtgaagaacgagaacaccagcgaggccagccatccagacaacataaacagcagcggatgcacggcctgcacgcgcaggaacagcagatcgccaccgagcgacaccgtggattgcagcagcgcaatcagcgcgaacaccccgtaatgcccaaggaagagccgatgcggccgcggatcgcccaatgctttgcgcgtccggcgagacacggtggttttcagcgtcaccaccatcagcagcgcgcccacccacagcggcagcagcgtgtagaacggtgccatcgacgaaccgaaattcgccaccgggaatacggccttgcgcctgagctgcaccggtgcggccaacgtactggccagcgtttcgggatcattgcccagcacctctttgaccatgcccatatcgccactgtttagtgcgtcgctcagtgtgctgttgaacgaagccagttcggcaccggcggaacgcagtttgccggacaccttgtccaaggtagtgcgagcgtcactgagcatatcgctggcgtcgtcggaagtccctttcaggtcgccgagcgtggagtccaactgggtggcgccggaactcagtatgccggaggcgtcagcgacggtggacgacagggagtcgatttgcggtttcaccgtggccgagaaatctgacttgatattggcaatactgttctgtgcttgatcagccagattcttgacctgcgcatgctgatcctgcgcgtcctgattgccttggcgaatatcggtcgccgccgtattcagcgcttgccgcagcctgttttgccgtgcgattgaacggtcaatcgccgtgatgatggatgagtcgttgcccagtatgccggccaacgtgttgcgaatttcagtgtatttctccgtctgcttgccaatggccgtggcttgacggtccaattcgtcggcggccgtggtggcaccagcattcgcgtcggaatacagcttgtctatggagtcggacaccgcgccgaaactggaggcgctcgcgtccagtgcgctgctcatcgcgtcagcggtggtgcccagggctccggccacgtcggtgacttcctgtttggcgctggcaagatccttgccgccttgtttggcggcagaggaaacctgagtgatcagtgagttcgaggtgtcgagcaaggcgccggccgtatcggtcaatgcgctgtatgtgccaagcagatccgccgtatcgtcaagctgtgtggcgaaattggcgatgttggcgttgaaggtattcagttgctctttggtctcgggcttggacagctgatcggccagcgaagacgcgatttccagcccggccgaagtgatggtcttagcgaacgtggtgttgatttccgccgcaacctcatccgtgccctcgttgagcagattcggtgccagcgcgttcttcttctcgttgcggtaataggtcagttcggcatgctgcacgtcgtcggagaagaaggtcatcatgtctttgctgaacgacttcggaattacgatggccgcgtagtatttgccggatcgtgcgccctcgacggcatcggctttggacgtgatcgtccaatcgagctgactgttggcgcgcagcgcgttcaccacctgatcgccgaccgtgactttcaccgggatcaggttggaacgatacccctcatccacattcgccaccgcgaatttcaggttcttcatattcgagaacgggtcccagcatgcggccacgttgaaccaggtgaacaggccgggaatcatcaccaagccgatcacgatgatgatggagaccacgttgctggtcaggcgtttgatgtcgccggtaaacagtttccacatggtgttcatcgtgcgtgcctgccttccttggtcggcggaatagtggggatgattgcggtaacggcggcgctcgggtccgcttcttcgtggcgttcggcggaggtgtcgcgacgcttggccttatgcccgtacagcatggcgcggatcgactcgtcggagaggctgccgagctcggtttggcggcggatggaatcgcgcatgaattccacgaccatcaggaagcccatgatgatgagcacccatgccagccatgtgcccatgacttcgattttctcgctggtggtcagcgcaaacacgataatgagcgcggccggcaccacgaatccggcaataagcgcacccagcagcagccggggataacggtaggcgaatttggcggcccgacgttcgatggcatgacggtattcgtcgtggtcggccagtgctgcaatggcctgagtgacacggtattcgctgccgggcatgtgcaccggctcgccgataatcatgtcgctttccttgatttcccgcgcgaacaggcggttgagattggccagtttcggccgggcgccgaggccaagcgcaaaggccagaaccacgaaaaccagcaatttgccgatataggcgaaccagaggccgtcgtagaagccgccgatggtttcacgcatcgcgtcaatcgaataggtgaacggcagcagcgggtagatggcgcggaagaacgcgggcatcatttcaatcgggtacaggccggaggcgcccggcacctgcagaatgaccagcgccacgcatacgcctttgcccacgtgcatgaacgtggtggagagggcgaaaatcaccgacatatacaccagtgaggtgatgacgcaggtgagcagaaacactggggcgctcgcgcattgaatgccgatgacaagatcgccgatggccgtgaccaggccttggacggcagccagcgtggccagtagcaggaagcgaccgagatagccttgggttggtgtgagatcgtcgatgccctcatcatcggtttcgagtttgggaatgaccacgagcacgaacgcgcccacccacaaagacagggtggtgaacagcggtgccatgccggaaccataggaggcgaccggatagacggcctgttcgctgataacagtgggggagagcatgaagtcggcgattgtggcggcatccagtttgccgtcggtgccgatcagggaactgagtgaactggagatgctcagggctttgatgtcggtgaccagcgtatcgagcttggtttgtacgccggccagcgccttatcggtgtcgcgcagcgcggtcaccgtggtggaggctgctttgtcgagttggtcgagggtatgcttcgactgatcgatgagtgagccttgcgacgtgatgccggtcgacagagtgctggcggtcgagctgagggcgttgagaccggtgttgagctgaggaatggcgccggaggtgatggtgccgcgagcggtattggcctcgcgcaccgtggtttgggtggcggtattgagatgctgcgccaatccggcggtgtctgtggaggcattgccgatagtggtgttcaggctatcgaggttgcccagtgcgccggcaagctcgctattgcggctttccagtgtggcaatggcggattgcagcggttctcgattggcgttcggcagccctttgagttggtcgatgatgtcggcgttcgcttggttgatgtcttccgccgtattgatcagtccgcctacctgctgattggcggcgctgatggttccggttaccgtgcccacgctttggttggcctgtgctgcggcttggctcagcaggcttgagccttggtcaagcgcttcggacgtggaggtgacgaagccgttcagactggtctgggtagtgccgatcagggtggagacgccggccagaccttctgcagtgtcgatgccaagtgtgcgcgcgtcgtccagcgcctgacgtgcggtgcgtgtctgctctggggtgtcggtgagtttggtggtgagcttggcgatggtgctgcgtgtgtgctgcacatcgtcggaggccttggcaagggccgtgagggccttggctttggtggtgtcttcggtactgatggctttgccgtcaaccgtattgatgacttcggtaagtacttcggatacggtggagacgaatgtggaattgaccgtgcggtccacagtggacgcgccgacgtcggtgactttgggggcgatggcgctggctttttcgttgacgtaatactccagagtgggccgactcttgccgccggtcaccacgccggcgagatcgtcggaaaagtctttgggaatgatgatggctgcgtatgccttgccggattccacttggtccatggcctcggcttcggtgacgaaggtccagccgagctggtcgttgcttctcatctgcttgacgatttgatcgccgaggttttgcttgccgatgagcgcgttgtcggtgccgtcgtcattgttggcgatggcgacggtgatgcctttggtattgccgtacgggtcccagaagccgacgatgttgtaccacgaatacagtggcgggatgaacaccatgccgaacaggatcacccatgcggccgacaccttgaacaggcgcaggaagtcgcgtctgaggaccttgaagatattgcccactgatacctccggagcttggtgttgcttggttgctacgttttccgtagcgatacgttaatcgtagcgctacgtttgtagtagcgtaatacggctgccggagattaatggggtgattgatgatgtttttggcggaataacgccgctgcccagcggcttatcgtgtgtcgctgggcagagcaaaaggcgttctggaacttattgacaagatttctggatggtttttggacgtttcctgaacgcgatggataggctcggtgctcggcaatgtagacagacatgtaccgaccgcccatcaagttcagcaaaaccgcaatcgggtgatagggtgaggggacgctatgtggggaggaaaccatggttgaattcaaggacgatggcacggccactacccccggcaagccgcgggagaaccgtgacgccgagtccgcagtcgtggccgatctggtggccgtcgaactggacgacgtcggcttgaacctgaacaccaagcgattaccgattctggcgcgcatctatggcgcggtcgtgctgctggacggactcgccacattgccgattatggtgatttccatcctctatgccgtgcgcgagattctggatggtcatgtgcacgtcgatgcgatgagcctgaccttcatcctgtccgcgattcatgcggtggtgctggtagtcagtgccgcatgcctgattgtgttcggcgtgatgctgctgcgcaatcatcgccggtatgccgcgcgctggacctacgtgctgatgccgttgacattggccgacggcatgctgtcgctggccctgaccggccttggcttcaacctgctgctgccgctgattcagatgattattctcgtcgtgatttcggtgaccgccgatccctccctgagcgaggaacgccgtctgcagcgcgcgctcaggcgtatggacgatcgcgatgattatgaatcggctgtggcggccggcatgctaggccgcgaccagtccggcaagggctatattgcgctggactttttcaatatcttctggctgtttaccatcgcttcggtgggtggcctgattgtggagacgatctaccatatggcgctgtataacggtgaacttcaggaccgcgctggtttgctgtggggcccgttctcgccgatttacggctgtggtgcggtattggtaaccgtgtgcctgaatcgcctgtggaaggcgaatccgttcttgattttctgcgcttcggcggtgatcggcggcgcgttcgaatattgcaccagctggttcatggaagcggcgtttggtattaccgcgtgggattacaccggccgttggctgtccatcgacggacgtacttcgggccaattcatgttcttctggggactgattggtgtggtgtgggtcaagtggctgttaccgcgactgctggctctgattaatcgcattccatggaaagtgcggtattcgctgactgcggtatgcacggtgctgatggtgattgacattgccttcacgctgatggccttggattgctggtatgggcgcatggccggccagccgcaggattcaccggtcgcgatgtggttcagcgaacgctacagcgacgcttacatggccaatcgcttccagaccatgcatatcgacccttccaaggccgggcgtatgtgaatggctggcaagtaattacgcttcgcgggcagaaggtgcgtagaacctaagacagccctcgcgtgtgggtggtaagcgggatacactttcaagcgttgaaggaatgatccctccgctgatgcgctggtttgtgacgcgcgtgatgacgatgggacaatcaaacgaaaggcaaggcacatggccgaagctacagcaaacattggtgtgattggactggccacgatgggctccaatctggcgcgtaatctggcgcaccatggcaacacggtggcgttgttcaaccgtcattactcgcgtaccgagaagctcatgaacgagcatggcaccgaaggcaacttcgtgccggccgaaacgctcgaggaattcgccgcgtccctgaagcgtccgcgtaccgccatcatcatggtcaaggccggtgctccgaccgacgcgaccatcgcgcagctggaagaggtgttcgaaccgggcgacatcatcgtcgacggtggcaactccttcttcaaggacaccatcaagcgtgagaaggaagtacgtgctaagggcttccacttcgtgggttgcggtgtgtccggtggtgaggaaggcgcgctcaacggcccgtctctgatgcccggcggcactgcggaatcctggaagaccttgggcccgattcttcagtccatcgccgccaaggtgaacggcgaaccgtgcgtgacccacatcggcaccgatggtgcaggccactttgtcaagatggtgcacaacggcatcgagtatgccgatatgcaggtgattggtgaggcgtatgacattctgcgccgtggactcggcatggatgccgaggagatcggcgacgtgttcgctgaatggaacaagggcgatcttgattcctacctgatcgagatcaccgctgagattctgcaccacaaggatgccgagaccggcaagccgttcgtggacgtggtcgtggatcatgccggcatgaagggtactggtacgtggaccgtgcagactggtctggaatgtggttctcctgtggctgccatcggtgaagccgtgttcgctcgtgcactgtcttcgcacggtgagctgcgtgaagacgctcagaaggaaggtctggctggaccgaacaagaccatcgatctggccggagaagacaaggccgcgttcgtcgaggacgtgcgcaaggctctgttcgcttccaaggtcgtggcctatgctcagggcctgaacgagattcaggacggtgccaaggaatacggctgggatatcaacctgtccgaagtggcccgcatttggcgtggcggctgcattattcgcgcccagttcctgctcgaccgcatcaccgaggccttcaggggcgataacccgccggcttccctgctgttcgatccgtacttcgagaagatcatcggcgaatcgcaggatgcatggcgtcgcgtgatcgttcgcgcggtggaggccggcatcccgaccccggtgttctccagctccctggcgtactacgatggtctgcgctccaagcgcctgcctaccgctctgacccagtcccagcgtgacttcttcggtgcccacacctacggtcgcgtagacaagcccggcgtgttccacacgctgtgggctgaagaaggcaagcctgaaatcgaggcgtagcctcgtgatttcaggtttaggacagccctgtgggctgtccggccttcttcaggctcggcgatagccgagctgagaaaacagcaagtccgagatcgaggcgtagcctcgcgatctcgggcttaggggagcccggtgggctccccggccctcttcggagcgaggcggctatgccgccgagccaacactgagcctcgccgcaggcgagtccctaattgcaggggccggcggcgaagagggcaagtccgagatcgaggcgtagccatagacgaattaagccccctcatcagaggggggcttaattcactcacaactcggtgacggtttcttcggtggagaaccagatgaactcgtccactccgttggcgtaggaggacgggtaatccgggttgttgggctgctcgaagacatgggccagcgattcggctttgccggcaccggcggcgaagaaccacgtatggcgtgaacgcgcgatgagcggcgcggtcaatgaaacacgcagcggcggcatcttgggggagtggttcacacccacggtgagcctatcagtaaccttgacctcatcatgaccagggaacagcgacgcatagtgaccgtccggtcccatgccgagaatcatcagatcgattaccggttccggccccaattcattcaccaactcgcgctcatagtcgctcgcgacatcgtccagcaacgcatcattcgcggcatcggcggcggcgcgaacggaagcatcatcgctgtcggcctgatccatcacatcggcgatgtcatcggctgaacgggtatcggccgccatctcatgaatattcgactcaggcagcttgccatctgccaccagctggtcaagcagcaggcgacgggcctccaaagcattgcgatcggtgtcgtaagccggcacaaaacgttcgtcgctccaccagaaatgcacgcgcgaccaatcaatcgcgtcagccagcggatcgttcagcaccaagcccagcggctgcgcggccgaaccgccagacagcgccacatccacacgcgtgcgatgcgtgccatcaggcaatcgttcggcgagcaaatcgagtagcgccaagacaaaacgttgcgcgccagcctgaatcatcagatctttattcggatacacaatgagttttcgagttgccatgtatggtccttgtatggggtatgtgtcgtactttgcaatgtggattgtgttgtcagttgacaacacaatccacattgtgcgacatcgcatatgtcactttattactccgcgggcatgagcttcggcatcgcatgaggtaggaaacgatgagcaacggcgttggcatggctcggccacaattgccgaactcattccaacgccgctgtggcaacgggttctaccgacttcagtgacgaatcagatcccagccttcgttgatgacctcggcgtagatctcatcgggatcgatgcgacgcagttcctcggtcaggcagtcctcgatggtgcgcatcggcacggacacttcctgcggagtctggccgggcagcgagatcagcgcttggtcctcatacgggcgttccagcgagatcacaccgtcctcacgggtcaggtacacgccggtcacggcctgcgcgtcgggcacgaactcagtttcgactggtacgccaagtttcagacgcagccatgcgcacagcatttccataggcaggaagtcggccttgccggtcaccttcgcggcggtgatgggcaggtgcggcggctgatcgagcatcgaggcgagcattgcgcgccagacggtcagtcgtgtccaggacaagtcgatatcttccggtgtccaattgcggcgcaaacgctcaatcgtggcctccggattattggagtgcaacgcgtcggtgatgcgactgcgggccatcgcacccatcagatccttggccgggttcgacggcggtgtggtcggccaccacgccactacaggcgcatccggcacaagcagcgggataaccagcgtatccgggtggttgataaggccaccgcgcggacgcaagatgatgatctcaccggcaccggcgtccgcgccgaatcgcacttgggcgttcaggttggaatcgttcggatcgttcgggccgtcggtcaaatcgacggccggattatcgcgactcgcgctcacctcggcggccacttcggccgcgttcggttcgccttcgccggactgatcggcaggattggtatccggtactacggcaatcacgcggcacgggtgctcacggctggccgagttcgcgatttccagcgcatgctctaggtccgcgtcctcggtggcgatgagcagcgtcagcacgcggccggtcgccgattcgccgcgctcctcgtgcagctgttcgattttgtgcgcaatctcgcgggtgcgggtgttcggcatatcgatgatcatggcatcctccagtggcggccgtcgcgcgccagcatttcgtcggcctgtgccggaccccacgtaccggcgcggtaggcctgcggctggccaagcgtggaccagaattgttcaatcggatcgaggatctcccagctgaggttcacctcttcggtggtcgggaacaacggcggatcaccgagcagcacgtccagaatcagtcgctcataggcttccggcgagttctcggtgaaggagcggccgtagctgaagtccatgttcacgtcacggacctccatggtggagccgcccggcaccttggctccgaagcgcatggtgacgccctcgtcgggctgcacgcgaatcacgatggcgttcttgccgagttcgcgcacggcggtctgctcgaacggcagatgcggggcgcgcttgaacaccacggcgatttcggttacacgcttgccgaggcgcttgccgcaacgcaggtagaacggcacgccagcccagcggcgggtgtcgatatcgaggcggatggcggcgtacgtttcagtggtgctcttggggtcgatgcctttttcctccaagtagccgaccacttcgtgcgagccctgccagcccttggcgtactggccgcgcgcggtgttggcggcgaggtccttgggcaggcgcacggcggaaagcaccttggtcttttcggcggtcaggtccttggcggtgaagctcaccggctcctccatggcggtcagagccatgagctgaagcaggtggttctggatgacgtcgcgtgcggcgccgatgccgtcgtaatagccggcgcggccgccgatgccgatgtcctcggccatcgtgatctgcacgtggtccacatagttggcgttccagatcggctcgtacatggcgttggcgaaacgcagggccagcaggttctgcacggtttccttgccgaggtagtggtcgatgcggaacacggagctcgggtcgaacacttcggataccacgctgtcgagttccttggcgctggccagatcatggccgaacggcttctcgatgatcacgcggcgccatgcgccctcggacgagcgcgacaggccggaggcggccagctgcttggcgacctgtgggaatgcgcgcggcggcaccgacatgtagaaggcatggttaccctgcgtgccgcggtcgcggtcaagctcctgcacggtggcgcttagacgctcgaaggcctccgggtcgtcgaacgtaccctgcacgaagcggatgccggcggccagattgcgccaagtcgactccttgaacggcgtacggcaatgcgcctggacggcggccttgacgaattcgatgaaccgttcctgtgtccagtcgcggcgggcgaaaccggtcagaccgaagctcggcggcagtaggccacggttcgccaggtcgtagacggccggcagtagtttcttttgtgccagatcgcccgtgacaccgaaaatgacgaggctgcatgggccggcgatacggggcagtctgaggtcgcgcgagtcgcgcaggggattgctccaattgggggattcactcataatgtacaagggtagtcgccggcggctatctatcgctagaggcgatatgcgatttgggctgcgatttgggccacattgcgtgtgctgtgccgtgcgttgggccaatcgcgtacgcaaacgtgtacgcaacgccgtagttgaaatatcccaaaacggtgtgtattttagaagagttgcccctttagctcaacggttagagcagcgtccttttaagtcgtgggttgtgggttcgaatcccacagggggcacaacaaatcctcggaatcgcaatggttccaaggatttttttgtttcgaccagcctggctcctagagtggtgtcccatgtcatgcaccacgattcttgtcggcaaaaatgccagttacgacggttccaccatcatcgcccgcgatgacgattcgggctcgggccgttacgatcccaagcgcttcgtcgctgtcgcccccgacgaccagccgcgccactaccgcagcgtgctgagccatgtcgaaatcgaactaccggacaatccttgccggtacaccatcgcaccgaacgtgctgaataatcgtggcattctggccgaagccggtgccaacgaacacaacgtggcgatgagcgccaccgaaaccatcgctgtcaacgagcgcgtgctcggtgcggacccgatggtcgagttgcggccggctgtcggcgaaccggacagcaccgattatcaggccgagcagcccggcggtatcggtgaggaagacatcatcacccttgtgctgccgtatgtcaccaccgcgcgcgagggcgtcgcgcggttgggcgaactgctcgaaacctacggcacctacgaatcgaacggcgtgattatttcggatgtggacgagatctggtacgtcgagaccatcggcggccaccattggatcgcccgccgagtgcccgacgactgctatgccacgatccccaaccagctcggcatcgacgacttcgacctcgccgatgcgttcggcgagcagcgcgaatacctatgcagcgccgacctgcgcgagttcatggccacgcatcacctcgaccgcacaatgggaacgccggtctcttccaacggccgtcacgcgcatagcgccggattcggaacaaccgttgcccttcccacccgtttcaacccgcgcaaggccttcggcaccgcgacgccgaaggaccatatctacaacacgccgcgtgcctggtacatgcaacgccgcctcaaccccagcgaggactgggattcgccggccgcccgctacacgcccgaatccgacgacatcccgtggtgccgcgtgccggaagacaaggtgagcctcgaagacgttgatttcctgctgtcctcgcacttcgaaggcacgccgtacgacccgtacggcacgaccggcacggcggaatcgcgccaccgttaccgtccgatcggcgtgaaccgcaccggccatatggtggcgattcaggtccgcccgtatgtgccggcggccaatcgcacggtgatgtgggtatcgttcggctccggtccgttcaccgccgccgcgccgttctacgcgaacgtcaacgacacgcctgcctacctgcgcgacaccacgcccgaagtctccaccggcaacctgtattggacgaaccgcctgatcgccgtcgtggccgacgcgcattggtatgagacgaaccggttcatcgagggctatgcagaaggcgtgcgcgcgttcgggcaccggctcatcgagcgcacggatgagcagttgcttgctcgaagcgatgccgaatcgacggatacgaatgcatggccgctcgatggcggccacggcgatgagaaggatgtgcaaggcgtggcggatgcgctcgaagcggccaacgacgagatggccgactacctgcgcgagcacacaaccaagctgctgaacgacgtgctatacacctccagcaacctgatgcacaacagcttcgcgatgtccgaccgttgggccgagtagtaaaacctcgactggggaggtaatagggatgccctgctgataacgcgtcagcagggcaaaaccacaatccgaatcagttaaagccgacgatgcgttcggcgatgagatagccgttgcgcacgatccagcggccggttttgccgggcagattgagcgcgcgggacatcagctgcgagcgcacatccttgccgatggccggagaataggcgtcaatcgcatcccacagctcggttttcttaacgtagttggccggatcgcgcgagagaatcaggaacaccgaggtaacgcacgattcgatcgccaggaagtgaatcatgtaccggtacagcccctccggcaccgtaccgcgttcgggcgtggcctcggtcatcagccgattgacgagccgcaactggtccacacgcttaatcatcacgtcggtctgcacgctctgaccctcgcgcccgatgaagtagtggtagaacggcacatcgaggtactggatgcgcttcacccacgggaacggctggtacgagtaatagaaatcgacgtagaacgtatgctccggcagcttcagcccggaatcgcgcaccacctgcgtgcggaaggtgagcgcatgcatgatgatgtactgcgccagaccgaacttgcccaggtcatcccagccgagtacacggccggcctccatcacacggcggaagttcactacggtcttgtgacgcttggccaccttgtcatacacgtaattggtcaccagcatgtcaatcggttcgtcggtgtcatgctgtgcacgcaacgtggccagaaccgtgtcgatggcctgcgggtcgacccaatcatccgcatccaccactttgacgtacatgccggtcgccgccgcgataccggtgttcaccgcgccgccgtggcccttgttctcctgatgaatcgcgcgtacggcgcccggattggtgcgttccagcttgcgcgcgtactccagcgtgccgtctttcgaaccgtcgtccacaatcagcacctcgaggtcgctgatgtcgcttgccgaaagcaacgagttcacgcaacggtcgaggtaggactccatattgtatgcggggatcacaaaggtgagcgtctttgccgtgctggccatgaaagtcttacgtcctcacatatttagtcgttatgttcagtttcctgttcaaaccgtagcacttcgtctcccgactcggcagagtgttgcgtaacctgtgcccctgaactcatgttctgcaaccctgaatcttccccggtggcgtgctcgggatccgattgggcagaactcgtctggtctgaatccgggctgccggaatcggactcgcgcttggctcggcgctcggcctccttccgcgccttggcgccctcaaagaacaactggggcttggagtcaagccggctcaggccatgccaggccaaatccacaatgtatgcggccagctgctccttgctcacctttggccggtcggcccagtactgcccggtgaatacggtcatgcccaccagcatctgcgcgtagtacggcacgcccttggcagacagcttctgccgtttgaatgtttcggaaagaatgtcttcaacgcgtacggcgatgtctcccatcagcgagctgaatgagccggacgggtcggtgctcggcgagtcgcgtaccagtacctggaacccctcggcattctcttcgatataggtgaggagcgcaagcgccgtgcgttccacaatctggcgcgggtgcacggtcggatcgtcaagcgcggcggtgagcacactggtcagcgcgcgcatctcacgatccacaatgacggcatacaggccctctttgccgccgaaatgctcatacacaatcggcttggagactttggcgtgcgcggcgatttcctccacgcttaccgcttcgaagcctttggcggcgaatagcgagcgtccgacttcaatcagctgctcgcggcgctgcagcgacgtcatacgtgaagaatgtgccatgcggttcagcttaagtcgtcgggtggaattgtcggcctgagactgccgaattcgtaggggattccatctgcgggctagacttgacaggtatggatatgaatactgtgctcgccgttcttggcgtgattgtggcggcggttatcgtaatcgccctgagcatctggttgggcaagtcccgcaagcgcgatttggatcgtgcgatgggcaaggttgcccccgacaacaagaagacccgcgacgccaaggccgccgccgacgctcggctggccgccgaagccgaggaagctaaggctgcgactgccgccgagccggccaagtcagccgaatcggccaaagccgagcctgcgccagccgcgcaggccgaacccgaaccggcagctgcgcccaagcccgagtcccaacctgcctccaagcccactcccgccaaacctgaaacccccgaatcggtcggctctcgactgacccgactcaaggcaaaacttgccaagtccggcaacccgttcggcaaggccctgttcgacatcctcgccaaagacaatctctccgaggccgattgggaagacgtcgaagacacactgctgcttgccgacgtcggtgcggatgcttccgcccaactggtcgatgacctgagaaccgacgcccgcatcactggtaaagccgacccagccgaagtacgcgccacgctcaaggagaagctgctcgatctggtcggtcgagatacggaccgccgcctcaatgccgaaaagccgggtgccgccaagcccagcgtcatcatcatggtcggcgtcaacggcaccggcaagaccaccactgccggcaaactggctcgactgttcgtggccgaaaacaagcaggtcatgatgggcgcggccgacaccttccgcgcggccgccgccgaccagctcgaaacctggggcgcacgcgtcaatgtgcccgtcgtccgctccgacaaggacggtgccgacccggcatccgtcgcctttgaggcatccgccaaggccaaggaagcgaacgcggacgtgctcatcatcgatactgccggccgactgcagaacaagtcgaacctgatggacgagctcggcaagattcgccgtgttaccgaaaagaacctgccggtggatgaagtgctgcttgtgctcgacgccaccaccggccaaaacggcatggcccaggccaaggtgttcgccgaagccatcggcattaccggtgtggtgctctccaagcttgacggttccgccaagggcggcatcgtgatcagcgtgcagaaggagctcggcgtgccggtcaagctcgtcggtcttggcgaaggtccggacgatttggcacctttcgatcccgaaggtttcgtggacggcattctcgcgtagacggtcgagctctcctcagtctcgctttgctcgacagttcccctcagcgaggggagccctgcgtccgtccacgttgtgggcgcgggaaacgcccgcaacgcaccaaacctagccccgaatcatattcgaaacatgattcggggctttcccatatccgttggaatcatgccggaaccagcccatccgataccaacctaactgtcaggtgcgcttaacaatcgcgtaacttgccgtaacgaaaccaaaacgagaccggcttttactgacgaactgttagcccccacaagggggacggcattgtagagacaaagtcgacgccggccgcgcaaagcccccggtgccctgaacgaaagagagggaggtagacatgggagcgattgattccggtaacaccgcatggatcctgacatccgcgtccttggttttcctcatgacgcctggtgtggcgttcttctacggcggtatggttcgtgccaaggccgtcctgaacatgctgatgcttgaggcggccgccctgtcggtcaccatgattatctggaccctgtggggttggtcgattgcttacgccggttccgacatcggaggcatcttcggcgacccggccagcggcttcctgctgaaggactccatggtcgcccaggacggcgtgttcaccgccaccggtctgaacggcaacaactacccggtttccgtggacgttgccttccaggtcgctttcgcgatgattaccgtcggcctgatctgcggcgccattgccgagcgtgtgaagtacagcacctggatgattttcgtggcgctgtgggtcaccttcgactacgctcctatggcccacatggtctggaacggtggtctgctgtctgctgacggcgccatctccaaggccatcggcgctgccgcccacgatttcgcaggtggtactgtcgtccacatcaacgccgcagtcgccgccctgatcatcgtgctcatcatcggcaagcgtaagggcttcggcacgcagccgttccgcccgcacaacgtgccgttcgtgatgctcggcgccttcctgctgtggttcggctggttcggcttcaacgctggttccgccttcgccgccaacggtactgctggttacgcttgggtttccacctccgccgccaccgcagccgcaatgctctcttggggcttcaccgagaagattcgctccggtcactacaccgccatgggtgccgcctcgggtatggtcgccggcctggttgccatcaccccggccgccgatgtggtctccccgctgtgggccatcgtgatgggtgccatcgctggtgtcctgacctgcctggcctgcggtctcaagttcaagttcggctacgatgactccctcgacgtcgtcggcgtgcatggcgttggtggtttcaccggcaccatcctcatcggcttcttcggtgaaggcaccggtctgctggctggtggcgactggaagcagctcgtcgttcagctggtcatcgctctcgtcgccatcctctactccgcagtgatcaccgcgatcatcgccttcgctctggagaagaccatcggttggcgcgtcaccgaagctcaggaagtcggcggcatcgatcttgccgaccagggcgaacgtgcttacgattttgctggtactgccagctccgttctcaaggaggtgaagtgaaatgaagctgatcaccgctatcattcagccccataagctcgacgatgtcaaggaggccctcgcggccgccggcgtgcacggtctgaccgtgtccgaggccaacggctacggccgccagcgcggccacaccgaggtctaccgtggcgctgaatacactgtggacctgattccgaagattcgcgttgaagtgctgtccgatgacgcggatgccgaaacgctggttggtgtgatcatcaagtccgccggcaccggcaccatcggtgacggcaaggtgtgggtcgctccgctggactccgtggcccgcgtgcgtaccggtgagaccggttccgccgcgatctgataacacagacgtccatgcttagaaggggatggactgcataggaaaggtccccgcacgccgcgaattgacgccgtgcggggactttttttagcaatgaaagatgaagcaatgacttcagcagtagatggcttgaaacaacgattcatggatatgagccagccggatgacgacggcgtttaccggaatggtgcgaccaagcgcaaagcccgcacagaactggccatgcaatgcctcactgagctgtggaatgcggcctgcaaggatgtctctttccccgtgcccgactccggcatcggcttcgccgcggtaggctcgctggcacgtggccaactgggccccagctccgacctcgacctggtcatcatctacgagcctcgcacgttgaacgaccagcagctcaacgagttggccaacaaactctggtacccgctatgggacagcggtctggacctcgaccactccatccgcacgcgcgcccaatgcgaggaagtcaccgaccatgaccttcccgccgccatgggctggctggacgtgaagcccatcgccggcgacaccgctctgatcaccaccaccgccacgtccatcctcgaacgctggcgcaaggccgcccgcaagcgcctgcccgaactgctcgactccgccaaagcccgactcgacgaattcggccggctccaatacgtcaatcagcccgatatcaaggaggcccgtgggggtttgcgcgattcggtgctcgtctccgcgctcgccgcctcatggctggccgaccgcccgcacggcatttacgacgaagctgtggaacgtctgctcgacgtacgcgactgcatccatctggtggccggcaaggataccaacctgatgctgacgccctatcaggccaaagtggctgccatgcttggccttgccgatccgacttggcccgaaaacgagcgtgccgcctactcgatcgacgatttgcagacactgcttgcccgtatcggtcggcgcatctccttctcgcttgattccaccgcttcccgcgccgaacattcgctgacccacgaaaagccgcgattcgcgttcttccagatgttctctcagcgctctggtggcaagcgcgaagccccgcaattcgacgtggtggctcccggcgtggccaagcacgaaggcgaattggtgttggcgcccggtgccgagcctgccaaggatgccaagctggcgttgcgtatggccgtggcggccggcgaattcggtcttcccatcaacccgtctaccttggttaatctgaagcgctgcccgattcacgacaaccagtgggatgacgaatcgcgcgagctgtttatccgtctgcttgcgtgcggatcgaatcttatggaagtgtgggagagcatcgatttcgtggacattccgggtcgatggatgccggaatggctcggcgtccgcaaccgtccgtccgcctcggccgcccaccggtacaccatcgatcggcatatggtggaggtcacgtcgcgtctgggtcgtgagacaccgtccggtggacggtacgatgacgatcatttcaaggcattgctgttggccggtatcacccacgacatcggcaagcgcgcgttcgtggccgatcacgccgccgagggtgcccgccatgtgccggtgattctcaagcgtatgggctacgcgccggacatcgtcgactgggctaccgtgctggtgcgtgagcatttgacgctatccgaatttgccacgggtaaggacccctatgatccggccgtggcggaggagttggccgaccgcttgcaccacgacaagatgctgctggatatgctgttcgacctgacccgggccgacggctcctcgctcggtgccaccgccggtgagaccatcaccaagcaatacggctggtccaagtggcgcgaacaaatcgtccgcggcatgtattccgccgcccgcgccgctatgtaaacggaatcgcccagcgcttcgcgcggccgatacctacctcatccatgcgtccgagcgcacgcgtagtccgttggacagaccgcgcccacccatgagcaccacgttgaacgcggcccagagtacggcggtacgcatcaggtcgctcgtcagcgccggcgtcaccatattggccagtatgagtatgagcgtcacatacaccacggcggtcagcgtgcatgtgacggccagatagcggtagtcgcgcgcgccgataagaatgccgtcgattgccatcatccagccttgcagtgggaagaagatgcccatcgtcaccatgcccacggcgatcagcgtctgaatatgtggcgtaggggagaagaagtgcccggcgaacaggccgactaccgcaaaagccgcgccgattaccgcgccggtgaccagtcccgcacgcccggtcgcccgcgtcagccgccgcgcctgctgcacgctgccagcgcccagcgctgtggccaccagcgtctggccggcgatgcccacggaatccagcatgttcatcgcaaaattccaagaggagttcacggcctgaaacccggccaacacggcagtacccatgcgcgcggcacaggcgaccgtagtcaccatggccgcacgaatcgccaatgtgcgaatgaacaatggcagtccgtcgcccccggctgccgcaataccggccaaacgaggccgcagactcgcaccatccgcccgggaccacagaatggcggggattaccaggaacagccccatgaaccactgagctaccagcgtcgccactccggagccggcaatgccccaattcagcacaataacgaacaacacatcaagcaccgtgttcaccaccgcgccgcccaccgcagcgatcagcgtgatacgaaccttctgcaatcctcggaaaatgccgttcgccgcatataccatcagcatgcctggcgcacccagcacgattgcgcgcgtataggtcacggcttgttccaatacttcgccctgaccgcccagtgcccggcataatggctcggcagccgcgaacaatcccaatcccagtacggtgccgatgctcaaggccagccacaggccgtcaatgcctgcctgcagtcccgcgcgacgacgacccgctcccagcagatgtgccacctgcgcagtggtcgagtaggccaggaatatgcatagtccgactgccgtgaggatgatggtggagccgattgacaggccggccaacgccgcatccccgatatggccgacgatggctgtgtcgataaggatgaaggtcggttcggcgatgagctggccgaaggtcggcagggccagcgccatgatccggcggttggtggagcgggcgtcggtcgggccgatgctgacgtttgtgtttgcgccggcatgcggggtgccgaagccatcgcggcgtgtagtatcgccggaactggtggctttggcgtcggaagagtctatgggcacgctcacacgcatatcacgcctgactgcgttgcgcaagcacctgttgtgggcgcggaatgttatccccagactatccaccaagttatccccagtatgtggataacttagtggattatccccagaattatccccaaaatgtggataacttatttttctatccacattttgctttctgcgtgtcgtggcgctgactcataggtgaataaggaatgaaccgatgcgggcaaccgtttcgtttccatacgatatcgttcacctgccacgccacatcctatacttggaggctatgccagaaggaagtgaacactcgtatcagaatgggttcggcggtggcctggatcgtggcgatcgtggcgaccgcgcgggccggggcggcacgcagacgtcggcggcggccggcgacccgattttcgaccgcgtgcccccgcatgatgacgacgcggaaatggccgtgctcggcggcatgctgatgagtaaggatgccatcggcgaggtctcgcagaccattgacgtcaccgatttctaccagcccaagcatcagacgatctataacgcgatcatcgatctgttttccgccagtcagccggtggacgtggtgctcgtggccaaccagctgttggcggatggcaacctcgacaaggtcggcggcgcggactatctgcacagccttgtcgcatccgtaccgaccgccgctaatgccatgtactacgcggagatcgtccatcagcgggccattttgcgcaatgtgatcgccgccggcaccaaaatcgcccagctcggttattccgccgagggatcgcaggctgaggatgtggttaacctcgcccagtccgagatctacgagatgtcgatgggcaaggtgcgtcaggactatgccgccatcggcccggtggtccacgacgcgctcgaccagctggacaaactgcagcaaggcctcgtcaacaagggcgtgccgaccggcttccgcgacatcgacgacgtgacccagggcctgcagcccggacagatggtcgtcgtcgcaggacgtccggccatgggtaagtccacgctcggcatcgacttcgcccgcgccgccgcgttgcaccacaacatgacttccgtggtcttcagcttggagatgagcaaggtggagctcgctcagcgtattatctccgccgaaaccaatattccgatggccgccctgcgccgcgccgacgacatcacccccgaacgctggaacaccctgaaccagttctggaccaagatgcagaacgcgccactgttcattgacgacagcccgaacatgagcctcatggagatccgtgcgaaatgccgtcgtctgaagcagaccaacgatctgaaactcgtagtcatcgactacctgcagctgatgacctcgggcaaggccgtggaatcccgccagcaagaggtgtccgaattctcccgtgccctgaagctcttggccaaggaactcgaagtgccggtcgtggccctttcccagctgaaccgtggcccggaaatgcgtaacgacaagaagccgcagctctccgacctgcgtgaatccggctcaatcgaacaggacgccgacgtggtgttcctggtccaccgccctgacttctacgacaaggaagaccgccctggcgaggccgatatcatcatggccaagcaccgtaacggcccgaccgaaaccttccacctcgccttcctcggtgccacgtccaaattcaaagacatgccgcaggactacaacgccaatcagggggtgtgatgatggcaagcaacgtttcacgcgatgtttcgcaagaccaatcgtccgtggtgcagacctgcaaaccgtggtatgcgttcgccaccgtggccgcaggccgcttcgtgcggtttgcatcccgcgtcaccaaacatggcggttcggctttgcccggcaaagtcgtagaaaagattgaccccggcttcctgacccgtacgctcgggcagttgccgcttggcgtggtattggtgtccggcacgaacggcaagaccaccaccacccgcatggtcgcctcgatgctctccgatctggggctgaaggtgttcaccaatccgaccggctcgaacttcgtgcgcggcgtggtctccgcactgcttaccgaagtcacgctcggcggcaaattggacgcggacatcgccgtgctcgagctcgatgaggcgtacgccgtccacttcgtcaagcaggtcaagccccgttatgcattgctgctgaacgtgatgcgcgatcagcttgaccgattcggtgaaatcgacaccacggccaaactgctcagccatgtggctgcggcgactaccggcactgtggtactgaaccgcgaggacccgcgtatcgccgcgctcgccgcgaaggccccggctggcaccaccgtgcgatacttcggcctcgccgacgatttgcgccgctatttcccgtccgatgacgacatggccacgaccgtgtcggtggaaggtgtggccgggccgctcccctcagccagaactcccctcagtccgcgaagcgaactgagaggagcttccgcaggcacggcagaacttcccgccgacgtgacacttaccgcagtgggcgaccacaaggccaccttccagatggacggtcagggctacgccaccgacgtcaagcttgaaggcgtctacaacctgtacaacgcggccgccgcgctcgccgtggtacgtgcggtgatgcaagacaatgccgccgcatccaaggccaccgccgcagccaacgcctgcgccgtgtccgccgacgagctcatcgccgccgtttcccgcgtcacgccggctttcggccgtggcgaggtcatcgacgtcaacggttccccggtcgaactgctgctggtcaagaacccgatgggcttccgcctctcgctcgccagcttcgacccggccaacgcggacaccatgatcgccatcaacgacgaatatgccgacggccgcgacatgagctggctgtgggacgtggacttcacttccctgcgcgcgtccggtgtcgccatggtctccggcgtgcgtgcctgggacatggcattgcgcctggggtatgaccaagtgccagtcgccgatacgaacaccgacctcgaacaggccgtcaccgcattcgtcaacgccaatcccggcacacgcaagcacatctactgcacctacaccgccatgctcaaaacccgcgccgtactgggccgcatcaccgaagtacgggacgcgggcgtgggcaagtaactatcctctagcgcccgcgcgccacctcccgcctgcgggaggacatggtgaggaataagacgcttcccgtcagcgggaagacatcgacaaggagaacgtgacatggccagaacaattgatgtggtgtccctgtatcccaaagacatgaacatctacggcgattccggcaacgtgctgactatccgccgccgtctggaactgtacggttatgaaccggtcgtccaccagtacaatcaaggcgacgactggcccgaccaggtggaccttattctgggaggcggcggccaagacaccggccagaagaaaatcatcgacgacttctaccatcgcgccgacctgttgcgttcgcttgccgcagacggtacgccgatgctgatgatctgcggcctgtaccagctgttcggcgagtactttgaaaccgtggacggcacccgtctggacggcatcggcgttatcggtgcttataccgtgggccagaacgtgcgtatgatcggcaatcttgttgagcattccgaccagttcggcgatgtgattggctacgagaaccactccggccagaccttcctgcgcgaaggcgttcagccactcggcaccgtcaatcaggacggccgaggcaacaatggcgaagaccataccgagggcgcgcgcgtgcacaacgtgatcggcacctacatgcacggctcgttgctgcctaaaaaccccgccatcagcgatttccttatcgaaactgccgtgactcgtcgttacggtacgttcgatacgtccgatcagacccccgaacaagccaaggagctcgcccggctcgatcaagtagccaccaacgcgcgcaaggctgccgccgaacgtcctcggtgaattctcggtgagtcctcggtaagtaccaatcagcgaaaaatcagtcgaaatcagtctgagggtctagtacattgccctgttgtttgcgctaggcttggtggtacgagacatggcaccaggccatgtcggacctcgaaggaggggtatcatggctgattttgatcttctgggtgatggcctgcgcaaggtcctgctggcgggcatcggagcccttgccaccggatacgagaagagcagcgagctcgtcgacgaactcgtcaagaagggtgagattacggtcgagcagggcaaggcgctgaacaccgagctcaagcgcaaggtgagcgagacggtggatgacgccaagaaggccgccgccgaagccggcgacaaagctgctgccgcagccgacaccagtgccgccgacaagcccgctgacgagggcaaggccgagtgaccaagcccacacgcgctacgccggaatcagggtcgaccccgctttccagcagggtcgaccctattctgacgcctgcgaaagccgaacgtgaggcggcggcgaaccggtccgtcgacacgtcggacacgctcaagcagaccgttaccaaggcgactccgagcgtatccgacgaaacgctggcactgttcggacgcaggaacgatttcgccacgcgctaccatctgacgcgtcgtggcaagatcaaacgactggggcagatcaccagaatcgtcgagcaattcgacgtgctgcacggcctgactccggtcaaaatgcgcctcatgttcgaggcgctcggccccacgttcgtcaaagtgggccagattctgtcgatgcgctccgagattctgccgcaaagcttctgcgacgaactcgccaaactgcgcgccgacgccgacccgatgccgtattccacggtgttggatgtgcttgccgccgaatacgggcgtcccgccgacgaggtgttcgcgcatatcgaccccaagccgttgggctctgcttcactggcgcaagtgcatcgcgccacgctgaaaaccggcgaagatgtggctattaaagtgcagcgcccgggtgtgcgcgaaaccatggcccaggacgtctccatcatgcgctccatagccaaggccgccactaaggtgattcgcacctcacagatcgtggacctgaagggcgtggtcgaggagctgtgggacaccttcgaatcggagactgactttctgatcgaggcccgcaatctcgccgaattcaagcgtttcgccgcccgattcaaatacatggactgcccgacggcgtacaccgaactgtgcaccgagcatgtggtggtcatggagtacatcgacggcatctccgtctcccatccgggccggctcgtcgatgctggttatgacttgaaggagatcggcaccaagctcgtcgacaattacgccacgcagattctcgacgacggcttcttccacgctgacccacatcccggcaatatcatcatccggggcggccagatcgtacttatcgacctcggtatgaccggtcggctcgaccagcgcacccgtgcagtcctcaaagaaatgattttcgccgtcgccaaacaggattcgcccgctctggccgaggggctgctgcgatttgccggcaccgaggccgatccggaggactacccagcactgctggctgatctggacgtgatcgtcaaggaattcggcaccgtggatctggccgaactggacattgccgccttcctgaccgcactgacgcagatggccggccgccacaacatcgaggtgcccagtacggtgaccaccgtcggccgcgcgttggttacgctcgaaggcttgctggacgagttcattcctgatgtgaatatgatcgaaatcatttccgaccatatcgccacgtcgaaatcgctgaagaacgccaccaaagacgagatcaagtcgctgggcgttgagggacatcaggctttgcatgccacgctcggcaccatgaccgaactcaagaccgtggcccgtatgctgacccgtggtcagttgcgcgtcaacatggaactggtcggctctgaagagccgttccagctgctttcggatatggtgaatcgtctgacgatggccctgattgtggtcggtttgttcgttggctcgtcgattgtctactacgccggcatgaagccgattatcttcggcattccggtcatcggcttcatgggctacgtcgtggccttcgccctcggcgtatggatcgtcatcgacatctacttaaaggggcgcaaaaccaagaagcggtagggcatcgattggtatcagtccagcgggagggtggattcgcgctggataaggtggcagggtacgtagtcgacaccgtgatgcgggttgccgtcgatggcatcgaccaagtatcgtgccgcacgccgtccgatggtttcggtttcgttgtcgatcgacgtcagtgcgggcctcgagctggaggtcagtaccgaccagttatcgtggccgatgacggcgacgtcatccgggatgcgcagtccctgctgcttgagcacgtcaatgcagccgcgggccaactgatcgttctggcagaccactgcatcgaacttgaccccttggtcgagcagcaggcgggtggcggcgcggccccagccttcgtcccatttgccgtaacgaattgggccggcgggttcaatacctaattcggagagtgcctctagcgcgcccttggtgcggtcggtggcagcggtataggtttcgtcgccgccgataatggcgatgtgccggcggccacacgagatgagatggttgatggccatgcggccggcgtccacgttgtcgcaagtgaccgagcagtctttggggtcggtggaggggccgtagacgtagaccagtggcacgccccagtcatggccaagcgtgggcctggggttggtctcgcactgcacgatgagcagtccgtcgaccttgagggacagcagtttctcgacatgctgacgttccaaggcggcgtcgccacgagcgttggccaacaatactgaggtcgattgggctcgcaactcgttctccgcgccgataagaatcggtgtggagaaacgaccctgcagatcggaggtgaccaggccgatggtgccagtagtgccgcgggctagggattgggcaagcttgttgggagagtagttgagttgcttggcggcatccagtacacgctgcttggtttcttcgctgatgcggggtttgttgtgcagtgccttggatgcagtggccgtcgagactccggccaatgccgccacatcctcaagtcgcgctgcccgtccggttgctggctgggtcatcatgcctcgattccttggttcttcagcagtatatagcgcattgttttgcgatgaaatacctcatacggtgtggtgcgccattacatctgggaataattgtagcttcaatgcgaaaactttcgcaaacatctttttttcggcgtggcgtagtcagggaaattgttcaagtgcaaggtaagtgaaagaaagcgttacttccatgttcgcttttgtttgatttgctcgacacgccggaataatcattgatattaagccaattcaagcacgttattcatagtcgaatcacagtctcgaacccgtttgatgtgagaaaaaacgcgaaaatgcgaaagcgcttttgcaaaaacttccatgttcgtttatattgagaaaaggctttcgcagtgttacctgctccgagcaaaggagcgagcagggcgaaaccaaggaggcggaccgtccgccaccgcctctcatagttgagcggatatatagagaaagaagcgaacatggtgtctttcaataaactgacccgtactcttgctggcatcgctgccgccgcgttgatcgttccgctggccgcctgtggtggctccggcaatggtggcactgccaccgccgaaggtatcccggccaagggcaccgacgatggtaccgagatcaccctgtggacccgttcccctctggagcgtcaggccaagaacgtggtcgaggcttacaacaagagccacaagaaccaggtcaagctcgagatcatcccgaacgacgatatggaaggcaaggtcggcggcgcttcgcagaccgactccctgcctgacatcctcgccggcgacgtggtccgtattccgtactgggcttccgagggcatcttcaccgacatcaccaagcaaatcgatggcctggataacaaggccgacctgcagcagggccacatcgaagccggtactgttgacggcgccgagtacaccctgccgttcatcaccgatgtttccgtgatggtctggaacaagaccctgtacagggaagctggcctggatccggagcagggcccgaagtccatcgctgagttcaccgagcaggccaagaaggtcgccgccctcaacaaggatggcgtcgcaggttcctaccttgccggtcagtccggtggtgctctggtcttcgacctcttcccgtccgtgtgggctgacggcgaatccgtcatgaacaaggatggctccgaggccaccctggacaacgactccatgaagggcgtcttggacgcttacaaggagctggccaacaccaccaacggcctgggtgcaggctccaaggaagagaccggcgccacctggaccgctccgttcgcgaacggcaagatcggcgttatgccttacccgaacacctccaccactgctctgttcgatgctgagaaggacggcggcttcgaggtcggcgttgctccgatcccgggcaccaaggaaggcaagacctccacgttcctcggcggcgatgccatgggtatctccaaggactccaagcacgttgctcaggcctggaacttcctctactggctgatgcagtctgacgctcagaaggaagtcttcgctgaccaaggcgacaccgcctccaacatccagaccctgaagaccgcttacaaagacgctgacccacgcatccagaccatcaactccgtgattatcgacggcaacggccagaccccgaagtccccggccttcaacgaagccttcaacgccgctggctccccgtggcagctgctcgtgcagaacgccgtgtggggttccggtgacctcaaggccgacaacaaggccgtcaccgacgtcctgtctgcccagtgattcggtggtgatgctcctcaccatcactcatcaaatcacagcaataactgaataacaactgaacagattgagccggtccctcccttgtgagggcaggagccggctcaaccacataatcgaacttctatcttcttcttcattccttttcttccttcatcactacataccttatgaatgcggtgtgttggcggggcttcggagtcctccttcctcgaagccctgacatcggattgcattcggattccgtgattaccatttcacagtaatttcccaaaggagagagaaacatgtcgagtgtttccaagagcgccggggctgtgcccgtgcataagtccaaggcgaaggcggcgcagaccaggcgaggtctgctgtacgcacttccggactggctgatgattatcgtcctgttcttcgtgccgattgttctactggtcgtcatggcctgctctcgttggagcctgctgggtggcaaccgcggcgtgaacttcccggacaacttcgtcaaggtgttcgagaacaaattgttctggccctcgatttggttcacgctcgagtacaccgtgatcgtcacgatcttcctgttggtccttggcctgggcatggccatgattgtgcaggagagctcgaagtggaacaacgtgctgcgtacctgcttcctgctgccgtccgcgacgggcctggcgtccgcgtccctgctgttctacgccctgtattccccgcaggtgggccctgtcaccaagattctgagctcgttgggtctgatgcaggagggtggttcggtgctggccaccggccagtcggccctgtgggccacgattatcgtgattgtttggcgtttctcgggctactacatgctgctgatgatgatcggtctgcaggccatccccggtgatctgtacgaggcggcccgcatggacggcgccggttcctggcgtatcttccgctccatcaccctgccgctgatgaagccgaccatcgtgatgtgcctggtctactgcgtgaccggctcgatcctcgcgttcgatcagttcttcattctgaccaagggtggtccgaacaactccaccatgaccgtggtgcagctcatctacaacttcgccttcgattccaagaaggatctgggtatggccgcggcgctctcgctgatcgtgctggtggccttggtcatcatcaactccatccagatgcgcggcatgcgcgacaacaccaagtgagaaaggggaggtaacacattatgactaccccattgtggaagcgtatcatcgcccggatccttgaggccctgctggccatcatcttcatcagcccgctggtctgggtcatcatctgctcgttcagcccgcaggccggttcggcccagtccaagggctggggcgtggccaactacctgaccctgttcggttatcaggaaggtctgcccaagtacctgttcaactcggtaatcgtgactctggtcgcggtcgtgttctccgtggtcgtctgtacgctggccggctactcgttctcccgcttcgactacccgggccgcaacctcggcttcatggtcaccctgtcgatcctgatggtaccgtacgcctcgctgctgatcccgctgatggtctggtacaagcagatcggcctgaacgacagcctgctgggcgtgggcctggtcatcaccctgttccagctgcctatgagcacgttcatcatgcgcaacgcgttcgacgcgatccccaaggacatggaggaggccgccatggtcgacggctgcaacagcctccaggccttgttcaagatcctggtgccggtggtcaagccttcgatggttacggttggcctgctcgccttcctcgaggcatggaacaacttcatgattccgctgtacttgagctcttcgtccaagtccacgctgccgctggcgatggtgaacatgcgtcagcagaccatgggcgtcatcgattacggtgccaccgaggccggcgtcgtgatcctgctgattccctgcgccatcctgttcctcgcactccagaagtactacgtcaagggctttatggccggagctgtcaagggctgacggctcgtgccgccggcccttggctgggagcccggtgggctcccagcaagctccgtgctgagacgcgacagcgtcgaagccaatactgagcccggctgaaaccggtccttaattgcagggccggaggcggtgtggtcaagggccttaaaaaaaggacaatcatgaacgttacaatcacttccccgttctggaagcggcgtcgcgaccagatcgtcgaatccgtcatcccctaccagtggggcgtgatgaacgacgagatcgacaccacggtgcccgacgacccagccggcaaccagctggctgacaacaagagccatgcggttgccaacctgaaggttgccgccggcgaattggacgacgagttccatggcatggtcttccaagactccgacgtctacaagtggcttgaggaagccgcctacgcattggcataccacccggatcccgagctcaaggcgctgtgcgaccgcacggtcgatctcatcgcccgcgcccagcagtcggacggctatttggacaccccgtaccagatcaagtccggcgtatgggccgaccgcccgcgcttcagcctgattcagcagagccacgagatgtacgtgatgggtcactacatcgaggccgccgtcgcctaccatcaggtgaccggcaacgagcaggcccttgaagtcgccaaaaagatggccgactgcctggatgccaacttcggccccgaagaaggcaagatccacggcgccgatggtcatcctgagatcgagctcgccctcgccaagctgtatgaagagaccggtgagaagcgttatctgacgctttcccagtatctcatcgacgtgcgcggtcaggatccgcagttctacgccaagcagctcaaggcgatgaacggcgacaacatcttccatgatctcggcttctacaagcccacctacttccaggccgccgaacctgtgcgcgaccagcagaccgcggatggccacgccgtgcgcgtcggctacctgtgcactggtgtggcccatgtgggacgactgctcggcgatcggggactgatcgacaccgccaagcgtttctggaagaacatcgtcacccgtcgtatgtatgtcaccggcgcgattggttccacccacgtgggcgagtcgttcacctacgactatgatctgccgaacgacacgatgtacggtgagacctgtgcttccgtggctatgagcatgttcgcccagcagatgctcgacctcgagcccaagggcgaatacgccgacgtgctggagaaggaactgttcaacggttccattgccggcatctcgctcgacggcaagcagtactactacgtcaatgcactggagaccacgcctgacggactggataacccggaccgccaccacgtgctctcccaccgcgtcgactggttcggctgcgcctgctgcccggccaacatcgcccgactcatcgcctccgtggaccgctacatctacaccgagcgcgacggcggcaagaccgtgctgagccaccagttcatcgccaacacagccgaattcgcttccggcctgacggtcgagcagcgttcgaacttcccgtgggatggccatgtggaatacacggtgagcctgcccgccagcgccactgacagctcggtccgatttggactgcgcatccccggctggtccttgggctcctacacgctgaccgtgaacggcaagcccgcagtgggttcgctggaagacggcttcatataccttgtggtcaacgccggcgatacgttggagattgcgctcgagctcgacatgtccgtcaagttcgtgcgcgccaactcccgcgtgcgctccgacgccggccaggtggccgttatgcgcggtccgctggtctactgcgccgaacagaccgataaccccggtgatctgtggaactatcgtctggccgatggcgtcaccggtgcggatgccgctgtggctttccaggccgacttgctgggtggcgtcgataccgttgatttgccggcagtgcgcgagcacgccgacgaggatgacgcgccgctgtacgtggatgccgacgaaccgcgtgcgggcgaacccgcgacgctgcgcttggtgccgtactactcgtgggccaaccgcgagataggcgagatgcgtgtcttccagcgtcgataaatatcggcgatatgccggcctgcgcgcaactggccggcaaaaaaatacttatgccgccatcgtctgcaataagtcgatgacggcataggccggatgtcagtatcgattggagccgaaaacacatccggggaatgaggtctcctgtgcggggtaatacccgtgcaggagattattttttaattatatgctcccgctgtgagagctgtcggcggagtcgactgagggcggtcataagcggtaccgtgtaagccaccctcagtctcgctttgcgagccagctcccgccagcgggagcctgttggttcctgattcagcgaggctgaatcgttgcgccgtaggtactgcgacacggcgaaacacagcaatgccctaatgcgaaaataaatgcgaaagctgagaaattaccgggtttttgttgtataagatggttgatatcactgagggaaagttgtgaaaccgtattcgctcggttatgatgtggaatcagcttcggtgaattgctccaaccgggatatccatggcggatatcacaccagatttactgaagacactcattccggtgaacccaataaccaataaaggaaactgatggagaacgggctctgcggcccagcatccacagaagaagtcctggtcgcatagacgcgacgtagcctgagcgaagacgcgaaagaccggggcggagaggtccaagcaggaatgcatcaatcaacacgaaagcggtggcttgcgtcaatcggcgcggttgcagcggtcgccacactggccaccggcggtgcagtcaccgcgcaggcagccgatacgcccgtcatcaagaatgcggatgtggcatatccgtcgttcaaggggtctgatgatccgatgaagacggcggcgaacaacaccacatataaccctgccgccagctatctgcaggagacattcgataacgacgtgaagaacctggccggcaccgacaccgaccatgacttctggatcgataagattctcacccgtactggtgcacagccaactggtaaaggcacgaacgacaagggtgcttactcgtatgaaggctccgacggcaacaactacctgttcacccgtggtcgcgccgcctacatgtacacgcacacgcctaatcggctcggttttgtgggtaacaccgcctactgggatgagaccaacagggatggctttaccgttaccgtaaacgctgacggtgcaaaccagacccttaacgaagacgcctcccagcgcaagcagacaccgagctacttcacctccctgttccagaccggtggcaagagcctcaagatcaaggaagttaagtacatcacctacaacaacgtgatggttgcgaacctcaccgtggaaagcacgcaggaccgcgatgtcacactgaccacggcctcgccgttcgccgccgagggtgctgatggtgccaccgaacttactggccgcgtgaacgtcaagaacaacctgacgaccatctatccgcgcttctccgccaacaaccaggacggttccaactggatcgtcagcggtggcaaactcaccagcacgttgagcctcaaggccaacgaaccgcagaccgtcaagattcagctcggcctgatcgccaacgaactgcctgactccaccaaggaatatgaggcccgttacaccggcgaccttaaggatgctgccgcctcctacaaggattccgtgaccacctacaacaagtggtgggtcgataacgctccctatgtggacactccggaagacaacatcgataagaccgtggtctaccgctggtggctgagtcgtttcaacatgctcgacgccaacatgcctggcaacaccttccagtacccgacctccatcgagggtgtgctcggctacaacaaccagatcgtgctcacctccggcatgttcatgatggacaccaagtggttccgcaaccccgagtactcctacggcacctggctttccgccggcgataccgccaagaagagcaatgcgggctattactactaccacgacaatccgggcgacccggccaactggaaccatagctacacgcagtacatcacgcgcgccggctgggactcctacaaggtgcacggcggtccgtccaccgtggccgagaagctggccgaccagggtgccgaggacgtgcaaggtctactcgcttccaagagcgagccggacaacaacgacaaccagaacaacaatgacaacagcttgattgactggtcctggtggtcgatgaccggtaacgatgccgacgccgtttccttctctgagccgggtcgctccggccagcgcatggatcgcgccgatggttccgccaatatgtgggccaacgctaacgcggctgctcaggcatacaaggctgctggcgataccgccaacgccgagaagatgcgggccatcgccgacaagatccagaaagaagtcaccactgaactgtgggacaagtccgacaacctgctcaagcacaggtggctgaacgacggtgctttcgccaagtacaaggagatcaataactactacccgtactccgaaggcctgatgcctaccggcaacgaagattacaacaaggctctgcgcctgttcgaggattccaacgagttcccgatcttcccgttcttcaccgccaaccaggcggacaaggccgcgttgaacttccccggttccaacaacttctccatcattaatgcgcagccgctgctgcaggtctactcggccggtattcgcaactacgatgcagccaagaatggctacatcaccaatgagcagttcaagaagctgctgtactgggtggcgttcgcgcactaccagggcggcgataacaaccaccctgatcagaacgagttctggaacgaggacaacaacaacgtcggcgatgtgaacggtgacggcgtgatcaacaacctcgacaagaaccttgacgccgcacagaacggcggcaagatcacctaccgctcctggatccaccacacccagctcggcaccacgaactggacgatggtcgaggacgtagccggtatggtgccgcgcgaggacaacaagattgagctaaacccgatcgaaatccccggttggaactacttcacggtaaacaacctgcgctaccacgatcaggatgtctccatcgtatgggacaaggacggcagccactacggtggtcctgctggctacagcctgtacgtgggcggcaagctcgccttcacctccgacaagctggcgcacctcatctatgacccggctgcgggaacggtcgaggtcaaggacgattccggtgcccaggttaccgtcggcgccgaagccgtcaagaacgtgaaggccgccaatcaggttaccttcaatgccgatcagcgcgtgaccgacctgttcgccaagtccggcaccaacgtcgactccgcctccaagtccaccacgaacgtggccaaggacgcggacgtgaccggtaccacctacgccgagaaggacaccaactacccggccaagaacgcggtggacggcaagaccgtgatggaatcgttctggggtaccaagggctccgggaacaagaccgacacgctcaatatcaagttcaaggacggcaagcagaagatcgacgacatccgcttgtacttctaccagagctcgtccagccagaccatctccggctatgccgagcccgccaactacaagttggagtaccagaaggatgacggcacatgggccccgattgcggatcaggtgcgcaccccgaactacgcgggcgcgaactacaaccgtatccagttcactccggtggagaccacgaccatccgcgtcaccttcacgccgcaggccggcatggccgtcggtgtcaaggagatcgaagcctacaacaccggtatcaaggctgacggcacttctgagaaccagactccgcaggtggatgcttacgtgtcttccagcacctcatccggtgccaagctcgtcggtacggtgaaggatgacggtctgcccgcagaaggcgacgtcaccaccacatggtcccaggtctccggtccggaaggcggtgctgcgaagttcgtggacgcctccgctgccagcaccaccgtcaccttcaacaaggagggtgactacgtcctgaagctcaccgcttccgatggcgagaaggaaggctccaaggaaatcaccgttcacggcatcccctctgacggtaccgtgaacgtagccccgcagtcgagcgcctctgccagctacaccaacggctaccagccgaaggacaacgccaagaaggtcatcgacggtcaggtggtatacgccaacacgccgaacgagacctggaacaactggggcgacaacaccggtgtggagccgtggctgcaactgaagtgggccggcaaggtgccgctgaagaaggccaaggtcttcttctggaccgatggcggtggcgtgccgatggtctcatcttggaagcttcagtacgctgacgctgacggtaactggcaggatgtgaaactggctgacggccagtcctacacggtcaaccggaacgaaggcaacgaagtgaagttcgccgacaccgtcgaaaccaacaagctgcgcgtggtcttcccgaagggcgccatcgtgggtgcttccgagttcgaggcgtacgccatcgagccggtgagcgtggacgaagtcaaccgactggtgcagaccggttccaaggccgatgatctgaagctgccctccaccgtgagcgccgtatacaccgacggttctcgccgtgacctcgccgtcacgtggggtaaggtgaccgacgctcagctggccgccgatgccgtattcgatgtcaagggcaccgtcgccggtgcgctgaacggtacggttgcacacatcgcggctcgttccgataccgcatcgcagaccgtgggtaatgcgcagccggttgagcagaccgtctaccagaacgccaagtccatcgacctgcccgccacggttccggtgaagttcccgaacggatacaacgacgaccgcaaggtcacgtggaaggatgccgacatcaaggccatcgacctgaccaaggttggtgactacgaggtggctggtaccgtcgacgacggttcgtcttccgcagctgccaagctcactgtccacgtggttgccgacccgaacggttcctccactcctgagcctgagcctgagccgttggtcggttggattgaaggcaaggcgaccaagaccaccatttcgcctgattccgaggcaacctggtcaccggccgaaggcaagctcaacgacggcgtagtcgtcgatgatacttggccgaccacggatgatcagaacgtcaacgacaaggtctggggttcttggggcaaggcaaaggacggcatgtacgcccagtacgacttcggtcagtccgtgaccgttgaccagagccgcgcccagttctgggccaacttcgctgagactgacgattcgaagggtggtctggaagtcccggacgcttggaagattcagtacctcgccgaggatggttcttggaaggacgtcgagcccaccgaggattacaccgtcgtgcgtaattcgccggcttctcgtgcggataccgatgccaagggttggagcgctgtgaccttcaagccggtcaccaccaagtcgctgcgactcgtgctcactccgcacaccggcagcagcaccttcggggccgccgtggccgagtggggcgtgcatggtattgacggcaccgagcctgaacctaccccggtcgacaagaccgcgctcaagtcggctcttgacacagccaacggcctcgatgcaaaccgctacaccgccgcttcatgggctgagttccagcaaagcattgacgctgcccaggctgtgtacgacgatgtcaatgccaccgaagaacaggtcgccgagcaggtgaccaagctcgaggacggccagaaggtgctcgttgcgctcgccaccgacgtggagaagtccacgttgcaggcggccatcgacacggccaaggccgaggccgcttccggcaagtacacggataagagtgtcgaggccttgaacaaggccatcgaggctgcggaaggtgtgctcaagggcgatgagtccggtgaggtcactcaggccgccgtccaggaagcgtccgcttcgctgaacaaggccgtcaaggccttggaagagaagcccgccgtcgaaacggtgaagaaggagtctctcaaggcttccatcgagcaggccaagaaggctgacaagtcgaagtacaccgaggaggcatggcaggctctgcagagccagattgccgccgctcagaaggtgtacgacgacaaggatgccaagcaggccgatgtcgatgccgcacaggatgcccttgacaaggcattttgggccaccaaggttgagcagaagcccggctcccagcagcctggtgtgaccgacactgataaggatgataaggacaacaagggtgatcgtgtgcctccgactggtgccgcggtttccgtagttgctgcggctgccgtgctgctcaccgccgcaggcgtgaccatcctgaagcgtcgccagtccggcgaccacggttcggctcgccactcggcctgacccgcaacggagtcattctgccgagtgagccccctcacagagggggctctagccttttccttctacccatcattactcttttcactcactcaatgaggagcactatgagtttccatgtatccgcgcaatcggttcgcgcggtggccggtggactcgtcgccgcagcgacattgctgtcaggccttgcccttgcgccgaccgcaatggccgccgattcagccaccgctgacaacgcgcccagcgttgccggtcacgcgtataacgaactgccgtataacaatcctgatgtcaccgtcacccaaatcgacaatagcgcactgcccagctacatgcgcaaccccatcgggcagaacgagggtattgacaccccgaacgatctttcgcagaactactactctgcagatgcatccgcgctgagctatgacggcaaactcttcgtcttcaccggtcacgatgaggcttcgcccgactacggctccttcaacatgaaggactggggcgtatacgtcaccgatgaagacggcctgaatcaaggcaaatggacacattacaagaccatcgccaaggcagacctgttcagctgggccaccggcgatggcgcgtacgccggccaagtcgtagccgacgataacggcaccccgagcgacacttccgatgattggttctactactacgtgccggtgaaggacaaggcttctgaggcggctggacaggacccgttcgccatcggcgtggccaagtcgaagagtccgctcggcccgtggaaggatgccatcggcaagccgctgctcaccacatcgcaaacccagattgaaaccatcgatccggcattctttgtggacgaggatggcaccggatatttgcactttggtacgttcggcactcagctcgccatcaagatgaagaaggacgccacaaccggccgcacctcatacaccgaggtggaaaccaaggctgatggcaccacgccgaacctccacaccatgaaggacgcggacagcaacgcgaacggcccgaagggattcttcgaggcggcgtgggtgttccgtaagggcgatacctattacaacgtgtacgacggcggtaagcccggttcgggcacggccacctgcgtggaatcgaactatcaagcttgcatccagtactccacttccgacagcccgctcggcccatggaagtaccaaggcgtaatcgtgccttctggctcggccaccacgatgcacccctcggtgctccagttcggcgacaaatggtatgtgacctatcacaccggcgacaaggaaggcggcaccgatttccgccgtgccgtgtgcattgatgaagtcgattggaccgccgacggccagatggtttccaccgcccatccaaccaaggccgagaaaacgcagccctccaccaacgtggctccgtacgcaaaggtgagcgccacgttcactgaaacgcctgcttggaagggttcggtgaacgacggccgtgtgttgcaaaccgctgtggtcccgccgaatcactggaccaactaccgttctatcccgcaatcgcagtccggcgattctctggtctaccaatgggatggcactgtgcgcgtcaactcgtctaaggtttggttcgacgtggattccaacgctctgcgcgcgcccgcctcgtggaagattcagtacttggacgcggacggcacatggaaggatgtcaccaacccgagtgcctatacaacgaccacaggcaaggccaaccccaacgccgtcaccttcgatgcggtgaccactactgccttaaagctcgacatgaccggtcaagctgtggatggcggctatgcctccgtggccgttgctgaatgggaagtcggctccgactccagcgaatcgccggcaatcactgcgccgaagagcgtgaccaccgccaccggtactgcgcctactctgccggccacagtggatgtgaagtacgggaacccaaccgttgcctccccagtaatttggcgtccagttgatgcttcctcgtatgccaaggtcggttcgtttacggcctacggcgtggtcgccggcgtgcccggtgaggcaagcgagcagggcaatgtgtcggtaaatgtcaccgtgcaggacggctaccagcctgccgctgataccacgaagccgactgtaaccgttgccgttactgctaacgcaggcaatagcgagtggctcaccaccgctccgttcgccaccgtgcaggccacggacgacaccgcacctatcgccaagctggagatttccgctgatcaaggcaagagctggaccaccatcgccgcgaatgcaaacgcggccattgccacgctttcccagcagggcgatgtcgaagtgtgggctcgcgccaccgatcaggccggcaacgtttccgacgtggccaaggccggcggcaaggtggactccgccgcgccaaccgtgaccgccgccgccgataaggaggagcgcacgctgaccttgaccgctgatgacggcaccggttccggtgtcgcatcaattgaataccgcattggcacagacggtcaatgggccacgtacagcaagccgattgctgcaccgagcgcgtcgcgcgccaccgtgtactaccgcgccaccgataaggccggcaacgtgtccgcttcggcgaaaaccgacattccatccgacacttccgtgccgctgaccggctacattgagggcgatgccaccgccaccgatgtggacggcaaggcatccggctgggtcaagggtgccgccgcgttgaacgacggcaagatcattcccgatatcaccattgccaacgaggatgtctggggcacttggcccaacaccggtgagatgcgcctcgactacgagtgggaccgtgaagtgactatcgactctagccgcgtgcaattcacctcggatgatggcggattgggtattccggcatcgtgggaattgcagtactgggacgccttggcgaacaacggtgccggcaacttcgtggatatttccgacgccacctacactgtgaccgccaattcaccgtctgctggctgggccaccggcgatgccaaggggtggtctgatggcacgtggaacactccggtcaagactaccaagttgcgtatggttatcacgtccggctcggcttctccggctgttgccgaatggcaggttcatgccattgacgacagtacgcctgagccgcctgagcccacaccgatcgacaagaccgagctcaagcaggcgctcgctgactcgcctaaggctgacgatgcctccaagtacaccgagacttcatgggcggagtacgcggcggtattggattcggcgcagcaggtgtataaggctgaggatgccaccgaagctgcggtggtggatgccgcaacccagctgaagcaggcagcgaagaagctggtgcttgtagctacggtgcaagatcgtgccgcgctgagcgctcagctcgatgccgctgctgccgtggatcgcacaaagtggactgatgaatcgctggccgtgcttgattcggcagtcgctacggcgaatgcgctgacgagtgatggtcaggccgcccagtctgacgtacaggctgcgactgaggcaatcagcgatgccatcgcgggtctggttgagaagagcaccacgaagcctggccagggtggcgataagcccggttccggcacggacaagcccaaccaaggcaacgattccaaccagaacaagggtgatgcagactccggcaagcacaagaagatacctgacaccggtgcagccgtgcttggtgttggcatcctcgccgtggtacttgctgttgcgggtgtaatcatcctcaagcgccgcaagtccggtacctgctagtcccactcgctcggcctagcatcaccaagcccccgcgcatgaacagcgggggcttcacttttgttcaataacaagcattatgtgcgcgtatgagactacgatggtggggaatctacgaacaggggcagcaatgacggcatacatggaccataaggatctcgccaacgaagttatcgatcaggcgcgcgcacaagagattactgatggtgtgcatcgcgtgcttgaccggattgcctcagcggagtccgcagccgggcgtgctgccggttcggtccaattgctggctgccaccaagacgcgcgatgtcggcgagattctggcggctatcgatgctggtattcgcgtgattggtgagaatcgtccacaggagattactgtcaaggctgacggtctggcaaaacgactgggggagcgtggttattcgctaggcgtgattgatgccgctgaggctgacacggccaatgccgcagctgcaacgcatattcctttccatctcatcggccaattgcaagccaataaaatcggcaaggtgctgccggtagtggacaccatcgaatccgtggattccatcgaactggcggaaaagatcgcccgccgtgccaccatgcgcggcatcacggtcggcgtgttgctggaggtgaacgaatccggcgaggaatcgaagtccggctgcgcacccagccacgccatcgacttggcccagcgcatcggtgcgatgggcggactgcgcttgcagggattgatgactattggcgctcatgtggatgatgagcgcacgattcgtgcgggcttcgcgcatctgcgccgcactcgtgaccagattcttgcctccggtgccgaaggcacggccgactgcaccgaactgtccatgggcatgacccacgacatgacctacgccattgaagagggctccaccatcgtgcgcgtcggcaccgccatcttcggcgaacgcgccttcatctgattggagctatacgaaaaaaacgccacttgatagccaagcggcgtttttttcgtaaggattttcggcgtatcaatcacgcatagatattgcgcggacgcatgtcctcgggcaggccgtcgagcagaatcgccacagaaccttcctcgaacacggagcgaatacccgcggccagcagcggtgcgcaagacagtacggtcatattcggcaggcgcttctcttcgggaatcggcacggtgtccataaacacgatttcatgcgcgccgcagtgagacaggcgctccacggccgggccggagagcaggccatgggtggcgaccagcgtcaccgacttggcgccggattcgttcagggtgcgcacggcttcgcagatagtaccggcggtatcgaccatgtcgtcgatgaccacgcagtcgcggccgtcgacatcgccgataatgccatgtgcctcggcatggttcggacgagtaatatcacgctgtttgtggatgaatgccagcggcagattgcctagcttggcggcccactgttcggacactttgatacggccggcatccggggacacgatggtggtgttgcccagatcaagggtggaacgcacgtaatcgagcagcaccggcatggcggttagatgatcgaccggaccatcgaagaaaccctgctcctgagcggcgtgcagatcgaccgtcataatgcggtctgcaccggcggcgtggaacagatcgaaaatcagacgggcggtgatgggctcacgaccgcggtgcttcttatcctggcgcgagtagccgaggaagggcgccaccacggtaatcgacttggcggaggcgcgcttcaaagcatcgatcatgatgagctgttccatgatccacttgttgatatcgcccgaatgacactgcagcacgaacacgtccgcaccgcgcaccggttcggtgaaacgcacgtacatctcgccattggcaaagtcataggacgtggtttcgaggatttcggttcccaagcattcggccaccttctcagctagctcggggtaggcgcggcccgtgaccaatacgagtcgtttatccggagtgccttcaagaatcgccgacatgcgttcgcatcctttgtttgagtcgctgtgtgatttacgccttaaccagtgtacaagcaccccgccgcagcgaacgccacggcggggtgcttatttcgtaagagtgttgagattgccgaaatcactcggagaactcgacactgaccttattgtctttgatggtgaagttgccgttgacctccttgccttcaagcgtgtacgttagctgggcgctcacggtgccatcggcattattggagttctgcgagatgcgcgcgttggtgatgcgcgtgttctcgcccgaggatgccttgctggtcagcagtgcgcgctggttcgtatccacgtgaggatcggcgatggtgttggccttgtcgtagttgccggaggagatggcggccacatagctgttcgcaacgctcttcgcgctgaacacggcggaagacagcacgccatacacgataccgaacagcacgaggaagccggccacggcaccaacgatgatgaagattttcttctgctgctcattcatggtggtggaggtcgcgccaggtgcggctaccggtgccgctccgggagtgatgggagccgcgggctgcgtgggcttgtccaaaacggtggacatcgcgaaaccggcaagaatatgggcataccctgtcccgcctcatatatagactgtccaagttgcccgaagaggcggtgccggtttggtgctgcgtcatgggctaacacgcatacacactcctgccacggaacgtccgtggccgaatagtccgaaggaggtgggtgatgtctgcgcacaagtacgaactgatgttcatcgccgatcctgagctggatgagcgcggtctgaagaagctgaccgagcagtatctggaactcgtcaccaaggaaggcggctctttcgatgagcccgattactggggccgtcgcaagctcgcctatgagattgccggtaagaccgaaggcaactacgtcgtggtgaagtacaccgccgagcccgctaccagcgatgagcttgaccgtgttctgaacctcaacgaatccgtgatccgcacgaagattcttcgtaagggctgaatcaagcgtttagtcagctgaacagctggtattcaaggtaagtaagaaggaccgttatggcaggcgaaaccgtcatcaccatcgtgggcaacctcactgcggaccccgagctgcgcactattggcagcggtgcgaccgtggcgagcttcacgattgcttccaccccgcgaacctggaatcgtcagaccaaccagttcgaggatggtcaggcgctgttcatgaggtgctccgcttggcgtgatctggccgaccactgcgcccagtccctgaagaagggcatgcgcgtgattgccaccggtcgcctccagcagcgttcctatcaggcacaggatggttcccagcgaaccgtcgtggagatgcagctcgatgaaatcgggccctccctgcgctacgccaccgcacaggtgactcgccagtcgtccggtcagggcggcttccagggtcgttccggtggtttccagagtggtcagcagcccaatcagggctatggcaaccagggtggccaaggtggttatgccggtggccagggcggttacaacggtggctatcagggtggtggcgctggatactcccagcagtctgccgctcccgccaacccgtccgctcctgcggtcgacccgtggagtaatgccggtgcatctgatgccggtagcttctccacgttcggcgcttcctccgatttcggcggcgacgattccgacccggagttctgatcagtacttgcctccccgctgccagcagcaatcaatatcaagatttataaggagaacatcatgtcacgtaagaggccgcaaccgccggtcaagccgttcaagaagaagccgaacccgctgaaggccgccaaggtcaccgagatcgattacaaggacgttgcgctgctgcgtaagttcatttccgatcgcggcaagatccgttcccgtcgtatcaccggcgtgaccgtgcaggagcagcgtgagctgtccaaggcgatcaagaacgcccgcgagatggccctgctgccgtacgccacctcgggtcgctgagttagggaggctttgaacaatggctgaaaccaaggttattctcaccaagaccgtgtccaacctgggccattccggtgacgttgtcgacgtgaagtccggctacgcccgcaactacctgttcccgcagggcctcgctttcgcgtggaccaagggcgctgaggctcagatcgtcgctatgaagcgcgctcgtctggccaaggccgtcgctacccgcgaggacgctgtcgccgctaaggccgccatcgagggcactaccgtcgagatcgccgccaaggtgtccgagtccggcaagctgttcggtggtatctccaacgaggccatcgccgtcgctctgtccgacaaggccgcggtgaacccgaaggccatcgaggtcgagaccatcaagaccaccggcgatttccccgccaaggtggccctccacccggagatcaccgcttccttcttcgtgaaggtcgtggccgagtgagtcattccggcctagtgctggaatcacacagaccaagagtctgagcttaagcatcatcccccgtgcggttcgcgccgcatgggggatttttgtattagcaaaaacgccggaaataggcgcgacacgccgagagttgcattcgcttcaaatctgagtatatttatcacctgttgcaaggaatacttcaacatctaaccaagcccctgtagctcagttggttagagcagctgactcttaatcagcgtgtccagggttcgaatccctgcgggggcacagacaaccggaatcgaaagattccggttttttgtttttttcagcatcagtccgtagctggtgcggaaaggccgtcttcgcgcgtgacggccggacgtgtaaggagcaacgtcatgcctcagatattcacgttcaccgtatccgaccccgaaggcatgcacgcccgcccggctggccggttggttgccaaagcgcaggaatatgaatcgagcatcaccgttgcctacggtggaagatccgtggatgccaagcgtatcttcggtgttatgggacttgatgttcaacaaggtgacgaggttacggttcgggtgcagggcaacgatgaagctgtcgctgctgcagagttcgagcgattcctcaaggagcacctgtaatgagaacgatacagggcgtcggcgtatccgctggcattgctatcggcacggtccgcgtgctcgccgccgtagattatgccgtagaacgccgcttaatcgacgacccgcaggccgagatggatcgattccgcgcggcccgtgacacggccgtcgctcagctcaagcaactgcgtgacaacgtcgccgctgagttcggcgaaaacaaggccgaactgttcgacgcccatcggcttatgctccaggacccggactatgcggaatgcgtcgaaggtttgattgcgcaagacaaggtgaacgccgaattcgcggtgaagagcgccgccgaacagttcgccgccatgttcgctgcgatggatagctcgaccatgcaggctcgagccgctgatgtcaaggatgtttctcgccgcgtgatgaacgtgctgcaaggcaaatgcgatagcacggcgcaggatggcagtgtacaaggcgatgctgtgcagaacggtattgtgcagaacgggatcgcgcagaacggcgaaagccacatcatcttcgccgaagatcttgctcccagcgataccgcgcagctcgaccgcgctaaggttttgggcctcgtgaccgccaagggctcagcgaactcgcacaccgcgattctggcgcgcacgatgggcctgcccgccatcacaggtatcggcgacgcctttgacccggccgatgatggtcacgttgccgtaatcgacggcgccagcggtgcggtattcgtcgacccggacgaggccacgttgaccgaataccggcgcaggaaggccgaggctgaggagcacctaagcctcctgcggaagctcaagggcaagcccaccgaaaccaagtccggtcagcgggtccacctgtacgccaacatcagccgtccctctgacgcagccgccgtgctggccaacgatgctgagggcatcggcttgttccgcagtgagttcctgtatctggaacgcgaggactggccgaccgaggaatttcagttcgatgcatacggacaagtcgcacaggagatgggcgaccgtccggtcatcatccgtacgctcgacatcggcgcggacaaacaggtcgactactttaatctgggccacgaggataatcccgcgcttggttaccgggcaatccgcatctgcctgacccgcccggagattttcaaagtccagttacgcgcattattgcgcgcctcagcatacggcaacatcgccattatgctgcccatgatcacctctgtgcaggaggtacgcgacgccaagcggattcttgaagaagccaaaagcgagctgcgcggcgagcgcatcgacttcaacgagagtatccagatcggcgttatgattgagacgcctgcgtcggtcattatggccgacgagctggccgccgaagtcgatttcttctccatcggcaccaacgacctgacccagtacacgctggcctgtgaccgtcagaacccgagtctcgaacgctttgccgacccgcattcaccagctgtgctgcgcatgatccagatgactatcgaggctgcccatcgtcatggcatctggtgcggcatctgcggcgagcttggcgcagacttgagcctgaccgatacgttcctgcgcctaggaatcgacgaactgtccgtctcgcccaccagcgtcctgcccctgcgcaacgtcattcgcaaccactgagattcaaggtcgcttcggctgattccgatggctttttgggcattgcattcggctggacattcgacatcgcatcttgccggcatttcgtcgtggggcaaagtgtacaatcaccacgtttgctttcgcgcccagcgtaaatcgcgtcgccggctccgcgaacggatttccagtcacacagaatgccgtgaacagtcagccatgcctgttgcgcggcgaagagaaaagaagaagcagtggattatcctctctttaccaagctggccgccgagttcttcggcaccgccattctgatgatcttcggcaacggctccgtggccaacgttgagctcaagaacaccaagggccaccacgccggctggctgaacatcgccatgggctacggcttcggcgtcatgttcccggtgctcatgttcggtagcgtctccggcgcgcacatcaacccggccatgaccatcgcccaggccgtcaacggcctgttcccgtggagcgacgtgctgccgtacatcgtcgcccagctgctcggcgccctgctcggccagctcatcgtctacatcacttactacccgcactacaaggagaccgaggacgccgaggcgattctgggcaccttctgcaccactgacgcggacaaccagaaggccaactacttcctcaacgagatgttcggcaccctggtgctcgtcttcggcgccctgtgctgcctgtccctggcttggggcaagcaggattacgccgccgcctccatcgtcgtcggcttcattgtgtggggcctcgtgacctccatgggtggcccgaccggccctggcctgaacccggcccgcgacctcatgccgcgtctgctgcacgccatcctgccgatcccgcacaagggctcctcccgctggggcgaggcctggattccggttgtggccccgattgtcggcgccattatcggcgcttggctgttcgtgttcttcttcgccagctgattcgttgattgattcatatatgcaaatggcctccgctcgttttgggcggaggccattgtcgttgaatcaggtaaacgcagagactactgctccaggaacacctgcggggccttcatgaagttcgtggcacagtgttcgccgcagaagtaataggacttgccctcatactcgcgcgtgatcgcgtcggcattcaccgccacggtcatgccgcacaccgggtcggtggcggtttcgccgtccgcgggggcggtgtggtgcatgtgcattcccatatccatagtgttctccttgttggttggattattggattggtcagatacgtgattggtttgattcagcgtggtgcgatcgtcgatgatgacggtcggctcgtgaggcgcgttggatgtggcggagccggtgatgtcggcggcgttggcggatacggccgatgcggctgattcgacatccgccgtgctgctgcccgagccagcggtgctatcggcagcacccacgttgatgttcgctccatgcagccggttcgcgttcagcaccaggcacactgagctcaacgccatcgccagacccgcgatcatcgggctcaacagccagccggtgaacgggtagagtacgccggcggccaccggaatgccgatgacgttgtagccgaacgcccaccccagattctcgcggatgttgcgcatcgtggcattggacaggttgatggtcttgatgacgccgcgcaagtcgccgctcatcaaggtcacgtccgccgactgcatcgccacgtccgtgccggtgccgatggcgatgccgagatccgcctgggccagcgcgggggcgtcgttgatgccgtcgcccaccatcgcaatcagagtgcgggattgcgcggccgtgcgggaggtgccgtacgcggacttggcggcggcctcgtcgcgttcgcgctgcagtttggcgatccagtaggccttgccgtccggcttgacctcgcagatcaccgtatcgatgccgacttcgcgggcgatgcgcccggctacctcggccttgtcgcccgacagcatcaccgtgcggatgccgcgtgcgcgcaacgccgcgatggcctcgcgcgagccttccttgactgtgtcctgctcgtagctcggcttgtcccagtcggcggccgcgtccaccacgccgcgcgtgatggtgccggtcttgtcgaacaccacggtgccgatgcggcgtgcttgctccaaagccttggcactggtgaccagcacgccgttggtggcgcccagacccagcgagaccgtcaccgacagcggcgtggccagtcccagcgcgcacgggcaggcgacgatcagcacgctgaccgcggtgaccagcgcgtgcgccagttgcggcgccggtcccagtgacacccagatggcgaacgtccagatggcgatgatcatcaccgccggcacgaaataccgggcgatcttatcggccagctgctgcaccggcgctttggtcgcctgggcgcgggccaccatcgccgcgatctgcgagagtaccgtgtccgcgccgacttgggtggcgcgcatcacgcagtcgcccttgagcagcacggtggccccggtcaccgggtcgcctgcggttttggagaccggcttggattcgccggtgatcatcgattcgtcgatacgcgcctcgccggccacgatgatgccgtccgtgggcacacgctcgccgttcttgacgatcagcaggtcgccggtgacgatggcgtcgatgtcggtgtccgtgaaatgcgccggattacgccattcgatgccgtccacattgtctgcggaagtggcgttgagcttgtgcgcggtgcgcgggcgcagtttgataagcgactgcaccgccttgccggtgccttcgcgggccttggtctccagcaggcggccgaccagcaccagggtgatgaccacgccgaccgattcgaaatacggctcgcgcgagccctccgggaacacccacggggcgatgcaggtcaccagcgaatacaggtaggcggccgaagtgcccagcgagaccagcgagttcatgtcgggggagcggtgcgccagcgcggggaagccgaccgtgtggatcggacgcccgcagtagaacatcaccggcgtgatgagaatggcctgcagccacgggttcaccatccaatgcggcaccagcgcgggattggccatatgcagcatggtgacggcgaataccggcaacgtcagtaccgcgcccacaatcaccagcttcgtcagcgccttgatctcattggcgcgttcagtcgcctctcgccgctcggcctccgccgcatccacaaccggagctccaacccgcaagtctgagggagagaccccctcggcttcggccgagccgtcagcacgcgggcgcagcccgtccttatccgcaccgtccttactctcctttccctcaaccctcaacaacccatgcaccatattcatgccgcatgcaaacggatattcgcccgccggcaacgccggtagttccacgtcggtggtggcgttgcccggcagcatggcgtcaagccccagatccgcgaacgccacatgcgaagtgcattcgccggtctcctgtcgatcgaaagtcagcgtaatcggcgtacccgtgcgcatgctgatcacggcgggggagtacccgcccttgacggtgattgttgcggattggcgttcgccagaggcgtccatggccccggccgtggctttctgcattccgaagaagaaccgcagtaccagccatgtcaatgcggccgccgctatcagcgccgtggcggccgagaagatgctgagctccataaccgttccttccccttgtttgttgtactgaacaacagtgtataccctatacccctagagggtatataatggggtgtgttcagctgacggataagtatcagggggtttgcgatgcatggttatgacgaagacaaggccaaggtcatcgcacgattgcgccgtatcgaaggacaggtgcgtgccatcacgcagatggtggaggatgacaaatactgcatcgatatcctgacgcagatttcggcgtcgaattcggcgctgaaatccgtggcgttattgctgctggacgatcatctcaaccattgcgtgcggcaggcgtcgattcagggcggcgaggtggccgatgaaaaacttgcggaggcttccgcggccattgcgcgtctcgtcaaatcgtgacgagttttaccgtcattcaccatcgatgacatactgggtaccatgtttgagcaaataggaaccgtgattatcgtcatcgtcgtgctagtggttggtgcagggcttggcctcttcgccggcttcgtgctaggccgtcataagggtcaggagatggctcgaggcgtcaaaagcgaggagctggaggaggccaagacctcgctggagaatgcgcgattcgagaacgctgagctcagtgctcgcaatgctgccgcgcaagctcagattgaaggcgtgaaccagcaattggctttcgccaagtcacaacttgcccaggcgcagcaggctgagcagattcgcattcagcaggaacgtgagcgtgcagctgcggaggcagaacggaagcgtcaggcggatgctcaggccgccgaggtcaagcgtgctgaacaggaagcacgtttgaaagaacagagcaaggtgctcgaggcgcttgcgccagtggccaagaatcttgataccttgcagaacaaggtcacgcagatcgaagagggccgcaagagggaaatgggcgcattgggagcccaactcaaggggctcaacgatcagcaggcccgtttggacaaggaaaccagttccctgtccgccgcgttgcgcaacaacaaggtgcgtggcgcgtggggcgaggcccagctcaagaacattgtcgagtccgccggattgctggaacatgtcgatttcgacacccaggtggtggtcacggatgccgatgggcgtacgttgcgcccggatatgatcgtgcatctgccgggaggcaagaccattccgattgatgccaaagtgccttatgccgattaccagcgtgcctgcgaaatcccggacaccgccagccccgaggatattgcccgccgcgatgatttgctgcggtcccatgccaaggcgttgcgcgagcatgtacgtgctctcggcgaaaaggcctattggaatgcctttgatgtagcacctgattttgtggtggccttcatccccaatgaggcactactgcaggccgcactcgaagccgatcccacactgatggatgatgcgttctctcgcaaagtggcgctcacctcgccggtcacgctgtgggccgtgctgaaatccgtggcctatgcctggcagcagcagtcgctcaccgatgacgccaagcagctgttcgatctgtcccgagaactgtacgaacggttctccacgctgggtgattatgccatcaaattgggcacccagattactaagacggtcagtgcctacaacaagttcgcgtccagtttggaacgccgtgtgttgcccaccgctcgcaagctgcaaaaaatcgaaccgaccaagatcatcgaggaagtaccgatcatcgaatcagataaaggcaatgtgagcgaactgtccgcccctgaagtggtgccggccgatgaaggtgatactcatctgactgcctcaggcgatagtctggagtcatgactgaatctggattccgccccactggtaccccggaccttgccgtcgcgaagagccataatgactttgccatgctggagccgcgtgaacagctagccaccttgctgaaggagcatgtggtgggccgtccgttctccgaacttgccgcggtgactttcgaccaccgtgccgccactgtcatgggccatgtactgattgacgctttggaagatgcgggctattcgattgatgacttcgatgctgttggtgccttgaccgcagcatctgtacccatggtgtctgccatgatccaggccgccgcctctcgtggcgaggacctagatggattcgtgatggacttcgtctacccgtccatcaagggcccctccatcgaaggccgccgtgtggtgctgttggatgcttggctgtccgaaaagtcgtacgtgcagacaagctcgctggtcaccctgcgcaacggcaatgagctgagcctcgactttggcatagtggagcagctgggtgccaaggtcgtggccatcgcctcgctggtcggtggcggtgccaaagacatcaatgtggtcaacccctccaccggcgacgagcaaacgctccccttcatccaggtcttcgacgaatccgaactgcggtaaatccacctttgacgtccctcacataaagtcagccgggctgagcagcgaagctgactaagaggaaccggtgaatagcgttatcgaggagaaagattgcacgcacccaaccagatttctttggctgccaaagcttcaggtgaaccggaattccgtgaaatcggccttgggccgtggtctgagacccatcccggtgagcctcgtcccgatgatccgacttcttcgaattatgacggtcgtttcgactcggtgctgttgaacgacggagaccgccgcaacgtattggaccgttaccgctactggaccgttgctgccattaaggccgatcttgacgctcgagggcgtcacgacttcgaagttgcggtggaaaactggacccacgattttaacatcggttccatggtccgcaccgctaatgccttccaggccaagcgcgtacacattgtcggtccacataagtggaatcgcaagggcgcgttgatgaccgaactgtaccagcacgtcgaacaccacccctccatcgccgaactggtggaaagctggcatcatcgcatcgccggtgaaatcgcctatgaacgagccaaggccggtgccgccgccatccatgcgcatgatgtggctgtggatggagacaacaagcaccttcatgagctgctggccgaaatcgatgcttgtgatgcacgcatcaaggagcttcaagccgcccgcgtcatcgccctcgacattattcccggcgcagtgccgatggaagcctatgccttccccaagcggtgcctgctgctcttcggtgcagaaggccccggattgagcgagaaggccctcgcattggccgacgatgtggtctacatctctcaattcggttccgtgcgctccattaatgcaggcgctgcggcggccgtggccatgcacgcatggattgcccaacacgccgtatcaggcgtgtagccatgcgccgacaatcctgccgcatggatcggcggtctcatcgtcaccagaaaagcggatatcaaataatgacccgagtgcctgccctgctgaaatggtctcaaagggtaggaaaatgcggtttcccgacaactgcgtgtcacatacggctcatatagttatggccatgccaacattttcacgcgaagaaatcgtgcatttgggcgatctggcccgaatcgcgctcaccgatgaggaaatcacccgtctgcagggcgaactgaacgtcatcgcagactccatcaacaaggtccaggaagtcgcctccgacgatgtgccgccgaccgccaacccggttccgctggaagcctacctgcgcccggacgtcgccgaaaccccgctcacgcaggaagaggcgctcgccggtggcccgaagaccgaggccggcatgttcgtggcaccgcgaatcctgggaagcgaggagtaatcgatgagcaacgaaaccgcaactctcgtcaaactgtctgctgccgagcaggccgctgccgtcaagaagggcgacgtcacctctcgcgagctcgtcgaagcccacctcaaggtgatcgaggctgccgagccgtccatcaaggccttcctgaaggtttccggcgatgtggctctcgagcaggccgacgccttcgacgccaagtccgccgaagacaaggccgccctgcctgagctggctggtgtgccgatcgccatcaaggacatgatcgtcaccaagggcatcgaaaccaccgccgcctccaagatcctcgaaggctgggtgccgccgtacgacgccaccgtcatcgaaaagctcaaggccgccggcatgccgattctcggcaagaccaacctcgacgaattcgcccagggctcctccaccgagcactccgcctaccagaccacccacaacccgtgggataccgagcgcgtgcccggcggttccggtggtggctccgcctccgcagtcgccgcattcgaggcaccgatcgccctcggcaccgacactggtggctcgattcgccagcccggcgccctgaccggcaccgtgggcgtcaaacccacctacggcggcgtctcccgtttcggagccatcgccatggcctcctcgctcgaccagatcggcccggtctcccgcaccgtgctcgactccgcactgctgcaggagatcatcggtggccacgacaagcgtgactccacctccatccccgaaggcccgcgcccgatggtcgccgccgcccgcgaaggcgccaagcgcgatctgaagggtatgaaggtcggcctcatcaaggaactcggcggcgacggcttccagcccggcgtcgaggcccgcttcaacgaggccgtcgacaagctcaaggagatgggtgccgaggtcgttgaggtctcggtcccgcacatcggctactcgctaggcgcttactacatcatcatgccgtccgaggtcagctccaacctggcccgttacgatggcatgcgctacggcctgcgcgtgatgccgccgaccggcgtgccgcagaccgccgccaacatgatggcctacacccgtgaagccggcttcggcgacgaggtcaagcgccgtatcatcctcggcacctacgccctgtccgccggctactacgacgcctggtacggctcggcccagaaggtccgcacgctgattatcgaagacttcaagaaggccttcgaacaggtcgacgtgctcgtggcccccaccagcccgtccaccgccttcaagttcggcgagaagatggacgacccgctggccatgtacatgaacgacatcgccaccattccggccaacctcgccggcgtgcctgccatgtccatcccggccggcctgtccgacgacggcctgcccgtcggcttccagttcatcgccccgcagcagcgcgacgaagtcatgtacaagccggccgcggccctcgaagccgcgctggaagacagctggaacggcccgatctggaacgacctcaagaccccgtggcttgacggtctgggcaagtgagcatcggaaggaaagaaacaacatcatggctgaaaaactgatgaagtacgccgatgccaccaagaagtacgatgtggtcttcggtctggaaacccacgtggagctgtccacgaacaccaagctgttctgcccggcccacatcgagttcggtggcgagccgaacaccgagctgaccccggtgagccttggcctgccgggctctctgccggtgatcaacaagaccgccgtcgattacgccatcaagctgggtctggccctgcactgcgaaatcgccgagtggagccagttcgcccgtaagaactacttctacccggacatgccgcgcgactaccagatctcgcagtacgacaagcccaccaacggcaacggctacctggacgtcgagctggaagacggcaccgtgttccgcgtgccgatcgagcgcgcgcacatcgaggacgacgccggcaagaacacccacgtgggtggcgccgacggccgtatcgaaggtgccgaccactcgctggtcgactacaaccgtgccggtgtgccgctgattgagatcgtcaccaagccgatcgagggggcgggcgaccgcgctcccgaaatcgccggtgcctatgtgcgcgccatccgcgacatcgtgcgcgcgttgaacatctcccacgctcgtatggagcagggcaacatgcgcgctgacgtgaacgtctcgttgcgcccgagcccggacgctccgtacggcacccgttccgagaccaagaatgtgaactcgttccgcggcatcgagaagaccatccagtacgagattcgccgtcaggccgctcgtctggacgacggcaaggagattctgcaggagacccgccactgggatgaggctacgcagaccaccgctggcggccgtctgaagtccgatgccgacgactaccgctacttcccggaccccgacctcgtcatgctccacatcaccaaggagcacatcgaggagatgaaggcccagatgccggaaatgccgcgcgagcgccgcaaccgcctcaagtccgagtggggcctgagtgatctgcagatgcgcgacatcctcaacgccgacgccctcgacctgattgaggaaaccgtcaaggccggtgccaaggctgccggtgcccgcaagtggtggctgggcgagctttcccgcgaagccaacgccaagggtatgtccctcgaagagctgccgatcaccccggccgatgtggccgaggtcgagaagctcatcgcctccggcaagctcaacgacaagctcgccaagcagaccgtcgaaggcgtgcttaagggcgaaggcactccggatgaagtcgtcaagaagcacgactacaagatcgtcgaagacaacggtgccatcgaggcggccgtcgacgcggcgttcgaagccaacccggacgttgtcgagaagctcaagagcggcaacatgaagccgatgggtgtaatcatcggtgccgtgatgaaggccacgcgcggtcaggccgacgccaaggccgtcaccaaggtcgtcatgggcaagatcaagggctgattagattcactggctcccgctggtgggagctgtcgaacggagtgagactgagggtggtcgccatgtacggatgaccaccctcagtccgcttcgcggacagctcccgccagcgggagcacttatttgtagggaaattctccagttcaaatccgttagacagctcccgccagcgggagcctttattgattctgtaagaaagtcgactcagagcatttccagcgttcacccagtcgagtaagatatgttcggcactggaccgtgagccgaaacaagccgaaccgggggacgtataccgatgaccgcaaccaacgagacgctgagcatggctaccgaagcgcaactgaagcgcgatctgccacagagcatcgtcattccgccaatccgtggcgaaatggtgcacctgcgccccgccaccgtcgaggacctgcctcgtttggatgaacttgatgccttctatggcgcatccaagatcacaggtaaggatgcggtcaccgaacgcgccatcgtacacacgtgggtccgccgctcccaggcttgggaagccggtcaggcacccgccgaatccggtgtgggtgatccggaatcccgccgcaccatcgcatgggccgtattgactgacgccgaccatgacgatgacggtcagctcgatgcggccagcaccgataatgtcatcggcatgattttccttatcgacatcgacggctggtccaagtccgcccgcatccagatcatcttgggccgtgaataccgtggccgcggctactcccgtgacgccatgccgcgtgtgatgacctacggtttcgcgcccgaaccggccggcttgggcatgcaccgcatctgggtgagcgtgccggaaaagaacagccgctcgatttcggtctaccagtcgctcggcttcgtgccgtccggcacctcgcgcgacgcgttgtgggatgccgaaaacaacaaataccaggaccttatcgtcatggacacgttggctgacgagtacgatccgattcgttcgcttgacgcttttggcatgcacttgattgaggacaacccgggtgtcaaggaagcgctgtccgcgcgcgagcattccatcgccatccagcagaacaagccggaacccgagccggcacagcgtggtgaggcagccggcgccacgacgagtgacgtgcagtcccaggcccagacgccggcggccgcacagccagtcgaaccacaggccgagcaccacgacgatacgcagaagaacgcgcgccacagtctcgaagaggaaagcaactggccgtacggtcaggcagaacgcaagccctcaaaggaagcatggtggcgtacgctgggccgcggccgcaaacgcgatacggaaagtgagtgagtaaacaagcatgagtgccgaggatctcgacaattacgaaaccgacgccgaactcgcgctgtatagggaataccgtgacgtcatcaagctgttcacctatgtggtggagactgagcgtcgcttctacttggcgaataaggtcgatttcaacgtgcgttccgctggtcaggacgtgtatttcgatgtgcagctgactgacgcatgggtatgggatgtctaccgttccagccgtttcgtcaagtccgtgcgcatcgtgaccttcaaggacgtgaacgtcgaagaagtccagaaaaccgatatcgacattcccgacgatattcactgacaggcaatcgtctgatacagcctgtattgacaatgcgcggcattccgtcatcttacggcggggcgtcgcgcattgttcatacaacgcatagcaaaagttcagactcgtaaccttgccatcgtgtgtcttgtttgcttgcggctgatagaaaatgctgcatgaacacacaccatatgcagcagggccttaagggctccatcgcgggcgtggttgctgccgccacattgctggccggtggcatcctgaccgttccgcacgccatggctttggagaccgatggccagtattacagcagcaagcagccatatgtggcacctagcgaagcgaccactgccagctatagccaggcgccggaaggctacgaaacggtatacaccgagtcgatggctcgccacggttcacgcggcctgtccagctacaaatacgacgcattgcttatgaagatggccgaagccgccgaagcggataacggttttaagtctgatgccatcaagtccgaattcatgaagaatctcaaagccatcaccgccgcaaatgtggagaatggctacggtatgctcaccggtcagggtgctgaccaacatcagggcattggcgcacgtgcctacgagcgcaacaagacgctgttcgacaacgcagccaaggacggtggcaagattgcctatcagtcctctggcgaagcccgcgctactgaatcaggcgagaattttgctcgcggtttcaacgcggcctcgaacaataaactggcgaacagcactgtgacgcccgccgatccggccggcaccggcgaggcggcggctttcgacaagacgccgaacacgctgtacttccacaagtccgaaaacccggacggcactgagaaaaccggtgaggccaagcagcgtgccgacgattaccagaacttcgtggaaaacgatgcgattatcgcaggcgctgagcaaaccatcgccgaaaacgaggacgtgaaaacagcctctcacgatttgctttcacaaatcttcaccgatgacttcctcgccaaactggccgacggcacgtacgcctggtacaacactgtcgatggcaccaagggcggcgaggccaactgcgcgccgggagccgaccccagcaaggatgccgacgcctgcggcgcagccaagaagaagatcgcctccgaatacgatgccgcgatggatctgtacaacctgtacatcatcgccgctgatatggagaacgagaacaccggcagccataccttcgacttcaaccagtacttccaaggtgagcaggcagacgacgccaagttgttcgcctgggcgcttgacgccgaggacttctacgagaagggcccgagctacgccggccaagacgagacctacacaatcgcacagccgctgcttgacgatttcttctcgtcgattgatgagcgcgtaaacggcggatccaccgttgctactttccgctttgcccatgccgaaacgatgatgccgttcgccgcgctgcttggccttcccggttccatccagcaggcggccgccagcaccaccgacgtgtacacctacgccaacaatgaatggcgcggtgaatcggtgactccgatggccgctaatgtgcagtgggatgttgccgtcaaatccggcaacgacccgaagaccggccgtgcctacacgccgctcgttcgtatgctctacaacgagcaggaaatcgccttccgctccgaatgcacgccgattgccgatggttccacgtggtacaagctcactgagcttaaaagttgcttggcctccgaccaccaaaccctaggcgacgatgcgcatctgactgatgattccacaacgcagccgggcacaggacctaacactggtgaaggaacgagtaccactccgaataacaatggtgcgggaactcatcagcccagcaacactcaggctaatggtacggaaaacgagttgagtcgtactggtgttgccgttactggtgttgcggggattatgatgctgcttgcacttgcaggcatctcgctgaatctatggaaagttcgtcgctgacgaattagcctaagaccaaaccgattcgccgcgctgtgtgtgacgcaacgttgccgaatacccctacctcacgattcgatgcgtcgcctttctgctgatggaaagacggcgcatcggtcgtatatcgggagaattctgtaagcattcgctcatctttcggtgtgcgattccggggcttctagtagactgtctctgattttgcgtttataaggagcataatgaccgacaagcaatccgtagtgattatcggcggcggtccggctggacttaccgccgcgtgggaactcatcaaggacggcggtgccgacaagtacgacgtgaccgtgctggaggggacccgcgaattcggcggtatctcgcgcaccgtgaagcacaacggcaaccgcatggatatcggcggccaccgtttcttctccaaagacgaacgcatcatggattggtggaagaccgttctgccgttgcagggcgcaccctcctatgatgacaagaagctcggccgcgaccacgacatggagccgggcggccccgatccggagacggaggacaaggtgatgctcaagcgccaccgagtgtcccgtatcttctggaaccgccacttcttcgattacccgatttcgctgagccccaacacgttgaaggccatgggcttcaagctcaccatggtggccggcttcagctacctgaagtccatgttccacaagctgccggaagacaatctggagaacttctacatcaaccgtttcggccgcaagctgtattcgatgttcttcgagggctacacggagaagctgtggggccgccacccctcccagatctccgccgactggggcgcccagcgcgtcaagggcctgtccatcatgggcgtgctcaagaacgccttccagaagctgctgcccaagaagcgctccaacgcggaggtcgagacctcgctgatcgaggagttctggtatccgaagtacggtcccggccagctgtgggagaccgtcgagtccaattgcgaggccgccggcgtcaaggtgctgaccgacgccagggtggtcgaggtccgccagaccgatggtgccgtgtcttccgtggtgtacgaggattccgagggcaaccgcaccgagctttccggcgaccagttcatctcctcgatgccggtcaaggacctggtcaacgccatcgacgcggccggcgccgatcccgaggccgttgattccaagcccgccccggccgatatgaccgaggtggccaacggcctgccgtaccgcgatttcgtgaccgtgggcctgctggtcaagcacctgaagctcaagaacaccaccagcatccccaccctcggcaatccgccgatcgtgccggactgctggatctacgtgcaggacccgggctacaaggtcggccgtctgcagatcttcaacaactggagcccgtacctggtcaaggacgtggacgacaccgtgtggatcggtctcgagtacttctgcgaggagggcgactcgttctggaacatgagcgaggaggatgtcaccaagttcgcgatttccgagctcacccgcatgcgtgtgatcaacggtccggacgaggtcatcgactcccatcgtgagcgcgtcaggaaggcgtaccccgcctacttcgacacctatgagcacatggacgagctcatcgagtacctcgacggcttcggcaacctgtactgcgtgggccgtaacggccagcaccgctacaacaacatggaccactccatggccaccgccatggaggccgtcggcaacatcaagaccggcaagacgtccaagaagaacgtgtggtccgtcaacaccgaaaagtcctaccacgaagaaaagtgaataaaccttgttgagctccctcgtcacagagggagcttttttggttttcggcgggccgttttgcgttggtcgagttggcgttgtacagtgaacgaagttcgcagagactcagagacgcagcgaacattcatgagcggtgcaaccgcaataatcactcttaacgcctggataggcatgggtctgttcggtatggaaagggcaaccagtggcaaatagccagaatcttgaggatatgaagctgcctgagctcaaagagctcgctaaacagatgggcctgcgcggcacgtcgaccatgcgcaagcccgagctgctcgccaccctgcaggcggcgcgcaatggtggagagccgccggccggtgtgaccgtgcgcgcccccaaggccgccaaaaccgccaaggtcgtcaaggctccgcagtccgatgccgctgaggccaacaccacagacaatgctgacgtggccacccagtcgccggctccggctccggctgccacggaaccgcagctcgatttgccgcttcccgtggccgacgatgccaagaaggacgagaccgaaccgcgacgcacccgtcgtaaggccgccgatgatgccgcatccgaaccgcgtgcggcccgccgtcgtcgcgatgacgaccagcccgatttcgctcgccgcaagccgcgcaagaaggccgatgaggccggcgatctgctggccacgctcgatttgggagatgcagcgcctaccgagcgtcgccgcgagcgtcacgaggacgtggaagttccgctgattcgccgagtccgtgatgatgaggacgagcagcctcgccgccgtcgtcgcactgcggaaaacagcgaagaaaccgtgcgtgacctcgacgatatcctggccacgctgcccacgcagaagcacgaggaaacgtccgaagacggcgagcagaacgacgatcacgagttcgtgcgtcgtaaccgccgcgaccgtagcgatcgcaacgatcgcgatacccgtaatgatcgcagcgatcgccgtaaccgtcgcatgcgtggccgtgatcgcgacaacgccgatgatgatcgtcgctatgatgatcgcgataatcgtagcgatcgcaatgaccgtgatagccgccgcgaagagccgcaggaggatctggtgccggtggccggcatcgtcgacgtgctcgactcctacgcttttgtgcgcacttccggctacctgcccggcccgaacgacgtgtacgtttccatgggccaggtcaagaagtacggcctgcgcaagggcgatgccgtgcatggttcgattcgcgccccgcgtgaaggcgaccgccgcaaccagcgccagaagttcgtgccgctgcaggccatcgattccatcaacggccaaagcgttgaagaagcgctcaaccgtccgcagttctccaagctcacgccgctgtacccgcaggagcgtttgaagcaggagaccgccccgaacaagctcaccggccgtatcatggacatcgtttccccaatcggcaagggccagcgtggcctgattgtctccccgccgaaggccggtaagaccatcaccctgcagaacatcgccaactccatcgccgccaacaaccccgaggtccaccttatggtggtgctcgtggacgagcgacccgaagaggtcaccgatatggagcgcacggtccagggcgaggtcatttcctccaccttcgaccgtccggcctccgatcacactacggttgccgaactggccgtcgaacgcgccaagcgtcttgtggagctcggccaggacgtggtcgtactgctcgattccatgacccgactggctcgcgcttacaacatcgcagcccctgcctccggccgcatcctgtccggtggtgtggacgcgcaggccctctacccgccgaagaagttcttcggtgcggcccgcaacatcgaaaacggcggctccctgaccatcatctcatctgcgctggtggaaaccggctccaagatggacgaggtgattttcgaggagttcaagggcaccggcaacatggaactgcgcctgtcccgcgagctggcggacaagcgactgttcccggccatcgacatcaacgcttccggcacccgccgcgaggagctcatcaccaacccgcaggaactgccgattatctaccgtctgcgtcgactgctgggcggcatggagcccgagcaggcctaccagacgctggtgccgcgcctcaagaagaccgccaccaaccgcgacttcctcgccgccatcgtgcagcaggccaacaccggcaacgcggtcaacggcaactgatcagaccgctgaacaatagtgtaagggctgcaccctgattgatacggggtgcagcccttgtcgtatctgatgcaaatacgtcaactatcacattgcagttgtagtattgccgtcaacgttcacatgcacgctgacgatatatgagatgaaagaggcatcactgggttcgattgttttgggagtgggcagtggtgcggccatgttcggcgatgcggatgccagccatatcctcaccggcgactatgacatctgagatatctgactttgcgcatcgtgcaaagccgtaatcgggagtatcctcgaatctatgagcgaaacgagcagcgactggcaaaggaccaccatcgactccgcccaggcggcggcccacccggaaaccgcacaagcggtggcgcgcatcaaagcgctgcgccaaaccatcgataacatcgattcggcggtcatcgcattactggccgagcggttcaaggccacctcgcaggtcggcgtgctcaaagccaacgccggattcgcgcccgaagacaccaagcgtgaggactatcagatcgaacgcctccaccgcatcgccatcgatgccgggcttgatccggaaattgccgaaatgtaccgtgaattcgtggttaccgaagccaagaagcgccaccagcgcatagccgatgccggtggtgacccgggcgtactcgacgtattcgcctgattcgcccgcagcgaatgggcacctttcggatattcgtctatagggcaagttgcctgcagcgactacattaatacgggaatggaatgcccgtagtggtcgactgtatgaatgggatacgtagatgagatgtggtgccgcactggtcagttgcgcattgtgcgtggcttcgattctcggcggtgcttggatgtctcgtccgactccggttgattacggtccggtgctcgctacggcaagtgatatgtacgccgtcaccgatgccgaaggggagccggtccgttggtatgtggtagggaagggcggcgccggcaatggcgccagtgccgattccggcaatagcggttccactgataccgattccgccaatagtaattccggcacgtccaaggtttctcgtatccccgcttccgccgccaccctgccatggaaagtcagcgtcacctactcgcttgacggtccgaacgtcgaggcaaacgaggttgccggcgcgtctggactgatcggcgtgtatatcgatattaagccgcaaaccaaggaagccaaccgtacgatcccggttgtcgcctttaccgtgcctacgcaggtagccgatgatgtttccgctgacaactccattacggtgaccacgcaaggttccaataccgtagtcgccgcagctggaaaagccgcaaccggcttggaattcagctgctatatgaacgccaaagacttctccatgagttccgtggcgctcgccgtattgccttccaattccagcagtccggcagttggtgctaatcccgatgccgcgaatgctgcgaatgctgccgcacagcctgctgccgatacggatgtcgcccaactcgtcgcctctgccgccatactggtcgattcactgaccgacgccggttccggggagcatcaacagctcatcgagcagcttcaaaccctgcgcgataatgagcgtgcgctggacaagtccgtagtggccgaacgcgaaaccgcccataagcggacgtttgaagactatatggccgcgtatgtgggctcatataccacgcacctgtctggatcgattggtacctccacccagttgccggcgttgatgggcacggccggcgaactgtccggggatacgcctttggcacaagccgtactcgacttggccaacgcggtgaacaacgtcagtgccgcacatcagcatgccggtgcggtcgatgcgttggatgaggtgattcgccgcatccagcagcaaggcaccaccggactggtggatgatctgaccgccgaggcttcggaggaagccactcgaggctccaagcaatacgccgatggccagagccagctctccgccgcaatgattccgtattcgatgaaatacacggacgtctacacggccaatttgagcgccctgaccggcggcacgtcttcgggcgccaccgcttacgagagccaagccatcgccgaaaccaacggtagcgatgaactcgccgacgctcaatccaaggtcgatgccgcgatgagcacgcttgccaccgcctccgagcatacgggcaaagccacggccttgcgccagattgtattgcgattctccgatcagttcgaaggagtcgcgtcctcggcttccggcagcgatggcgatggctcgtccggtgatgtctcttccggtccggtgaccgaggctcaggcactgactggcctggtcgattcgcaatcgcaatcgttctacggcaagacccgggccgtccaagccaagcgtaaggccgatgccgcccgtaagcaggccaaagccgcgcaacagcagcagtcgcagcattccaaggcctcactggtcgatgacaccatgtccatgtctgctggcgatgtgatgaactatgcgggtggtcttacttcggccatcggtggtggaggtaagttcgattcgtccaagagcgatggttcgggaacgaacgactcagccaagtcgagcgatactggcgattccggcaacaatcttgacaccgctccagtactgttcggctttggcactggcggcacgctgttcaagcacgatatgaacgcgctgattaatgagaccgtgaaaatcagtgatgctggcacgctcttggcgcaggccgtcgcgcagctcgacagccccaatacgcaacaaaaaaccgccgaaacccgatatctcatcgtgattccgacggtgtgatggtgtatgcgggatatttgcgtgccgtcccacagtcgtgtcatccgaacgtcaaaaaacaaaagaggggaacctcaataggttcccctcttttgttgttgtgcgtaacgttcagtgctttggcttcttagctggccgagccgttaagcgggaagcccggtgggcttcccgtaggctcggaacgagcggcattgccgtgagacctactgttgttgtgcgtaacgttcagtgctttggcttcttagctggcggctcaccgagctcgctggcttcgacggcgacctcggtttcgggcgtgccttcggcggcggattcctcggcgtgcttggccaccaagtcgaacttgccgaccacgcgaccggcctgcgcgatatcgcccaaggcggcgtgaatcgcttccacaccttccgaagcagcggacagtgccacagacaggattggggtcttcatggagaccttggcctcggacttgatcttacgcagctgctccacggccttgccggcccaagtcagcagctcgggggaagcaccggtggcggcctcgacatacgggtccacgaccggccaggcggcgcgatgcacggaaccggaaccggcgtgcatccagctccacacttcctcggtggcgtacggcaggtacggggccagcagacgtgcgaaggcgtccaggcccagacccagagcggtgcgggcggacttcacagccttctcggacggcacattgccgtgctcgtccggagtgccataggcgcggttcttgaccagctcgatgtagtcgtcgcagaactgccagaagtaggactcgatgacttccagcgccttggaatgctcgtaggattccagcgcctcggtggcctgacgcaccaccaaagccagcttggccatagcggcgcgatccagcggttcggtcacatcggccgggttccacgcggcctcggcggcagcgcccacgtgatggttctcgtcctcacggccgatggccagcgcgaacttggtggcgttcagcagcttgatggccagtcgacggccaatcttcatctggccgatgtcgtacgtggcatcgaggcctaggcgagcggcggcggcccagtaacgcacggcgtccgcgccgaacttctcgatcggctcgttcggcaccacgacgttgcccttggacttcgacatcttcttgtggtcggggtccagaatccagccggacagcgtggcatgggcccacggcaggcacttgttctccaagtgcgcgcggtccacagtcgagaacagccaggtgcggatgatgtcctgaccctgcgggcgcaggtccatcgggaaggtggaagcgaacagggccttggaggcctcgtccggctcggcccagtgggtcacgatctgcggggtcagcgaagaggtggcccaggtgtccatgatgtccttttcggcggtgaaaccaccgggcacatcacgctgggactcgtcgtagccctccggcacgtcgatggtcgggtcgatcggcagacgatcctcggacggagtgatcgggtgatcgtaatccggctcgccggaagcgttcaccgggtaccacagcgggaacgggacgccgaagaagcgctgacgggagatcagccagtcgccgttcaggccgtgcacccagttctcataacgcacgcgcatgaagtcggggtggaactcgagttccttgccgcgctcgataagctcggcgttcagcttggcgtcggtaccgccgttcttcaaataccactggcgggaggtgacgatctcgagcggcttgtcgcccttctcgtagaagttcgtcatacgcttggtcggggtcggctcgccgtccagatcgccggactcgcgcagcttgtcgacgatgatcttgcgggcggagaacgtggtcttgccagcggtttcggcaaagacctcgcggccggccgggtcctcgatccagtccggggtatccatcacgatacggccgttgcgctggatgatcgggcgggtgggcagcttcaggtcgcgccaccactcgacgtcggttacatcaccgaacgtacagcacatggcgataccggcacccttgtccatttcggcggccgggtgcgccagaatcggcaccttgaccttgaacagaggggagtagacgtactggccgaagtactgcttgtagcgttcgtcgttcgggttggcgatcagcgaggtgcaggccgccagcagttcggggcgggtggtctcgatgtagatcggggtgccgtcctcaaagcggaaggccaccttgtggtagaagccggggtattcgcgcgattcgagctcggcctgggccacggcggtctggaaggtcacatcccacaggccgggggcgtcctgctggtaggcctcgccacgggcgaggttgcgcaggaaggccttctgggccacacgctgcgggtgctgaccgatggtgtggtaggtctgcgaccagtcgatggacagacccagcttgcgccacagggcctcaaacagcttctcatcctgagcagtcagacgctcgcacagctcgatgaagttcttgcgggaaatcggcacctgatccttggcgtcaatcttcttgccatcagtgccttcaaacggcggcttgaagtccgggtcgtaaggcagagacacgtccacgcgcacgccatagtagttctgcacgcggcgctcggtaggcaggccgttgtcatcccaacccatcgggtagaacacgtcgtagccgcgcatgcgcttgtagcgcgcaatcacatcggtgtgcgtgtaagagaacacgtgacccacgtgcagcgaaccggagacggtgggcggcggggtgtcgatggagtagacggccttgcggtcgcgggtgttgcggaatttgtaggtgccgtcttcatcccagacggtgcgccacttgtcctcaagtccgtccacgccgaccttgtcgggcagcggggtgaggttggcgttgatgatggatttgccttcagtcataaggccaaagtttatgcacgttgcatgacaagccgaactgtacagtaaacagcccagtaggctgttcgcaggcgaggtacgaacgatcgaacgatagtgagccaaggactatcgggcgtagcccgtccgtgactgaaggttgcctacttcaccgtcaacccggccagcggcatgcggcgattgatcatcgaggtcgggtagccggagaccttggtggacgccacagtgaagcatttgcgggtatacagccaatcactggccgcatcctcgctgatcagccgggcgtacgccttcattcgtgcctcataatcggcgtcattagtggcggcgcgagcatccgcataggcctgttgcgcttcggtatggtcgtaatggaacatggaatcggggtcggcgaatatgccggcatcatccgtgccgtccatgctcatcacggtcagttcccatttgccgtccttgattcgtttggcataatcctcatcggagagcacttcaaggttcaccgtggggcgcggctgccgctcgatctgctgcttgatggtttcggccaacgaccggtattcttcgggaaccaccagattcaccgtagtcaggtattgcgcaccaaagtaggagaacatctgcccagcttggttttcgtcatgcgggtacagtccggtcaaatcttcgtatccgggttccagcaggctgatggggccgcccaatgctccggctgcgtcgggttgggcggaggcgatgccggctgcgtcgatttgatagcggaaggctttacgcgcctgttcgtcggagagcagcgaatcggtgccgttgttgtaggccagcagcaccttatccgtagtggccccctccttgacggtcaggccatccttgccgttcaaaccggtggccgtcgaagccgaaaccggtgccgccatatcgagactgccgtcggtcagggccttgctgagcgcatcggcgtcggagtattgcataaattcaacgacattgctggccgctttggtgccatggtaggtatcgctgcgcgccagcttcagggaatggccaggctggaaatcggccacggtgaatggtccggaacctatggccttgcgttgataatcggcactggacgactcggaatcgtagacaatgccgagtctgccggacagcgctcgcagcagcgtcggattgggcttggcaagcgtaatgaccaccgtggtggcgttcggattggcgaccgacgccagatcgcccaattcgtcgacgtccgccaccttgttggtcacgttctgttgcaacgaccacacggcgtccgaggcgtccaacgtatggccgttcgagaaggtgacgcccgattgcagtgtcagggtgacggtcagtccgtcatcggaagtcttccagcttgtcgccagtcccggctgaagcttgttgtcttgatcgacggtcactaatgtctcatacacattgtcgacgagcaggcgttcggctgccgcagaggaatcggaccgaatatccaaggattgcggcatatcgtcgatgccaatggtcacatcggcatcgagggatgatcccggctggaaccggttttgcatgaacgtccatcccacaaccacgagtgcgccgagtgccacggcgactccgagaaaaatcccccacttggaccatgtattgtcccgcttgctgtgctgcatggttttcagtctagcggtggattcagcctagaatccgcaattcaccatgatgaggtatgagttagcgcttggacgtgctcttgccggcgggcggcgcatagctagggcaggtgtcggacagcgggcagttggcgcagtcaggggtacgtgcgtggcaggtggcccggccgaacagaatcagtcggtggctgagattcgtccactcttcgggcggaaaacaggaggtgatttccttctcgattttcacgggatcggggtgtgcggaccgccaatccgaccgccaacgcagtcgtccggttacgcgcatcacatgcgtatcgaccgggaatccggggatatcgaacgcgttgccgagcacgacgttcgcggttttgcggccgacccccggcaagctggtcagttcatccatcgtgcgcggcaccacgccgccgaatcgttcgtccagtgccgtggccagtccgatgagatgctgggttttcgaacgatagaaccccagcggatgaatgatgtcttcgacttgggccgggtttgcggccgccaagtcacgggcggtggggtaggtggcgaacagttccggggtgaccgtgttgacacgcttgtcggtggtctgggcgctgagcacggtggcgatcagcaattcgagcggattcgagaaatgcagtgcgcaagcgggtgccggaatcacctggcgcagaatgtcgtattcgtcatgcatgcgcgtgagacgcgcggatttggtttctctcatcgtatggacctaagcggcgtaatatcgatgattgatagtttgcagcgccgctggtctgtcaggcgacggtgttgagatcgggagtatcgtcatcggtgtcgatggcggcagaggatgctttggcggcctgctgtgcggcggcagtttccttatccgtctccggcgggtcgaatcggtagcccacgttgcgcacggtgccgatgaggtgttcgtattcgccgccgagcttggcgcgcagacgacggatatgcacgtcgaccgtacgagtgccaccgtagtagtcgtagccccatacttcctgcagcaactgggcgcgcgtgaacacgcggccggggtgctggaccaagtacttgaggagttcgaactccttgtatgccagatcgatggggcgtccatgcagggaggcggtatagccgttggtgtccacaatgaggtcgccggagcgaatctggccatcttccaccgtggtggtggattcggcgggagaaccggctgctgcggctgcgggagcgttgccgcgctcggagaccaatcgcaatcggccctcgacttcggccggggaagcggtggcgaccaccacatccgcaatgccccactgggagttgaccacggtgaagccgccttcggtcagcaccagcacgattggcgtggacaggccggaagcgtggatgaggcggcacaaggttttggcggtcgccagatcatcgcgtgcatccagaaacagaatggtgttctccggcatcttcaccaagctggctgcatccatcggcagtacgcggacgcgatgagaaagcagggcgagtgatggcaaaacggtggcggggtcgctggcgaaagtcatcaacgtaagatccgtcacgctaatcccccttatcctgcaatgtgttacgcaattgctcggtgtggctgtacgagtcgtcagcggcgttatgccgctttcgcacggttttcattattctacgcgcttgtagtggacacataggttacaagtttgcggaatatggaacggtggacgtccatcaaccgatgatacggccgagcaccagtgcggttgcggcgatggtcacgcccatcagcattaccggcatcaggccggtaccgatccacggatagcggatatccgggtccggatcggcgtcacgcacccacaacgtggaagccacggccaaagccagtcccaaaacgatgaggatgatcagggcaacggttcccgcaacggtgcccttggcgagcatcgcgcccaaatcaggtaggaagcaccagccggccacggcgagagctgccacaccggaagtcacggcgtgagagagtgcgcggataagatgttcgcgcttctcacgagccatctggcgtccgaaggagaagaccaccagcaccaccagcagcaggcccatggccagtgcccatgaataccaaggaagtaccgagccatccgcagcggtctgatccggcggaacctcgctggtcgggaaaggtacgatgacgaaaatcagagaaatcgcgccaaacaccaaagtgacgatacgatccagtatgctgccgcggaacggccagaatacgacaaatgcggccaacgtcagagcggcgataatcaaagggatgatggggacggtgccaggggagggaatgaccgtggctgcgatgaacagtacataggacgtcagttgggccaacaacatgctcagagctttgttcttccaaccctcctgggtgatctcggtcatgatacgcctctcagataatcgaatttctatcccaatcctacgtcgggcattggaacggtgaaatcaaacaaaatagccccttctggtgaaggggcttatggcactaaatcagaacgcgataacgcccaaatgctccaatagcactttgatgccgagtagaatcagcaccacgccgccggcgatctgcgccggcttctgccagcgggaaccgaacgcgcggccaatgtgcaggcccgcagcggagaacagtccggtgaccacaccgatgctgaggatggcgaatgccatatgggctttggtgaacatgaaggccaggctcacgcccacggcgaacgcatcgatgctgcaggccacggccaggggaagcatatgcttccaatcgaactgggcggtctccttggagttttcctcatcttcttcgaaggcttcgtgaaccatgttgccgccgatgaacaccaacagggcgaagatgatccaatggtcgaattgggttacgtatttgctgaatgtagatgccgcgaaatagccgagaatagggaacagcatctggaatccgccgaaccagagggtgcttttcacggcgtcttgtactcgtacgcgggatacggtcaggcctttgccaatggatacggcgaatgcatccatagctacggaaacagaaataagcaggatttgaatgattatcgaaatcatggtgtgacagaaggttcatcgccggattaccgtgcgatgggcctcgaccagcgttcctacacgccgcctacgcctagttgaaaagacaaaacattactgtatcacaaaatacaagctccctctgttggggagctggcgcagtgaaactgcgactgagggagagtagagcggctttgccacaaatacaacaaaaggcccccgaaggggcctcctgtcaacgattcagaatcgaatcacttctcggaatcggcgagacgctgacgcgcggcaatgatttccttttcggcggcgtcagcaccagtccagtagtcgcccggcaggacttccttgcccggctccagagccttgtactgctcgaagaagtgcttgatttcggccttgtggtactcgttgacgtcgtcgatgtccttgatgtcatcgaaacgaacgtcggcgggcacgcacagcaccttgtcgtcgccgccggcctcgtcgaccatgtggtacaggcccacggcgcggcactcgaccacgcagcccgggaacacggagttcggaatcatcacgagagcgtccagcggatcgccgtcctcgcccagggtgccgtcgatgtagccgtagtcatccgggtaacccattgcggtgaacagggtacggtccaggaagacgcgaccggtctcgtgatcgacttcgtacttgttcttggagccgcgcggaatttccacaacgacgttgaaggtttctgccatgtcatttctccttgaaaatcgacagttacgttatcgtctcaccacaataccctgtttacgcctgcaaaacaggtgcggaactcaagaaaccgtgctgagattatgccgacactatgcccaaacagacgaaatcctccccttgaggggaggatttctagcggtttacgcgcacgataaacccatgcacgtcaacggcatcactgttgcattaccgttgcagtaccgcatcactgcacggacaggatgtgggccacatccgcccaaggagccagagacacgtagttgtcccaaccccactggaattcgcggccggtcagctcgtcgcgcacgttgagcgggcggtcggtgggcagacccagctcgctgagttccaggtgaatcatcgactggtgtgcgttgtgtccatcgaggttcacgaccacaatcagcgtgtccgcttggccggtaccggtcagttcggccggcgtgtggcgtgcgaaagccagaatattcgggtcggacgtaggcagcacggtgaggttgtggtagctcaacgcggccgggtgggcgcgacgaatcttgttgagtgcggtgagcatctcggccacgccgtactgcttggccttgctccaatcgcgaaccttgacctcgtacttctcgttgtcgatctgctcttcgaagccggggcgctgcttgttctcgatgagttcgtaaccgttgtagataccccaggacggcgagcccatggctgccagcaccgcacgcacgcagtggccggctacgccgttgtctcgcacgtaagcggtgagaatatccggcgtggtgggccagaaggtgttgtgctggtagtagccgtcgtcgccattggtgaccggcagatactcttccagttcgtccttggtgttgcgccacgggaagtagcagtgggactgggtgaagcccacgtagctcagggcgcgcatcatgcccgggcgggtgaatgcctcggccaggaacaggatctccgggtgcttcttggtcacggcggcaatcacgtcctgccagaaacgcaccggcttggtgtgcgggttatcgatgcggaagatggtgacgcccgcctcgatccacagattcatgatgcgttcgacttctttttcgatgccgggcatgtcggcgttgaagtcgatcgggtagatgtcctgatacttcttcggcgggttctcggcgaaggcgatggagccgtccggcttgtggcggaaccagttcgggtgggccttgacccacgggtgatcgggcgagcactgcagggcgaaatcaagcgcgatttccagacccagttcatgtgcacgctggcacagggccttgaaatcgtccatggtgccgagcagtggatccacggtgtcgtggccacctagctcggagccgatgccgaacggggagcccgggtcatcggggccggcgaccagcgtgttgttgcggcccttgcggttggtcacgccaatcgggaagaccggcggcaggtagacgatgtcgaagccctcggcagcggcgcgttcgaggccggccatcgaagtcttcagcgtaccctgaatgatcttgccggtgttcggatcgatggtggcgccttcggaacgcgggaagaactggtaccaagccgcgaagctggactttgggcgttccaccttgaagcgctggggctggctgggggagatgccgtcgcgcagcgggtgagtctcgtgcagggcggcgatggtcgggttgtcgccggcggcgagacgatcctcggcgctcagcgtctgatcggccatggtctcagcggccttctccaaggtcttgcgatcgcgtgcggtcaggccggtgtccggggtttcggcccaacgggccagcaactcggcaccggaattgagtgcgttgtccacgtcgtccatcacacgcaccttgatgcgggcgtcgtgcagccaggagacgtacgcgtcttcccaaccttcgatggtcacggtccattcgccgagctgacgcttgacggccgcgtagctatcctcccaaggcttcagatcgctgtgctcgccgcacttgaccatcacggtccaacgatcgaggccgggatttacgcaggtcatggcccggcgcatggtttccttgccgcgcgggttgcgcacgatggcggtggcacccaccttggtacggccttcgatgaacacctgggcggtcatctcaaacggttcgccgagttccacacgggcggggaagatgccgcgctcctcggcgggagtgatgtccatgacattgatgcggccgaactggccgggctcgtttgcttcgatggacggtgcgggggcttcgacagccaggcctttcagcgctgctgcggcgcgtgccgtttcggcgctgactctcttgcgcttggttgcggggctctttcgggcagaagtcgcctttgacttcgttttcgtggtgctgttatcggtattactagtgcgcgtggtcgcgcgatgttgtactgctgccataaggccctattctaagggcttttgaacatatgttgcgcattgtggataactatcaggtaaacgttcggtcaaccgcatgaggtggataactcggcggaagagttatccacaactcgccggcaaacggcaagctcggaccacataggtcgaaaaaccggctgtagcgaatgaaaatctgccatgatcgtggcctacccgcacacagtgcagtatgcggggaaacgtaccaggaaaggacgaatgatgataacgacatggcggcaacggggcatggccatcgtagcgatgctgaccggtctgataataatggtgggagtggtgttcggctcggcgaatacggcgtatgccgcgacgttgacgcccgccgacgaaagatatcacgtggcgtttccatacaacgatatggaatattacgtcggtgtcgcggggctggacgcttcgggcaacaagtactactgcatcgaagcggggaaactgagcgactatgtgataggccccaccacggtgcttgcctccgatgagaacgcccggcgtatggcatggatccttgaccggtaccgcgacacggatgccgccacccatgcggcgatcggcatcatcgtgcaggatcacttcgggcgcgatcgggacgagtgggcgagacagatggcggtcattcaaggccggtaccccgagatcgtggcgaaggcggcccggatatgggatcaatcggccggcaagacgcctgcgggcacgacggtggaacgcaccgatgccgaggctttgcgcagcggttccatctcggtgaaagtggtgaaccgcgccggtgacgcgatcgcgggagtgccgttcaccgtcaccttgcagggggcggcgcggttcgtccaaggcggcaacacgttctcgggggtgtcgacgagcgccgggtcctcgatcgcgtgggaggcgaccggcgccggcgaggtgacggcgaacaccacatacgagtatgggcggatgcacgtcatggacagcactcaggacatgctggcctttgactcgatggcttccactggcggcgcgtcgacgacatttcgggtgcgtaaggattttgttccggcggtatccaccaaggtctccgagaaggtgcttgatgtggcttctccggtgttcgatgacgtgaccagtggcgtggcggatgcggacagttattgggtgcccgatttggaattgcaggcccgcggatactatttcgatggtcttgatacgggcgatgtgggcaatgtcattacgccgaatgcacaagagagcgccgatgcttttcttgcgcgattggcgactttgggttatgagccggtggcctatggcaaggcctctttcaccggggtggggcagcaggcacgtgtgcaggccatgaccaagccggatgacggtgccgcttaccggaccaagcagaatagcggttttggcacatgggtatgggtgtttcggcggtccgagcagagcaaacaggcgcaggaataccttataggcgactggataagtccgtttatggaggctacggaaagcaatacaagtcgcaggaagctagaagtcatgtcgacggtcactgagcattcggcggatatcggtgccgagctcagcgacaccattaccgtatcgggattccctgcggatcatggccagtatgccggcaacgaagagtatgagttcgcggcggatcggccgtatgcgacggtgagcgtatggtggtccggcgatcccgacaacccctccaacgatgaggcgtacaagccatccgggggagaggttcccacggaagacgacaaccaccggttgctggccacctgggagattcccgcgatgaacggcacgttcaaaatcggcgccggggcgttggacgcgcatggcgctcctatgtatctgaccgccgaacggcctgggtggtacgtgttcgtctggcggttcgagggggatgaccgtgtttccccggcgtccagccggtatgacgatgcctgggagcgtgtgcgggtgttgcccccatgcgagtcggagaaaccgtgcgaaccggagaaacccgagacgccgccggcgccggcggaggcaaccacgcccaaccctcgcccgtcactgcccgtcacgggtggcgatgtgtcgcttgcctcggttctggccgtgtcagctctggcgataggcgccatactgtccatcgtcgttcggtggcgtcgtcgctatgaccgattcaagcactggacgatgcgctggccgatacgttgacccgctgcggcatgatgccgatgatgtcggctggatggtgaaccacactccgcttctgagcagaagaacgggagctgggcacgaagtcgatcgtaacatacgacttgtgcccggcttccgcttcgttgagaaacttcacgcctgtcgcctcccgtggattagacaactgaagatccgcgatgaaaatgacgagacgtttatgatcgccgacttccctgggcaccgtagctgcctgatcgcctttcatccatatcgccacggtaaacggaaaggccgctgatttcggtaccgaaatcagcggccatataaccacgttcgtagcggggcatggatttgaaccatggacctctgggttatgagcccagcgagctaccgagctgctccaccccgcgtcggcttgtctctcagacagctctatctacaataggtgcagattccagaaagtcaacatcggcgtgtcgcgtcatcttcccgcggttttaaaacgtgaattggctcacgcagcgaggggtttggggcggagtcggagtcggggtaataacgcgccataaatggccgttataggaatgccctgaaccgttatcccgaatattgacataataggaacatgcctatcaagatccccagtggcctgccggccagagatatcctcgattcggagcgcatcttcgctctggagaagcccgaggcggagcgtcagcgcgtccgcccgctcaaactggtgatcctgaacttgatgcctaagaaaatcgagactgaaacacagctgctgcgtctgatttccaagtcgccgctgcaggtcgaaatcgacttcatgaagacctccacgcatgaggccacgcacgtttccgccgatcatctcgtcaagttctacgaaaacctcgatgcgttcaaagacaactattacgacggttttgtggtcaccggcgcgcctgtagagcatatgccgttcgaagatgtggactactgggacgagttcaagacgattctcgactgggcctccacccatgtgttctccaccatatacctgtgctggggtgcgatgggcgcactgtactaccgctacggcatccacaaggtggattaccccgagaagattttcggcgtattcccgcagtacctgcaggatgaatactgcttcctgaccaatggcttcgacgagattgatctgcagccgcactcccgcctcgccggcgtgaacgaaaacgaggtacgtgccaaccatgaccttcagatcttgacttgggggccgcagtccggcccgggcctgatcgccacgcgtgacttctccgaagtgttcgcgctcggccattgggagtacggcaagtacacgctcgccgaagaatacgagcgcgatatggccaagggcatgaccaacgtgcccttcccgaagaactacttcccgcatgacgatccgaagctggaaccgttgttcgcctggcgcgcccacgccaatctgctgtggcgcaactggctcaactgggtgtaccagaccacgccgtatgacctgaccgaggtgccgcagctcagggctgagaagaagctcggtactgatcgttcgattcggcatgagccgggcgggccgcgccaggatgatttcaagccgtttgtgcatgacgggtatggggtgattcagggctgagcctacgatctcccctcagtcgcctacgacgacagctcccctcgacggggagctcctttgcttctccttcacggctcggcccatcagagggagctactgttggaggttgcgttcgtagcgtggacggttgttcgtccacgatgtggacggcttgatgaacgtaatgccacacatccgcgtaatgcgaccaatagtgcacaacgttcgcgaaacgcccgggaaaaccttgcagcagtagggatttcaggagactcgccggtataatattgacattgtctagacgcaggcaaataatcactcttcagtcattcggagccgaatgcccagcgcagactccgtgtccatgcccggcagactccacaccgaggagacaaaaaaagacgaaagtaacgagcacgtcacatttgcctgcccggtgggtttaaactgacacctgacattgaagaagcaggaggcgtgatatggtcggttcgctcagcgcaggattgctgttggctgacgaggcaggcgctcatctgccctcggttgatgacttccttcccccggagattctgttccagggaactccgtttgccatcaaccgcattattttgattcgtatcgtggcaaccatcgtgctgttggtggtgctcggcgtgaccgcaaagcgcgccaagctcatccccggccgttggcagggcgtagtcgagtacggtctcgacttcgtgcgcgacaaggtcgtgtatgacgtgatgggtgaggcccgtggcaagcgctacgtgccgatgatcaccaccctgttcttcacgatcttcattttcaacctgtgcggcatcattccaggtatgaacatggcggccaacgccacggtggtcatgccgctcgtgttcgctgtctggacactgatccagtactggatcgccgccatccgctcgcagggcctcggccactatctgcgccacgagctgttcacccccggtgtgccgtggccggtctatttcctgctggctccgatcaacctgcttgagctgttgatcatccgcccggcctccctgaccatccgtctgttcgccaacatggtttccggccaccttatggtcgccacctgcctggcgttcgcacagttctggatggttgacgcggtcaacaagctgcagggcatcccggtgggtgcgctgtggttcgccggtggtttcgccatgacctgcttcgaggcgttcgtcgccttcctgcaagcctacgtcttcgcgattctttccaccgtgtacatcaacctgagcttcccggaagagtgacgggcgactaacccgccgcttccggtccccggtctgggaaaatcgcagaccgaccaaaccccaagatttataacgtcgccaagtacgttagaaaggaaacacaatggatatcatcaccctcgcagaggtcgccggcaacctgtccgtcatcggttacggtatcggtactcttggccctggcattggtctgggcatcctcttcggcaaggccatggaatccaccgctcgtcagcctgagatgtccggcaagatccagaccatcatgttcatcggcctggctctggtcgaggtgctggcactgatcggcttcgtcgccgccctgatcatctgatctgcgcagatcaacagacgaaaaccgattatgtccatcactgaaaggagggcttgatgacacaagcagcaagcgggattgacctgttcattcctgaggtttatgacatcgtatggtcgctgatcattcttgtcatcgttgcggtgttcttctacaagttcttcatgccgaagttcaatgcgatcttcgacgagcgcgccgccaagattcagggcaacatcgccaaggcggagcaggctaggaaggacgccgacgaggccaaggccaagtatgaggcccagctgagcaccgcccgtgtggacgccgccaagattcgcgacgacgcccgtgcggaagcgtcccacatcatcgccgacgctcgttcccgcgccgagtccgatgcggcccagatcaccgcatccgcacagcgctcgatcgaatcccagcaccagcaggccatcgtctcgctcaagggcgaggtcggcgcacttgccaccgccctggccggcaagatcctcggtgccaagctggaagacaacgacgtgcagtcctcgatgatcgattcgatgatcgacgacctgggcgccaagaagtgaccgtgaccatccgtaaccagaaagggaggtgaccatgcgaggagaggcatcacgtattgcagaccgcgagtcgcgtgattcgctggccccgaaactgcgcgacacccgtgaggacgcgtggcggatcggcaacgaactgttcacgatcaccaaggtgctcgatgacagcattcagctggagcgcgcactgaccgacccgtcccgcccggttgccgacaaggtggccgtcctgaaggaactgctcggtgacaacgcgcatccgatgaccatggagatcatgactgacttggtctcccgccgttggagccgtgcgcgcgacatcgccaacgcagtggaagacttcggcgtggacgccatgatgtactacgcggacgccactgacgccacgctgcaggtatccatcgagctgtccgagctgcattccgcactgctgaacctgccggtcgtacgcgccaagctgtacgactaccaggccaccagcgaggcccgtgtgaagctgttccgcgaggtgttctctggcaagaccctgaacaaggtcaccatgaggctcgccgaacacgccacttgcaacctgcgccgccgccgctacttggagaccatccagtggctgatcaacaagttctcccgccacatgggcgagtcgatggtcaccgtgaccaccgccaccccgctgaagaaggagcagatcaagcgactggtcgaggtctactccgccaaggtgggccgtcaggtgcacatcaactcggtggtcgacccgaccgtgctgggtggcatgcgcatccaggtgggcgacgaagtcacggacaacaccgtggtcgcacagctgcagaacttgcatcgcaaggtgcagacggaggcgactccggcctgaccggccgagccaatccgtccaacaccacacacaagcaaagacttgactgaacaataaccaatagaaggagtgatcatggcagaactgaccatcgatcccgcctcgattcgcaaggccctcgacgacttcgtgtcgtcgtacaagccgagcgacacccccacccaggaagtgggctatgtcgccacggccggtgacggcattgcacacgtgacgggattgcctggttgcatggccaatgagctgctgacgttcgaagacggcacgctcggcctggcgttcaaccttgacgcccgtgagatcggcgtggtgatcctcggcgatttcgctggaattgaggaaggccaggaagtgcgacgcaccggcgaagtgctttccgtgcccgtcggcgacggctatctcggccgcgtcgtggacccgctgggcaagccgctcgacggcctcggcgagatccagggcattgagggtcgtcgtatcctcgaagcccaggcccccgacgtgatgcaccgccacccggtcgacgagccgctgtccaccggcctcaaggccatcgacgcgatgaccccgatcggccgcggccagcgccagctcatcatcggcgaccgccagaccggtaagaccgccatcgcgatcgataccatcatcaaccagaaggccaactgggaatccggcgacccgaagaagcaggtccgctgcatctacgtggccatcggccagaagggctccaccatcgcctcggtgaagcagagcctggaagacgccggcgccatggagtacaccaccatcgtggcctccccggcagccgattccgctggcttcaagtacatcgccccgtacaccggctcggccatcggccagcactggatgtacaacggcaagcatgtgctcatcgtcttcgatgacttgtccaagcaggcagaggcctatcgttcgatttccctgctgctgcgccgcccgccggggcgtgaagcctacccgggtgatgtgttctacctgcactcccgcctgctcgaacgttgcgccaaggtctccgatgacctgggcggcggttcgatgacgggtctgccgatcgtcgagaccaaggcgaacgatgtgtccgcctacatcccgaccaacgtgatctccatcactgacggccagatcttcctgcagtccgatctgttcaacgccaaccagcgccccgccgtggacgtcggtatctccgtctctcgagtcggtggcgccgcacagaccaaggctctgaagaaggtctccggtacgctgaagatctccctggcacagtaccgttcgctggaatccttcgccatgttcgcctccgatctggatgcggcttccaaggcccagctgacccgtggtgcccacctgaccgagctgttgaagcagccgcagttccacccgtactcgccggaacaggaagtcgtgtccgtatggaccggcacccacggcaagctcgacgacctcgacctgaaggacgtccttccgttcgagcagggactgctggactacatcgaccacaacaccgatatcctcaagaccattcgcgagaccgaggaattcaccgccgacaccgaggctgccctcgataaggccgtggacgagttccgttcgacgttcgtctcttccgccggcaagccgctggtcgagaagaagccggacgttgacaaggccgcgccggtcgatcaggaaaagatcgtggcgggagaaaagtaagccatgggctcgcaactcgcattgaaatcacgcatccgctccaccgagtcgttggcgaagatcttcaacgctcaggagatgatcgcgtcttcgcatatcgccaaggcccgtgatgtggccctgaacgcgaagccgtacaccgatgcgattttcgatgccgtgcaagcgttggtggcccacacccatatcacgcatccgatcgcggtgaaggacgagaagaacccgcgcgtggctgttctcgccctcacctcggatcgtggtatggccggcccgtacacctcttcgattatccgtgaaacggagtcgctgctgtcccgcctcgatgcggcaggtaagcagccggagctgttcgtgtacgggcgtcgcggttcgacgtactacaagtaccgtaatcgtgacatcgcggcgacgtgggaaggcgacaccgaccagcccggcgtggaaattgctgaaacgatctccaacaccttgatggacgcctacatgaagccggctgagaagggtggagtttccgaactctacatcgtctacaccgagttcatcaacatggtggtgcagaaggtgcgcgtgctgcgcatgctgccggtcgaaatcgtgaaaaacgagaccaaggtgcccgatcctgatgaagaggcaccggctactgcggatgtcgctccgctgtacactttcgagcccagcctcgaaaaggtactggatgcgattctgccgaagtacattcagtcccgtatccacgagtgcctgctgaccgcggccgcgtcggaaaccgcaagccgccagaacgccatgcacacggcaaccgacaacgcacgaaacctgatcgacgaccttacgcgcaagctcaacgcttcccgccaggcctcgatcacccaggaacttaccgaaatcatcggcagcgctgacgcgctgaccaagaaggaagagtaggaacgcatatggctgacaaccagaccactgcggccgagcctaccaacggtcgcgtcacccgcgtccagggctcggttatcgacgttgaattcccggtgggtcatctgcccgacatctacaacgccctgaaagtaacgatcgtcaacaccagcgccaaggaagaaggcgaggcgaaggagaccgagatcaccctcgaggtcgaacagcacctcggtgattccacggtccgttgcgtcgctctgaagcccaccgacggcctggttcgtggtgcctccgtctccgacaccggcgccccgatctccgtgccggtcggcgacgtgaccaagggccacgtcttcgacgtgtccggcaacatcctcaacaagaagccggatgagaccatcaccgtctccgagcgttggcctatccaccgcaacccgccggccttcgatcagctggagtccaagacccagatgttcgaaacgggcatcaaggtcatcgatctgctgaccccgtacgtgcagggcggcaagatcggtctgttcggtggtgcaggtgtgggcaagaccgtgctgattcaggaaatgattcagcgcgtggcccagaaccacggtggtgtgtccgtgttcgctggcgtcggcgagcgtacccgtgagggtaacgatctgatcggcgaaatggccgaggccggcgtgcttgagaagaccgcactggtcttcggccagatggatgagcagccgggtacccgtctgcgtgtcccgctgaccgcactgaccatggcagagtacttccgtgacgtgcagaaccaggacgtgctgctgttcatcgacaacatcttccgcttcacccaggccggttccgaggtgtccaccctgctgggtcgtatgccttccgccgtggggtaccagccgaacctggccgatgagatgggttccctccaggagcgcatcacctcgacccgtggtcactcgatcacctcgttgcaggccatttacgtgccggccgatgattacaccgacccggccccggccacgaccttcgcccacttggatgcaaccaccgagctttctcgtgacattgcctccaagggtatctacccggctgtggacccgctgagctccacctcgcgaatcctcgatccgcgttacgtgggccaggctcactacgactgcgccaaccgcgtcaaggcgattctgcagcgtaacaaggagctgcaggacatcatcgccctgatcggtatcgacgagctcggcgaagaggacaagaccaccgtgaaccgtgctcgtaagatcgagcagttcctcggccagaacttctatgtggctgagaagttcaccggtcgccccggctcctacgtgccggccgacgagaccatcgaagccttcacccgcatctgcgacggcgtgtacgacgacgtcccggagcaggcgttctccggcatcggcggcatcgacgacctcgaagagaagtggcacaacatgcagaaggaactgggtgcgtgatggctgcggaaaaaaccacgatgaaggtcaacatcgtcgccgctgaccaccctgtgtggcacggcgaggcgacgagcgtgaccattcccgcctctgagggcggcatgggcatcctgcccgaccatgagcctgtgctcacggtgatcaagcagggtacgctcaccgtggttgagcccgatggcgatcgccacatgttcgaggtgaccgacggattcatttccttcgactcgaacaaactcaccgtggcggtcgagcgcggccacgacgtccagtactccggcaccgccgagtgacctgaaccaactccttaaggggctctctggttttccagagagccccttttgctatgtatgccatgtgttgcgctacagtggtggcctatgcgagttattgttgccgactgttcggccgagtattcgggccgcctcaacgcctcactgcccctggccaagcgcgtattgctgatcaaggccgattccagcctgttgattttctccgaattgggctcctacaagccgctgaactggatgaccgcgccctgcacgattcgtgagatcgacccagccgccaaatccgcgcaacattcccgggaaagtgtcgctggtggggctgtggatggtgattctgcgacgcattccccggaaagtgtcgccgctggtgagccggaaaaggtgctacgtgtcagcgccgacaagggttcggacattcttgaagtgacgctgcagcatatctattccgaccaaacctatgatctgggcgaagatccgggtctcatcaaggatggcgtggaagaccatctgcagcgctatctggccgagcaaatcgagcgtatcggcaagggagccaagctggtgcgtcgcgaatacccgaccgccattggcccagtggatattatggccgtgaatgccgagggcgagcacgtggctgtggaaatcaaacgtcacggcggcattgatggcgtcgagcagctgactcgctactgcgaactgctcaatcgagatccgctgctggccccggtgcacggcatcttcgccgcacaaaccatcacgccgcaagcccaggtcttggccaaagaccgcggcttcacctgcctcatcctcgattacgacgatatgaaaggcaccgaggacgacagtctcaggctgttctagatatagcaggggctccctcatcagagggagcccctgctatatcttttagtacgcggcgagaatatcgattacgaagaccaacgtggagttggcgggaatcggaccttgctccttatctccataggcctgatccggcggaatcaccagcagaacctgagagccgacggtctggccgaccagacccttctgccagccctcgataacctgatgctggccgctggaatcgctgaacagatcggcgtcgattgtggaatcgcgatcccaggacgaatcgaactgcttgccattcgtaagccaaccggtgtacttgaccaccacggtgttcttgtcggtcagcttggcgccgttacccttgatcagcgtctgcgagatcagcgaatcaaccgaaccctgaccgttcatgtcgatggacggctcgccgtttttggctcgcgtcaccttcggcagattggccggcacatccttgacttcctcgccagtggccttctccaagtccttggacttggacacaaacgtcatcgccagaatgtaagagtacccggacgaatcctgagcgttgacgccaaagccaatcgtggtgttgatcttggcacccttgatctggttgtagtaggtcgaggagagggtcttggaatccaccttcagcgagcaatccggcgtgttcttggtccaggtgtccatgagctcggttccgtctttaacgttgagcgcgatgccttgggcgcagacgcggtcgccctcctcgatcacgtcgccatcgcccttctgcagcaccacataagagccgtcggacacggtcatcggcgtattaaaggagatggtcggcttctcgccgagcttgcccttggcggtcacgccggcaatttggcccttcttgtcagaagagtcggaagatgaagaggaatcggaagaagaggatttcgagtccgagctcgaactggagcaggcagccagcgacacgcacatcgccagcgagcaggcaagggcaacggccttgccgaggggagataacatagacttaacagacttacgcatgacacatcaccctactggtaaaccttgattttctgcgctcctaggtaataaacaggtgaagattgtagaatggttgagttatgagtgctgaagaacagactacaagaccggataagggcgccaagcgtccatcccgtcatgccaaaatcatgcgtggagtggtgacgcctatcttcggactattggccgtggcggctgtggtgttggggtacatgaatgccacgatgtggaagccctccactgaaatcaccgcttccgcaaccatgagcggctcccggtatgtcgtcactgatccgaatgtgctgaccttgttggatcagaatgccacgataaccgtggactcgggatcctctcaggacgaggcgtgcgtggcgttgggtccgtccaaggatgttgccggatgggtcgcgtccgagaagtcctatacccgcatcaccggattggcatcatggagcgagctgagcacccagaagggaagcagcacgagtcagggagcgcctaccagtgccgatgacgcggtgtcgttcaaggattccgatatgtggactgccgtgaaatgcggcactgggtccgtttcgctgaagagcaagaagaccggcgcctcgacggtagccattgtggatttgggtgaaaatgtcaccaacgccaaggtgcagctgcactgggtgcgctccgaagtgccggactttgcgatgccgttctatctgtccggcggattgctggccgtgctggccgtactgtgcgcctccgtgttcgccatgccgccgcataagcgccgcaagcgcatggtggaaggcatggcaagcgccgtaatcgaggaagaggcacccgccagcatcgcagtgtccgggaagccggatggtgcaagtcgacgtaatcgtcgccgtcacgccacacatcggcgttcgggccgtgcgtcctcgcaatcctcgcaatctgaagccaccgaaacaccggttatcatcgacccaagttcgcgtaacctggtcgccgaccagcagaccggtgccgaaagcggcgctgagcccggcctcagcgccggcgataacgaatcgacttcggtaatcacccctgacgaactgcaggcctacttctcccgcttggcccaagaggtcaataccggagacgactcggccgatgacggacaggaggaaagctgatgaacaagcgatggaacaaactgtgtgtgtccgccctcgcctgcatggcgttggtcgtgccgttgaccgcctgtgaaggccaactgccgacgccggctgctgatacctccaccaaggttgcgccggatttgaccgaggcacaggagaagaagattcgcctgaagattctcaagacgatcgatgaagccgatcaggccaagaatcccgatggatatgcggccgttatgggcgggccccagctggacattcgcatcagccagaccacgatcaaccagcgcggcggcggtatgtccaaatacgcgaccattcccaaggacatcgcccagacggtgattcccatggacgacggatggcctcgctcggtgttcaccatcacgaccaccaccgaagatcagcagtccaagcgtttgctggtcttcgatcaggaatccgcccagcagaattacaagctgatggctatggctcgactgtttgagggcgccaagctgccgaagttcgagattccgactattggctcgcagatgggcaccgcaaaggatgagaagctggtggccgctcccgccgatgccttggcccaatacgccgatgtgctgcagaacggctccaagagccaatacgcttccaagttcgcagacgatttgctgcgccaggaactggccaataccacggccaaggtgcaggaaggtatgcaacgcaacaacggtacgcaggagcaaaaattcaccgctgtgcctgaacagatgtgggtgatgcgtgctgcagacggtgccggtgatctggtggttggccgtattaacggcgaatggactcgcaaggcaggggatggccgcgaatcgcagccggcttccgacgacgagaaggcgctgttcaatagcgacaagtacaccagcaccatgaaggtcacgtatgtgaacgtggtggccttgtacattccgttggcaagctccggtgagcaaatcaccgccgtgggtgccgaccgtcagccggtaaaggtcgaagcgctgtagttgttgccgccgcccaccgcgcggttaacgccccaccacgatatgattcatccaccacgatgtcggtaagttttacctttcgcacaatggtgccgttttgagtcacatcgtggtgggcgttttgctacgtggtgggaatttcaccgcgtagtggaagaatccctacgtggtgggaatcggcattacaatcaatgtcagcaaatgtgattgttgttgtacgcgaatcgcgtggaatcgggaggcattatggcagagcagcagttcaatccgggagtctcattggcgggcgccgtcgatttggaggcgctgaagcatcaggtcaaggccaagcccggccaggcgggtggcgctcctgccgctggtgggtacgtgatcgacaccaccgaaaacaccttccaggcaatggtgcagacttctgcgaccttcccgatcctgctgctcctgtggataccgaccgatgaccgcctgttcccgatggcccgtgcgttgggcgacgcggtgaacgccctgaacggccagattcagctctcccgtatcgatatctcgtccaatccttcgattgcccaagcgttgcaggtgcggggcgcgcccgcactgttcgcgttgattgctggccgtccgacgccactgttgcagggccttccgggtgacgacgagctcaagcaacttaccgacgaggtgattccgaagatcattgaggccgccgcgcagtctggtgtgaacggtaccgcgccgtactcgggtgatcctgattccgatgctgccaagagcgctggtgccaccggtgccggcgtgggtgctgagcaggtgccgccggagcatgccgaagcccatcgtttggccgaggagggcgattacgccggtgccgccgccgaatacgagcgcgtgctcgaatccgacccgtccgatgcactggccgcccgcgaacgtgcgaaggcgctgttgctggcccgctccgggtccgctgatgtacgtgacgtgcgtgccgctgccgccgcagcgccggacgatgtggaagcgcagttggctgtggctgatatcgacatgatcggtggccagattcaagacgctttcgaccgtttgctggactttttggccgccgggcacaaggccgatatcgagcaggttcgcaagcgtctgctcgaatacttcgccatccccgaacccaccgacccgcgtctgacccgcgcccgtcgtcgcctagccaccctcatgtactaagtggttttggctcccctctttgagaggggctgtcgtcgtagatgactgaggggagctcacgagcgtactcgattgctccccccccctaaaccatccgattcttcccgaaatactgctggaaccttggcccctccagcgccagctcctcctcgaaatcatccgcccacttacagaacggacggttggcgagaccatcgttattgaatcgcgcctgatcggtgatttcggtgatgcagaatttcggaatcgtcagattggtaaccggcccggatcgttcggcctcggctacgatgagcggcgcattcggcccgccgaacacatccacgctccagccgtcttcctcaatccacacggaataccggttcttgatgattaccgagccgccgcgcttgatgagttcggccgcgatacgcgtatcgatttcgcgctcgacttcgtagcgcgtgccgcccacggacggacctttgacggtgacatatgcttccgagaaccggtcgcggtattcgtccagcacggccaccggatttacgtcgggcgtcatgtcgacgtgaaccttgcgcgagaccagccgcacgcgcaaggcgtaattgtcggcatgcacgtagtagctctgaatgatgagggtcggggcgtcgccgtcgtcgtattccgccggcagttcgcggcagaagaagcggcgttcgtattcgaagtcatctgtaggttccgacataaccccattgtagagccgataatggcgattttctcgttattttggcgacgtatgtgccgcatgcaacgtgatgtggtgtacagtaaagaagttgctcgggtttgtagctcagtggatagagcgtctgtctccggaacagaaggtcgtgggttcgatccccatcaagcccaccagcatggctttcggctaaccgccggaagccttttgcatattcggcgcgtgcaaggctggtgctggtgtcggcaatggcaaggccggtgatgccggctcgcttgggtcgtggaaaaaccgtccggtttggcgagaacggtagccgaatcgtctggaatcgtctggaatcgtctggaatagcaaggaatagtctgttgatggccgtatgccgggcatcatgcgcgctaaacgcgactttgctcagtagactgctacgtaatcggcattgccaatcgttgctgatcgtgcgattggtcgtagccggtggtgatgtgtaccggcgccggccgcagcaggtgggcgcccccaagatgagaaggagcacaatatgagcgaaaagatggaagccgtagccacttccgaggcgccggccgcgctgggcgcatacagccaggcggtgaaggccaatggcttcgtgttcgtatccggccagctgggcattgatccggccaccggcgaactggcgggcgagaccgctggagagcaggctgcacaggcgctgaagaatattaagcacattctcgacactgccggtaccggcattgagcatgtgtgccgtgccaccatctacctgaagaacgtcgaggacttcaaggaagtggacgcacgttacgctgaggcgttcatcggctccgtcaagcccgcccgcgtggcctttggcaacaacatgattcccaagggcgcgctcgtggagattgacgccatcgcggtggagtgattcgaacgttttcccggcggcccgtctgcgcgcatggtgtgtgcagacgggccgccgcgtattgtgcgacgcattcccgggaatgttgcgctggaatcgttgggcggtggtccgtgccacaatagagaccatggcatccaaaggaaaaccgtcgccgcgttcggccgtaagcccgctgagtgatgagcaggtcaagcgtctggccgcccgccacacgcttgtggactcgacacagtattacccgaccggcccccgcacgcccaatcagccggaaatcaacgcccagaatcccaaggccaccaaacgactgctgggaggggtgtccattgtgttccgcgccagctgcaagaccaaggcctggggcttggaacaggtgccggaaaccggaccgttcatcaccgccgccagtcatgtcaccatgtttgatgtgttcgtgccaatgatgagcctgttccacatgggccgccgcccccgttacatggccaaggccgagatggcgaagtggccattgatcggcaagtggttccagttggtcggcatgcagccggtgcagcgtcattcgggcaaggccaagcagatcgaagagacctcgattgatattctgacgtccggccgcccgctgacggtctggccggaaggcaccgtgacccgcgacccgaaaaagtgggtgatgagcattaaggagggcgtgggatatatcgcccttgaatcctcgcgcagactgggacatcaggtgccgctgtacccggcggtgacgtggggtgccgcctccatcaaccactggtggccatggccgcgcaaaaacgtggtgatgtgctatgaccatgcgctcgattactccgatctgcttgccgacatggactcatggggtgaagagccgcctgccgaggccgtgaacgagctgatgtggcgcgtgctcaaacgcatgaacacagtactggaggaaattcgtggcgagcagttccccgctgaaggctactgggactaccgcagtatgagtcgtaagccttggcctgaagccggcggcccgttcccggctgagaagtagccgcaccggttcccgtacggggagcctaggcgagtagcatggcacaagattgtgccgatgaagttgcgcgacaagcgaaggtaggaatttgatatgggtaaaaatataacggttctcggtgcaggagcatggggtactgctttcggccaagtgctggcggacgcaggcaacacggtgaccatgtgggccaaggagcagcagattgtcgagggcattcgcgatcaccaccacaacgccgtgcgcctgccgtccgtcgaaaagttgccggacaacatgaccgccactggggatcgcgccgaagccgtcaagaacgcggacatcgtagtcgtggccatcgctgcgcagttcgcgcgagtggcactcgtcgaattcaagggactgattcccgatcgcgccatcgtcgtcagcctgatgaagggcatcgagcgtggcaccaacaagcgtatggacgaagtcgtccgcgaatcccttgacttgccggccgaccggttcgccgccatttccggaccgaacctgtccaaggaaatcgccgatcgtcatcccgccgccaccgtggtggcttgcacgaacctcgataatgccacgaaggtggccgaggcatgcaccacctcctatttcaagccgttcgtgaccaccgacgtcatcggcctggaaatgtgcggcagcctgaagaacgtgaccgcgctggccgtgggcatggcccgtggtgccggctacggtgagaacaccgcagccatgatcgaaactcgtggactggccgaactgaccgcgctgggcgtagccgctggcgccgatcccaagaccttcttcggcttggccggtgtgggcgatctcatcgccacctgtggctcttcgctgtctcgtaactatacgttcggcgcgaatctcggcaagggactgacggtcgaagaggccaccaaggtcagcaacggtgtggccgaaggcgtgcccaccacggatgcggtggtggctcttggcgatcagcttgatgtgccgaccccgttggcgtatcagatgagccgcgtgctgaacgaaggcatttcctgctcggagatgcttgccggactgttcgggcacgaggttaccggcgaataacgagagaagcgacgtatacgtggcgtatacgttgtacgtgccgcgtggcgtatacgtcgttggtgtgcacgagtagactggtgtgcgtctcttgtgcgcggcggtccgagcgcggttcggtccggttggcggtgcaaagcataggcttgaaaacggttgtagtttcaacaaaaggatggttatggccaagaagcgtgttgtggtgctctatggtgggcgtgcagacgagcattcgatttcctgcatctccactgccggtgtgctgggggccatggacactgaacggttcgagccgattccggtcggcatcaccaaggacggcaagtggatcatcaatggcgaggatccgcgtggctggaacttggacggcggcgagctgccgaccgtaaagatcaccccggaatcgcgcccggtgatgcttgacccctctcgcggacaggacggtttcttcatcggcgagcccagccacatcaattccgccgattccggcttcggcaccagcttcgtcagcatgtccgacccggaaatgcaccatgtgctgacctcgcttggacatgtggacgcggtactgccggtgctgcacggcccctatggcgaggacggtacggttcaaggcctgctggaaatgatgggtgtgccgtacgtggggtgcggagtgtttgcttccgccgcctgcatggataagcattacaccaaggtggtgctggatgccgccggcattcccaccgcaccgggtgtgacggtcgatgcgcgcaacttcaccgccgccgatgtgcttgccaagatcgaggacgccggtcttgcctatccgctgtttgtcaagccttcgcgcgcaggctccagcttcggtgtgaccaaggtcgagaaagccgatgaccgcgagacccagcaggatcgtctggccgccgccatcgccaccgccggcgagcacgactggaaggtgctcgtcgaacaggggattgatggccgcgaaatcgaatgtgccgtgctgtgcccgaaggccggtgacgagcctgaggccagctggcccggcgaaatcgtgctcgatcatcagaacgacgaccagttctacgatttcgattccaagtacatggatgcctccgccagccacgtggaagtgcctgccaatctgccggtcagcgtgcttgaggacgtgcgtgacgtggcccgtcgcgcgttcaaggccgtggatggtgccggcttgagccgtgtggacaccttcgtgacgcctgatggcacggtgatggtcaacgaaatcaacaccatgcccggcttcacgccgatttccatgtatcccaaggcttgggatgccaccggagtgagctacaccgaactcatcacgcgattgattgagggcgtgctgaggtaagtgtggtgcggaatcggccgcaggccggttccgctattgacacatcgcccatacctgtcagtaattcatgccaagttttcctaagttcaacaggcgtacaacaaatggcgaacgcaattcacttgcgcgccagtgtcaggacagattaggcgcatagtttcttttcttggattcacgggccgcgcgaatgccgcgcataccaagcccgactccccagactgtcgtctggatgatgttgagaaaaggaacattatgaacaacctgcgtaagatcgcggccggctccctcgccgccgtgctcgcgttctcgatggccgcctgcggctcgagcaacgcctcctccgatggcaccggcgaaagcaccggcaaggccgtcaccgtgaacgaaaagtccgccaaagccacctccctcgccgacttcggcaccatggaagacctcgagaaggccgccaaggaagagggcgcgctgaacgtcatcgcccttccgcacgattggtccaactacggcgaggtcatcgagagcttcaagaagaagtacccggagatcaaggtcaccgagctcaacccgaacgcctcatccaaggaagagctcgacgccgccaagaccaacaagggcaccgacgccgcccccgacgtcttcgatgtcggccaggccgtcgccgccacctccaccgactacttcgccccgtacaaggtgcaggcctgggacaagatcccggacaccgccaaggacgccgacggcgcctactacgccgactacaccggcatcatgtccgtgggctggaacgccgacaagtacggcgacatcagctccctggacgacctgctcgacccgaagttcgccggcaccgtggccctcaacggcaagcccgccgaggctggcgccgccttcaacggctacctgatggccaaccagctcgccggtggcgacatcaacaacctgcagcccggccttgactacttcaagaagctcaaggaggccggcaacctgaccaccgtcgacgtgaccaacggcaccatcgactccggccagaccggcgtggtcttcgactggacctacaaccaggcctcctacaagaaggagctcaaggacaagggcgtgaactggaagtacaagaccttcccgaaggcccaggtcgtcagctactacaaccaggccatcaacaaggacgcgccgcacccggccgccgcccgcctgtgggaggagtacctgtacaccgccgacgcccagaacctgtggttcaagggcggcgccaacccggtgctgctcgattccatgaaggaagacggcaccgtcgaccaggccactctgaaggacgccatcaccatcgaaggcgagccggtctcctacaccaacgacgactccacccgcatcaccgagtggctccagaacaactgggacaagacgatcggcaactgaggcacagaccgatgaccgccgcaatcgcacccattgcatcgaacggacctgctgccgccaaggccgcgggtccgtccgctactcccgcttctcctctctcctcggcgatggccaagcaccgccaggagctgggcacgctcgccaccacgctcccgttcttcgcctacaccgcctgcttcctgctcgcacccaccgtcatcgtgattgtcggtgcatttcaggatcgcagtggcaacttcacgctcgcgaacttcaataagatgttcgaggccaacaccatcgccgcattcggcacctcgattctggtgtgtttagcatcctctctgatcggcgcagtggtgggcgcgctcgcttcctacgcactggtcattggtgccaagccgaacggcctgctgcgtcgtatggtctccgccatctcctccgtgcttgctcagttcggcggcgtgatgctcgcgttcgcgttcatcgccaccatcggcatcaacggtatcggcaccatgcttatcaagacactgaccggctacaccgtgaacccgaactggctcagctcgttgccgggcctggtgaccatctactgctacttccagattccgctgatgatcatcatcttcctgcccgcggtcgattcgatccgtccacagtggcgcgaggcatgcgaatccctcggtggcaacacgttccagtactggacgcgcgtggcctgcccgattctggcaccccgcttcatctccgcgttcctgctgctgttcgcctccgcgttctccgcatacgcgaccgctgcggccctgttctcccagcgttcgattctggtgccgcttatgatccaaggtgccatgcgcaacgaactggaccccaaccagcagggctttgcccaggtgctggcattcgcaatgatcatcgtcgtggccatcgtcatgctgttgagccacgccgtggaaaagagggccggacgttggcaatgaccgaaacttccgcaaccaagccgccgcagctgcgcgccgctcgtgcgcgtaaacagagcatcatcaaattcgtgatcctgttcgtcaccctggcgttcctgttcgtgccgctgctggccatgctcatcttcaccctgcgtcacccgctgtccggccgctggtcggccgcgccgtggatcgcgattttcaccggcaacggcgagtcgctgggtgccgacctgaccgtgctgtggcagggcatcggcacctcgctggccctgagcgcggtcaccgtggtgatcatgctggtgctgctggtgcccaccatggtcatcgtgcatattcgctccaaggttttggagcgcgcgatcgaatgggtggccacgctgccgctgaccatcccggccatcgtgctggtggtgggtttgggcccgatctaccgctggctgtccgccgacgtgctgagcaccaacccaatctggctgtgctttgcctacgtgattctcgtgatgccgttcgccttccgcgcgatcgccgtggggcttaactccatcgacgtcaagacgctggtcgaggcatcccgctcgctcggtgcctcctggcccaaggtgttcttcaaggtgatcatcccgaacctatggcagtcgattctctcggcatcctttatctccatcgccgtggtgctgggcgaatacaccgtcgcctcgctgctcggccgtatgaacctgcaggtcgcgctctaccagctcggccagtccaattctcaaatctccaccgccatgtcgctgctggctctgctcttcggtgcggtgctcctcgttgcgctcgacctgatctccgacgcaatgcgcaagtcaagggaaggtaagtaacctgatgaacagcaattcgattttcacccgtcgccatgccggtgccgatgccgcggcttctgtttcggcacccgccaccacgtccgctgccgccgaggacgccttcaagaacgatcccaccgccaccctcgaaggcgtgcgcggcaaggacgtgaccaaggccgccaaggccctgctcaaagacagcgtcaagcgcggcggcggctccatccagatgcgcgacgtcgtcaagatctaccccggctccaccgttcacgcgctcgacgacttcaacctggacatcaagcccggcgaaatggtcgtgctgctcggcggctccggctgcggcaagtccaccgcgctgcgctcgctcgccggcctcgaagacatccagggcggccgcatcatggtcggcggccaagacgtcaccggcgtgccggtcaacaagcgcgagatggccatggtgttccaggcctactcgcttttcccgcacatgaccgccctggagaacgtggaattcggcctcgaagtgcgcggcatgggcaaggcagaacgccgcaagatcgccatggaacagctggagctcgtgggacttgccgatcaggccaagaagtacacgcagcagatgtccggcggccagcaacagcgcgtggccctggcccgcgcgctggccgtcaagccgcgcgtgctactgctcgacgagccgctctccgccctcgacgccaaggtgcgcgtccagctgcgcgaccagattcgccgcatccaactcaccaccggcaccaccaccgtcttcgtgacccacgatcaggaagaggcgctggccgtggccgaccgcatcggtgtgatgaacaagggcaagatcgagcagatcgccgccccgcagaacctgtaccagcgccccgccaccgagtacgtggccacgttcattggactcaccaaccgcctgcccggcgcatccaatggcgacgaggccgtggtcttcggccagcgcgtgccgctgctcgccggctccgccaagggcgattccgtggccgtgctcgtgcgcccggagaacctgacgctggccttggccggcagcagcgattcgcacgtcggcgaacgcgcccgcgtggaggtcattcacttccttggctccttggtgcgcgtggatacggtcatcacctccggcgaataccagcgctggaacaagggcgaacagctcaaggccaccgtgcagctgcccgccagcgagctgccggccggtctggcggtgggcgatgacgtgattgtcaccccgcgtccggtcgccgcgctcgcctgctgaatggcgttgcgatgatcgtgcggttctgttctgtttttgtgactgtacgatcgtcgaatggcttatcggcaatgatgtgtgtgggatggcggcgatttttgggcgattatcgcgtgccgtcccacagcaatcttgcagagtaggggactttctcggcattgggaatgattgacgttgatcattccttgcccattgatgatttcctcccccattcccaatgcaatcgaaacgccgtgccgtattcttgaagagtattgcacgtgtgatcggtccgtttgcggccagtaactatgggggataagtatgagcgaaccaatgccgccggcgcagcaacctcagcaaccacagcagccgcaacaaaccccacgcgattggtggttcacggcccatcgccggttttcgacaatcggctcggcgctcgccattatgatggtgttctggatcggactgaatattctggccactgaagcactacgaacgctgcttggcgccgatgtgcccgcttgggctgtgctgctcgcctcctccggaccgctgtatgtggtggccatgccgctgagtatgttggccttcactcgcgtaccggttattcgcacccggcagtaccccatgaaggcgggggagttcattcagattttcgtcatgtgcattccggtaatgttcttgggcaatatgattggcaatatattgtctgccggagccactgatggtcaggccaccaatcgcatcaacgacgtgattcttggcagcgactggcgggtggacgcattgttcataggcctgttggcaccggtttgcgaagaatggatttttcgcaaggagattatctcccgcctgcgccggtacggagagaagaccgcaatcatgttctccgcattggcattcgcgctattccatatgaacgtgttccagttcttctacgcctttggcctaggactgatgttcggatatgtatacacacgcacctcccgactgcggtattcggtggctatgcacatgctgatcaacctgaacgggtcagtactcgccccattggtgatacaacagatcgatccccgcatcctcgacggcacggtcagcgaggccgaaatcatgcgtatggctgaaaccggcaacatgggcggcatgggcatcatgatgttgtacggcacagtgatgttgggcctctgcattgccggtatcgtgctgcttatcaccaagcgcaagagctgggagttctatcttgcgccagaggagttgcctgcggggcttaaaatacgcaccgcctatgccaatcccggcgttatcgcgtacctactgttgactgtgatgcttaccggttggatgctgttcgcatgactgtcatagccggacccagagaggcgagccgggagatatcacagattgcctgacgagctgccatcttcaacaaggtattcggtgcccgaaccggcgatggctcgcgccgccatatctttgatggtggaaggcagcacaccctcgcgcgcgaacacaagcacttggccggtcatgccgtaaggggagaagccggtgaacttgaccagcggtggctggccctccagtgccacatcggcggtggctttggttacgcggtcgagaatatcctgactgatagcggacgggtcgccggaggccttggccgtgaactcaagcgtggacatgccttcgctgaccggcgtgagcttggtcagggcggccgtattgagtaccgaattggggatgaccatcatgtctccggaacgggtgcgcaccacggtctgacgccaggtgatgtcgtgcacggtgcctgtgacgccttgaatggtcaccagatcgccgggttggattacgcggcccagcatcaggccgaagccgccgatgatgttggcgattgtatccttcagacccagcgagatcgccacacctccaacaccaagggcggtgataagtgtggtcggattgatgccgaatacgggctgcagtaccatcgctgcgccggtgacccagatggtcacgcgcgtgaggttcacgaaaatcgaggcgctgggaatctgagaattgtccagaatcttgcgcaacacgcggctgatgacgcggtcggccacaaatacgatggccaatacaatggtcagccagatgagtttgccggcgttcacctgaaaccagcgtgcgatgtcttctgcatattcagtcatacgcctactgtatcggtcgtttctggtgaagtcgtggagacggggtggcagaaagcggaatcggcctacggtcgattccgctactcctggtgctcgcggcaggtctggccgaggcctcgggccagtcgaatcggatcgagaatctcgtccaactgctcggcgggcaggtcggtgcgttcgccggccacctcgcgcacggtacggccggtatgtacggcttcggcggcgatgtcggccgcgcgctcgtagccgatgtagtggttgagcgcggcggaaatcgacggtgaggactgggcgtatgaacgccccaggtcagcattgatttcgatgccttccacgcagttgacgcggaacgtctccatggcgcgcgtcagcaacgccatgccggtcagcagctcatgcaccatcaccgggtcgaaggcgttcagctgcaactgtccctcggccacagcccagttcacagtcacgtccatgccgaagatcgtgaagcagcactggttgacgcactcgggaatcaccgggttcactttggcgggcatgatcgacgatccggcctggcgagccggcacgttgagatcgttgaaaccgcagcgcggcccggaattgagcagtcgcaaatcgtcggcggccttcttcaggtgcacggcgaggctcttgatggcagccgacgtggccacgtacgcgcccatatccgtcatggcggccaccggatcgggcgcggcggtgaccggcagcccggtgatttgcgccagatgcttgatagcggacttgcggaatcgcagatccgcgcaaatgccggtaccgatggcggtggcaccgaggttgagctgggccagcagcggcaccacgcgatcgaatgcagccaaatcagacttcaacagcgtggcaaacgcatgaaattcctgaccataggtcattggtacggcgtcctgcagctgcgtgcggccaatcgtcacgtcattgatatgtttgtcggccagatcgtggaaggccttggcgagtttcttggtggactcggcgagcggcccgatcgcgtcgataagcgcgagtttgcaggcggccgggtaggtgtcgttcgtggactgcgacttgttgacgtcgtcgttcggatggatgtatgtgtaatcgccgcgctggcggccggcgatttccaacgcacggttggcgatcacctcgttcatgttcatgttcgacgaggtgccggcaccgccctgcatcacatcgaccgggaactgatcggccagtttgccggcctcaatttctaggcaggcggcgcgaatggcctcggccttggctgggtcgatcaggcctaattcctcattggcgatggcgcaggcgcgcttgaccgtggcataggcgcgaatcagctcgggatgttggctatcggtgatgccggagaccgggaagttgccgatagcgcgctgggtgtgaataccccagtagacgttcgccggcacctccatctggccgatgcagtcatgttccagacgggtcttgttcgatgtttcgctcatgcttccatcttcctgtgcgtgggttggaaacgccagcatgagaggctgattgcgccttgtgagaaacctcacgcggggttcgtgcggcggaaacaatccagactcgctggttttcggtcaagcggtgtacccggggaatcctgcggggccgttcgacgatgagatggtggatggcgcggcatgcgtggcggcgaccggcatgccggggacggtcgaatcctgcgcattgtgcacgaagatgcgattccagtaattaagcatgtccttttggctcatggccaggtatatgcccatggccagcacggccacatcttctttaagcaggtctttgatttcgatggtgtcgctcaattcgggccaacgttgcagcacggcgagcatgccgcccacggtgaactcgaccatgagatcggttttcaggtcaaggttcttggggtcgcgttgcaatgtgctgagcatttgcagacggcagaagtcgcgcagcgattcggtcagttcaagcgtgctgtgcgggcctgccaacagggccaggcggtcgaggcgctgacgctgctctggatcggagagcgtggcggtgacgcggtctcgccattgttcctcgggattgccgttcggatcgggggtgcggttgatcggaatcgattcgacctgatgcaggatggctgaatcggccaattcgggcaggctggagaagtgatagtagaacgaattacggttcacgccagcctcacgcaccacgtcggtaacggtgatcttgcgatagtcgcggtcggcgagcaattcccagaaagcgttctcgaggcgttctttggcgggcagcacctcggaatcatggcgtggacgtggcatctcttcctcctgatgcaccagcgtgatatggtcacgctgtctaataacttattgggcagtataactgttatttgtggacatgtctatgagttaatcggcgatttcagttgcgtcctccgctgatggcgaagctgtggtgccggcatcggcatcagtatcggctctggctggagctgcgctatctgctcctgctgcagtttctgctggggtctcggctgttgctttggaggtcgcagaacttggtgcggaagccggggcgggcgtcggcttgcgtttggccgtggacgccttgaacagtatcgccagggcctcaaccaaatgacgccggtctgcgggggtcagccctacatacgcgccaagcatcgccggaatcgaagcggggaagttgctcatcacctcgctgaagctggtggcgccgttggcgtgcagcacggtgaacagcgcgtccaccgcacgctcgcgctgttcgggcgtaagcgtggcgatccaatggttcagctcctcgttaaacaactgcgagctggaactcaaatccggctcggtgatgaactggtcgccatccaatagccaggtgaaggcggaatgctgcatgatgccatccgaatcggaagagaccacgcggcaaggctccggggtctcgaaaatcatgcccacaatcgacgaactcggcacgattttcgtcaccttcggctggatggtgcggtaggcggggctggtcacaatctccggcgggaaaccggggccatccagtgaatagacatgctgaatgcgcttgcgcaccttgggatcggcgttcatggccgcgtaaatcgccagattgcctcccttggaatggccgaccagaataatcggaccctcccacagtcgcgccaccatatccagataggcgctggctgaacgttgcgccggcaccggatactggaaagccatattgaaatcttccttccatccgatgagcgaatcatcggtgccgcggaaggaaataaccaacgtgcctttgtaggtcggctttcggcgcttgtggccgtcgggcagttggaaggtggcggcggcgaattgggtttgctcaccctgattgatgtgctcgaccaccgcgcccaggcgaacgttggcgtagcgggggttttcgcctgcggcctggaacaggtcgtgggtcaggtccgggttgaccactgaaaccatttgggcttcgtgcggcttgtcgtcggcatgtgtttccggcgaacgatgcagctcgcggttggcctcgtcaaggcttaccgattcaagctcgggatgccagatacccttcagccagatcagtggatgcttgggttcgaaagcgcgaatgcgtgcggcgaacgagcctgaccgcgtctcatccagcatcaacgtcggacagacactggccacatcctcatagatgagcgtggagatgatcaaggcgtcgatttcgttgaacggcaagtcggcgaaggagcgcgtttcggtgtgcgcgtaatcgataatgccggtcatgcgcacctcctgcttccgttgatattgcatatccccttgggccatgtggtcttgcgattgcgtgcggccgtgcggctgcgcgcagcaattaaccatatgcattccattgtagggattgtacggttttggccggcgcgatcgagcaagactgcaccgacggcgaacaattcgtggaaggattcccgtcggcttgtcgaaaattgtcgggtagcagggttgcgatgccagccagccgaccaccctccggcgctacgcgccatctcccgccggcgggagggttaaccactcaatcctttttgacgaggcggaccgctgggcccgtcaaaggttcggcagatcgaagcgcgccagatccacgccctcgtgttcaagcaactcggccttgatgtcgagtcggccgccgtagccgccaaacgcgcggcccgagccgactacgcggtggcagggcacgatgatggtaaccggattgcgcttcactgcgcctccgaccgcctgcgcggccatgcggccgccaccgcgtcgttcggccaattcggcggcgagttcgccgtaacttaccgtcatgccatagggaatctcggccaccagattccacacttcatgttggaatggcgtgccggcgggatgcaacggcggcgtctgatctaggccggggcgctcgccggcgaaataggcggtcagccatacgcgggtcatacggaacacatcgggttcacgatcggattcgcgattcgaatcgagaacggcttggtgatcggtggcccaccaccagtcttcaagacagagctcggtcaggccctcgccgtccgaggccatcatcatccggccgatgggcgtttcgactgtggcccgcatcagttgtcgttgcgtcataccgccattatcgcgcgttgagggatgaagcccatactgtgcctgatttcatgaaggacgggtcgtgctgtacggtcagtattgcgtgccgggcagcgatatctgacatagtgggggttcttgggccggcatgagtgttctttccgacatcccaaccgtctaactccgtttcgaggggctgatttgggctgttccggaggtctatctccgtttcgaggggctcctcatccgggaaaccacaagtataaacggctccgggctaacgtcattacgccgtttttggcccgtgtctactcagccaccagccccttgaaacgggagtagacctccggagaaggccaaatcagccccttgaaacgcagcgacccctctgattggagtcaatcagaggggttcggcacattgctgatgcagctggtccgccgtccgccttgaggcggaacgtaaccaagattcaggcgggattactccgcaacgagcgccaggaaggcggcgtccacggcggctgtcgggttcgggaattcctcgtcctggttgaagaacggcacgtcggcgtagttcaggaacttcacttcggcacggtcgccgatcaaggccttggcctcttcggccagctgatcggttatcgtcatgcgttcctgatttccacggccatggccgtgcaatgtgcccatcgcttggttctacccgctgtttatgctggccatgcccatcgcctggctgctgtatacggccaccgcgagttatgtgcacggcggcacccgataatcgttggaaaaccggtgggacacgcgggggcttggctttttcctgagattggcgtatctttgtcacctgttgcccgtgaaggtaacacatgcggacatagcttagttggtaaagcgcaaccttgccaaggttgagaccgcgggttcgagtcccgttgtccgctctcggatggctggttcaggatgattgattcagcctgaggatgacccgggcggttggcgcagtggtagcgcacttccctgacacggaaggggtcacaagttcgaatcttgtatcgcccactcgatgaatcgccggcagaatgttgccggttttttcatcacaagctcgggcgattggcgcagcggctagcgcacttcgttcacaccgaaggggtcgtaggttcgattcctacatcgcccacccgatatcacgctcgtcagtctatgatggcgggcattttctatatctgccgtgccacggttcctcatatggcgtccggcctcgggtggcatttggctgtgagcggtttcgatcatgagtggcgtccggccgtcgtacaatcccgctgcgcgcggtgccgtttgggctgtaatacgggtgctttgaaccggccataactgcttcatatgtcccggggcttgtgtcgtgtgccgcggcgcgcttccatagtggatatggcggtgtggaaggggagccgccatacttacttacacaaggacgtcttggtccgccagggcaacgcgcatggaaaggggtttgcgatggtgtgcaccacgctgaatttcgcggagaaatacctgctgaaaaccgaagtcaggtccgttgccggtatgtccggcggtacttccgatgctggtactgatttcgatgtcgatttcggtggcgagggcgacctcggaagcgatcatgccaccggtttcaatcgctcgctatcggccgacgattattgggctgcagccggatatgccgatgagtcattgtattgatggacgtgatgacgcggtaagggcgcgtcgataagtgcggctggtgtcgcggctgatgccgcatctggtgctcgttcggtggtcgcggctgatgttccgtacggagcctgcaatggttttgcatcggtggtgcgtcaaaatccggaccgtcgccgacgctgtggacgtttggcggcgttgaaaggacagataatggattgtcaacgccgctgagaacgattggcgacggtggtgggacagcggatgccccaccaccgtcgccaagagtggtacttgtgtcggtggcgtccaaaacatggcccggcaccgacatcagatactctgaacgtcggcggattcccgttctgtgtcccagcgccgacgtttgattcctgcttatgcgagctggcgtcggtaaaaaggcagaacttggttcaccggcgatgtctcagcacgtttgcgcgcgtcggatccttctggagcagcaggaagacgagcgccacaacgagcaggacggcgatggagagcacgccgaacgaggcgttgccggtcagggacgtggtggtggctaccaggaaggtgccgatgattgaggccgttttagggaagaaacaatagtgagaccggggaacccttgaaatcattggggaatcatggtggcgatgcatgcgattaacacatgttgttaacacagatgtggaatgaggaggcgcgtgaggctcgtggtctgcgacgcatgagtgtgaccgtgagctccccagctgatgagcgcaaaggcagagattggtttcacgcgggacttgtctgccgaagagcggcgattgatgcagggtctgtgcgatgctctgcagcagttgctgaacaagcagtaccagcggcacatgtgggactgttcgatagcctgaaaaattttgccgcagacaatctaggcaatgtgcttggcggggatttcaatctcggttcgattggtgatttgccggcggtaatcggtgagcatttcaatgccgatcagttgggtgaaatcaacaggtcgttggcgaccatttgaacgccgaccgacttgacgagctgcaggcgctggcggaggaaaacatctccgccgaccagatcagtcaggtcgctggcgcaattcaggagcagggtgccaatctggacctcggatccattgccgaacaagcaggactgcccgctgacatcatcagccagatttccggactattgggcaagtagtcgccttaagctttaacgctgacggtgttgtctcggctattgcgtgttttgcggtcgctcagcaaatcatatgggtcgtaggtaaccgattgcgagcgctgctgtacacagatgtgtacgtgggtcgaagcggattcgtggtggcaggtgagacaagctgccctcgcatggctggaaaagcttcggtctcgtggagtgcgatgttaaagctgctcaggtcaacggaatggcggaattccgccgatgcaacttgtggttgcgctcgaataaccggcgattgcaacccaaagatggtggcgggtgacatggacggtatgccatagtgagcccatcggccgaacatgacatgataaagattacgtatgaagggacattccaatgagttttcgcgctaacctgcagtacctacgtgcgcaacgcaacctgacccaggaacgattggccatgttgcttggcgtctcgcgtcaggccatttcgaaatgggaatccgaaaaggcctatcccgagatggacaagctgcttatgatctgcgacctgttcggctgcacgcttgatgatctggtacttggcgatgtgagtcggcctgccgcgtcggcttctacggccggttcgtcgaatgttgactcctcggctgagacggcatcgcctttagccgcttcttccaaaacggcgggcataatcgctcctatcgcggagcttgcgcaggatatcactggctacgatgaacatcgccgccgattcgcgctgctgattgccggcggtgttgctgcgattgtcgccggggttggcatcggcaacctgttcgattccagcaattccattctcggagcgacgccgctcaacgattttctgacgtttctgtgcgtctgtgtgggtgtgattgcggggctggcgatgctgattccaggaggtctgtcgcgtattgacttcaaacggcgtcacccatacgtagaagatttctacaccggggaggaccgcagccgagaattgcggctgctggtaatcggcatcgtcggtggcatctcggctattctgattggcattgcggtgacggtgtatgccgatgacatgctcggcgtctccgatggctggcccaacgcaatttttctgctgctctgtgcgcccagtgttttcgggtttgtctactgcggcatgagatacagtctgctcaatatcaacgcatacaacaaagcggccgaggacgaccgcaaggagcatgcgggcgagcaggatttctacgccaaactgaccggcgcggtgtgcggcatcattatgctgatagccacggcgactggcttgtgcctgctgtttttgaaccctgcggcattgcgcggcgattggtcggccgtcgggtcgagcgccgcggacggggcgatgttctggctgccgtggccgattggcggtgtgctgtgcggcgttgcggccgtcgccattcagctgatcaaggattatcgcgagcgtaagtgatcaagtggcgatggtccattgctattagggcccgttgcaggggttgcgagatgtcgcccgcggcgcagagttgccgagggccggcaaatcactcccgcgtcgggtccttttgcaggagcaggaagacgagtgccgcgacgagcaggacggcgatggagagcacgccgagcgaggcgttgccggtcagggacgtggtggtggccaccaggaaggtgccgatgatcgaggcggtcttgccgaagatatcgtagaagccgtagtactcgttggcgtgatccttggggatgatcttgccgtagtacgagcgggagagcgcctggatgccgccctggaacatgccgaccagaatcgccagaatccagaactccacggccgacttcaggaagaacgcggcgaagaacacgatgcacatgtatgccacgaccgccgccgtgatcatcactttgcagccgaaccggccggccaaacgaccgtagagaatcgcgcaggggaaggccacgaactgcgtgacgagcagtgccaccaccagctgggtggagtcgatgccaagctcggcaccgtaggaggtactcatcgaaatcaccgtgttcacggcatcgatgtagaagaagaacgcgatcatgaacatccacaacggcttgttcttcacgattttgccgaacgtgcccgccagttcgctgaacgtgccgcgcacggccgagcccagctggtcacgggtggcgcgatagtgcacttggcggtagctggtaagcagcgggatggtgaatgccacccaccagatggcggtgatgatgaacgaggcgcgcgtgcaagccaccgtggaccagtcgaagagcgacgggccgccgaagatcagcgcgatgcagaagatgaacggcacggtggagccgatgtagccccagccgtagccatgcgaggagaccttgtccatgcgctcgttcgaggtggcgtcgatgagcatcgaatcgtagaacgttagcgagccgttgaggccgatggtcgccagaatgtagacgactaggaacggtagccaggtcaggggcagggccattgcgcagcaggtgaccacgccagtgccgaagaagccaaggaagaacttgattttcatgccttgcacgtcggcgatggagccgagcaacggcatgagcagcgcgatgaccaaggaagcaatggtttgcgcgtagccccaggcggacacgatgttgccgtccgccggcatcagcgatttggcgtaaatggggatgacggcggtggacagcagcacgaatgccgagttgccgacgtcgtagatgatccacttcttctcgcgggcggtcagtttggcgctttgcggcaccggttcgtggacattcgtgggatcagtcatatacactcctcgacagtattcaactcaatctatcgtagaagcgcggactagggtaggggagccattccggttgaacggcggatgaataatgccgggcctctttctaaggggagccagagcaaaaatagctcccctcgctgaggggagctggccgcgaagcggactggggggagctacctatagtcgactattcgccgatcagcgcgatggcctcgtcgtaatcggggcattgcggcacgccgttgaggctgtgctggatggcgatggatgccgccgcgttggcgatctttaccgattcggccagactatggccctttgccagcatcgcgcacatcacgccggtgtggcaaccgcccgccgaacgggtgtgtacggccttggtcgggtatccctcgatatgaatcgtctcgccacctggctcacgaatccaagcgccgcgggcgccgacacgcaccaccagcggcgcgcgcagtgtagcgcccaagccgtcgcacaactggtgcatgaagtcgtcaagtccgccgccaatggtgactttgctgtcgtcgattggcgcaccaagtcgctcggccagcgtcatggcctcctgacggttgcaggaccagaccgggcgtgcgagcaccaggtcctcaagcatatggtcgttgaccaaacgcaacgtattggtggggttgatcaccagcgtgtagtcgcgtgcagccgggtcggtaccggccttgagcaggaatccgtccacgccggtggccgtgtggtccatcagtgtgttgccgctgatgtgcaccacgtctttgggctgcggctccagcgtgtcgaacgtgtccgagtcgccatgagcctcggcgccataggaagcgatgaatgtcttcttcggcgcgccggagctcagcaccacgcggaagccggaatcctcatcaagacgatcctggccgatatgcgtaatgccgttgtcttggaatgactggcggatgaaatgcgcccacaggccgttgcccagaatgccggcgtgctcggtcggcacgcccatgcggctggccgcctgcagcacgcgatagctgccgccaatggagggcttcggatgatcggccacggcgaatccgccctgtgccggcaccttgtccacattgagcataatgtccacccagacttgccccagtgaaatcacgctgggctcgtgagtgccgatacctcgcttgagattcaacatgacagcctccttcgtcgtaagttgcacgaggaccccttcgtcccttgccgtctcttataccgagattatatgagagtttgctggatgcggaaaaggaaggccggcgtgttttatcgggtaaacgctatgatttgcagcgtaattcgccgctggcgaactgctgacgaactacttgcggaccgctggcgaaccaatgccgagccgctcgcgaaccgctgatggcccactcgcaagttacgctcgaaccgcgcgtgaaccgccgaggttcgcccatgatacacgcaagagttgcggttgtcggtattgggctatatatttgtgaagttgtgtgttcggcatgtcgggtgaaaccggcggtcgaatgcgtgaaagacttgacacatcaaggttaagggagtccatcatggcagctcgttgcgcagtgtgcggcaagggaccgcagaccggtttcaccgtttcccattcgcaccgtcgtaccaagcgtagcttccgcccgaacctgcagtctgtgcgcaccacgattgatggcgagaacactcgtctgcgcgtgtgcgtcaagtgcctcaaggccggcaaggttcagcgcgtggccgcgtgaatcgcgtactaacgtggagcaaaacccgtttgagcttcggctcagcgggttttgttgtttctgcggcctaaagaggccgtgcgaatagaataggccaatatgagcatcactatgggcaccactctcgcttcgctggtcaccaacaagcgtcgcgtgtccgcgctcaaatcgctgggaatcgtcactgtcggcgacgccctgacctactatcctttccgcgtcaccgaaccggtgccgcttcgcgccatccgcgaggccgcacccggccagcagatggcatttgccgccgtgatacgagatatgcgcgtggtgccgatgaacgctcgccgcggctaccgactcgaagcgacggtcgatgacgccgacttcgcccggtctcgtcgcgtacccggcagtacggcccggctcacgttcttctcgtatcgtaaatcgtatgtggattgggtcagcgtgcgactgcgcgccggcacgtctgtggtggtctccggtatgcccggcgaatacatgggtcagctgcagttcacccatcccgaaatcctcactgtcgcgcccgtgccggccggagcaggagcggggcttgagggttacgctcggggcgcggcatccggcaatggtgcgtttgcgggaagtgccgattcgtatgccagtgcgcagtccgcgtatccgccggccgcgactgccccttccggggccgcgttgaaatacgacgccgataccgtgcaagaggcgcttacccgcgtctgccggccccgcccggtatatcacgccagttcgcgtatctcgtccgaacatattcatgagacgattctgggattgctgtggatgatgggggcccgcacgtcatccacgcctgacgggcaactcgctggcgctggggcagccggcattgtggctcccgcgactgacaccatcgccgtccaaaacggggaagagaagtccggcacgaccgccgaatccggtgctgaggcgctctcccaatccatcccagatgtgctgcccgaatcggtgcgcaaggccaagaacctcatgcatcgggctgaggcgttcctggccattcatgatccggcctccacggcccggttcaaggaggccatcgaaaccctgcgctatgaggaggctttcgtttcgcagacctcgctgctgaagtctcgacagcacgcgcacaagtcatcggcgcatccttgcccgctgaacgaggcgctggaaacagctcgagcgtcggtgggcgaagcggttgcggagccaagtacgcaaccagaagcatcggagcgcggttctgcgaccgatctgcctgatctgcccaatttgcccaatttgcgcgaccgcttcatcgcatcgttgccgttcacactgacagccgggcagagtcaggtggtggacgacatcgcgtccgatcttgaacgtgactggcccatgcagcgtctgttgcagggcgaagtcggctccggcaaaaccgtagtggcgctcgcggccatgctgcaggcggtcggcgccggctatcaggcggtgctggtggctcccactcaggtgcttgccgaacagcattacgagaccatcagcaagatggtgtcggggttgacccttgcacagccgggtgccaaggagaccgatgccgcggccgacgttgagggcgcgatgggcgcgtccggtgcttcgacggtctcttcttccaaggtgactgcggaaattcccgtcaccctgctgaccggtggtatgaagcttgccgcccggcgtaaggcgctcgctgcggccgccagtggtgagccgggcattatcgtggccacgcacgcggcgttttccaagaccttccaagccccgcacttggccttggtggtgatcgacgagcaacaccggttcggtgtggaacagcgcgaaagcctcaacgccaaaaccgatgacggcaccacgccgcatctactggtgatgaccgccacgcccatcccgcgcaccgccgccatgacttggtttggcgatctcgatatttcctggctcaccgaattgcctggcggccgcaaaccgattcgtaccgtggtggtcaatgaggccgacgccgccaccatggggcgtatgttcgcgcacattcgcgcgcgagtcgacgcgggggagcgggcctatatcgtgtgcccgcgcattgatgcggatgatgaggagaacgaaggcggttccggcgtttcggcagcagccggttctgcccgcggacgcgccgcagcatctggttccagtgcccgcacagctgcgggcggccgtgcgacgcgcgcggcggccgatgccatcggcatcgacgacccctacgaaaccttcgacgaaaatggcgaaaccgtggctcgcccgccattgcatgcggtggccgaaatcgccgaccggttgcagaaacttccacagttccaaggcattcggtttgcgactctgaccggccgcgacaaggatgacgtcaaaacccaggtcatggccgattttgccggcggcgagactccgatcctggtgtccaccacggtgatcgaagtcggcgtggacgtcaagcaggccagctgcatcgtcatctttgatgccgaccgatacggcctctctcagctgcatcagctgcgcggccgcgtggggcgtggcggcaccaactcgtgggcgttccttatttcccgtgcggaacccggctccccggccgagcaacggctcgaagtgattcaccactcgctcgacggtgccgaaatcgcccaagccgacttggaattccgcggtgccggcgatgtgctcggcgacgcccaatccggcggcaagtccagcctgaagctcctgcgcgtggtcaaggacgccgacatgatcgccgacgcccgcacccgtgccgggcagcttctggccgccgaccccgaactggcaggtgaggtccaactcgccggtgccgtcctcgacttcacccgaggcaacgaaaccttcctgacctccagctgaggcacctccagctgaggctagggctgcgcccccgtaatcgcacgatatagtttttccgtatgccgatcgtgaggaaatcacggtcgggaagccctcgaatgtgcttcagtggaggcaagaccattcgtacatgaggtactcgaagtgcatatatcattggtgcgcttcgagcaccccattgttgttcatgattggtatgcgcagatgaacctgtacagtgaaagctatgcgtgtaatttctggacgattcaagggtgtggcgcttgctacgccgaaaacgggtacccggcctaccacggatcgcaccaaagaggcgattttctcgcacctcgactcatggggagtgctggatgatgcccgtgtactggacctgttcgccggtactggtgcgttgggcatcgaagcgctgagccgtggcgcgcgagaactcgtggccgtggaaagttcccggcctgcggcggcgctgattaccaagaccttggcgcagctacagaagaatcgttcgtgggatgcttcgctcaaggcccgtgtgctggtcaaaaaagccgagcaagtggctggcggcttcggcgaaccattcgacgtgatattcatcgacccgccctatgcctatgagaccgctgaatgcaatcagctactgtccgatctggcggcgggcagcgccaccaacgagaacacggtgatcatgctcgaacgctcggtacgctcggatgatcccactgcccccggaggctggcaaatcaccgaaagccgcaactacggcgaaaccgccgtcttctacatcgaatccgcggatgacgactcggatatagagcgttccgacgattccgccgcgtagtgaatctcccaccgtgtggtgaattaatcggcgagccggcgcggatgggcggcggagacctcccagcccaaggccatcagggtcttgcgatcggccttatccagcgccttgcaatccagtgccgcgataaggtctggccgaatctcggcggtgcgggccagcgcttcgtcgcggcgaaaacggtccaccttgccgtggtcgccggacaacagcacatccggcaccgcaataccgcgccacacggccggcttggtgtactggcgatgttcaagcagtgcgccctcgccggtgtaggattcctcaacaatcgaatctgggttgcccatgaatccgggcatcaggcgggtgatggcctcaagcatcaccgataccgctacttcgccgccgttcagcacatagtcgccgatcgaatattcgcgtacgtcgacgccttgggcgcggtagtagtccgggatgcgcgcatcgtagccctcataccggccgcagccgaacagcagatggtcggcatggctgagctcggtggcgtcgcgctgggtgaacaacggggccgatgggttcgggaagatgagcaccggtgcgccggatggggcgggggagccggacggctgcgagaatcccagcagttcgtccagacattcgctccacacttcgggcttcatcaccatgccggccccgccgccgactggcgtatcatccaccgaatgatgcacatcgtgggtccagtcgcgcaggttgtgcgccttgatctccaacaatcccttggcctgggctttgcccatcaggctgaggttcatcacctcaaagtattcggggaacacgctcacgatatcgatcttcatgtcatccagcctaacggtagcccctcccgcattacacggccaccactacactattgcggtgatgaatacgacgatgaacctccccacccgcaaaaagcccgaagtgttgtccccggccggcaacctgaggggcctgaaaaccgcggtcgattatggtgccgacgccgtctactgcggcggcaaagccttcggcatgcgatcggcccccaaaaaccttagccttgaggatttcgaggaaggatcgcgctacgcccatgaacgcggcgctcgcgtgtacgtgacctgcaacgtgctgccgcgcaacaacgagatcgaagccatgcgcgagtacgtcggccagctcaaagacaccggcgtggacgcgctgatcgtctccgatattggcgtgatgatgatggcccgtcaggtggctccgaatctggaactgcacgtctccactcaggccggcgtgactaattatcaggctgcgaacgccttctacgagcttggtgctcgccgtgtggtgttggcccgcgagatggacttgcaggccgtgcgtgatattcgcgccaacattcctgatgacctcgacatcgaatgcttcgtccacggtgctatgtgcatggccttctccggccgctgcctgttctccaactatctgaccggccgcgatggcaatcacggcgaatgcgcccagccatgccgctggaagtattcgatcgtggaagagaagcgccccggccagtacttcccgatcgagcagaccgagaacggcgcctatctgttcaattcgcaggacatgaatatgctggggcacttggatgatttgattgactccggtgccaccagcctcaaaatcgaaggccgcgcgaaaagcgcctactatatcgccgccatgaccaacgcctacaaaaccgcggttaatgaatacatgattcaacgcggttttgaagacgctgatggcaatgttttgaagcctttccatgaccgtgtgattcgcccgggcgaccccgattttggccaaggaaccgaagatcaagtgatgcgcaatgctgatgccgcgttcgccggtgtggccgatgagggatatgaccgtggctctgatactgcggttgccgattcggtcaccggctcggttgccgcagaacgtgaccgcgtgacggttgctgatgccgtcgactcaactgcctctggtacgccggccggcaccgccgtcgaacccgacggcatgagctctcacgcccgttccacgcgccgcaagtccaacaccgcggtcgaacagattgagaccgattggaaacatgcggccgttcgcccggccccacacgtcgaactgcccgaatggctgctcgaggaaaccgacaaggtggcccaccgcgactactccaccggcttctattacccggagcacaaggtcacacagaacaccgaccgctccgcctacttccgctcatggctggtagtgggcgaagtgctgagctggagcgcggacgaagacggacgtgtcacgctgatgagccgtaacaagattgagcccggtcaacaggtcgaattcctgctgcctggcgagagaccattggtctttaccgtgccggaaaccggcctgcgcgatgccgatggcgcgccagtacccgccatcaataatccggcgcacgtgttctcgatgccctgcccgcaccaggtgcccatcaacgccgccatccgctcgcgcaccaaaaagcccaccctcaaagccgaataacctaccactccgcccccgctgactggggggtggtcatgaaaatcatgaacaccgcccgcacccaagaaagaatgccttatgcctgaatacagcgaagaaatcctcgattccaacagcatcagctctaccgataaagccggtcgccctattccggtgaccatccccatcgcactggcccccggcatcaaggtggtgtacaccacgcgactgggcggcctgagcgccggcgattacggcaacctgaacctcggcggcaagtccggcgacgaacctgaggccgtgctgtcgaaccgtatcgcactcgccgaagcggtgcaagcccgcctatcgctggtctcccaagtacattccggcgtggctgtggacgtggacgactcgttcgtcatcaacacccccttcggcttcgacgtgtccggcacacatggtgagactgacactccgcacgtcatcgaggcggacggccaggtcaccgcacaatccggcatcgccctaggcatgttcgcggccgactgtctgccggtgctgctgggcgacccggtcaccggtatcatcggtgcggcccactgcggccgtcgtggtctggagcgcggcgtgatcggcgccacggtggacctgatgaagagcaagggtgccgacccggcgaacatcgtggccacactcggcccgcgcatctgcggcgactgctatgaagtgggcgacgagatcgccgaccagttcatcaagcgcttcccgctgaccaagacgaagacccgtttcggcggtgccggcatcgacatcgccgaagccgcgatgatcgacctcgctttcgccggtgtacatcaggtggtcgattcgatgccgcgcgtgcacgccgccacccagtaccttgaggaagacccggaactcgccgaactgtgccgtacggatggcgaaggcccggccgagctcgcggagcgcatcgacaacatcagccacagcatgtgcacgctcgaaaacccactgtggtactcgcaccgccgcgccgcgctcgccaacaaaacacacgaaggccgcctcctcgccctcatcgtgcgtgactaaacggagaatgcgagcacattccgtggagaagatgtgatgcagttcacggacggccagccctcaccctacggtggtgcctatgactgagagagatttcgatacccccgtcgagacgcctaccgtccagccggcccccgctcagggcgccaaaccggcgcaaaccgtgccggtggtggccgtggtgctggccgccggcttcggtacgcgcttcgaccccgataatcccaagcagcttgtctccgtgggcggcaagcccatcgtgtgctggagcattgatgcctttgaacattgcgaccgcgtcagcgacatcgtggtggtggtcaatcccaaggtgcgcggtgaagtggaaacgttggttggcgagatgggctacaccaaggtccgcgtcatcattgacggcggtgacgagcgtgtggacagtaccgccaccgcgctcgacatgctggctacggctggcattccggacgatgccaagattctgatccatgacgccgtccgtccgttcgtggaacagtccgccatcgacggttcgattgatgcgctcgaccagttcacggccgcaaccgtggcctacgcctcaaccgacaccgtgctgttgaccgaggatctgggcgatttgaaagtggtcaagtcggtgccggaccgcccgaacaccttccgcgcgcagaccccgcaatccttccgcttcgcgacgattcgtcacgcttacgatttggctgccgccgacccggacttccatcccaccgacgacacgcgcgtagtggtcgattatctgcctgatgaacccgtcgccattgtctccggtgcggaaaccaacctgaagatcaccacgctggaagatattcccacagctgagcgtatcgccgaggagattctcggtcgtgatcccaaggaagaggcccgcgcccgcatgcacgccctgctggcccaagcggccggccagatgcatcgctagactggcattatgcgtgaacttaatgttgtgatctccggcttcgaccactatgacggcgtggaggtcaatcccgccgtcgaagtgcccaaggccatcgccgagcagggactgggcgtctcctctgctccggacgatccgttggagcaggtcgccgtcaccgttcatgctgtcagcatcccggtgagcttcgccaaagcctggcccacgctgaaagagacgattgaggccaccaagcccaatatcgtcatcgccaccgggctcaagcacgcagcccgaggcgtgatgcttgaacgatgcgccaccaacctgatggacgcgatcaagccagacgcggacaacgtgatcccacgccgcgaacccatcgatcccaatggcccggccgcctattggacccgcctgccgttgcgctcgatcctgaatgatttcacggacgattcgattccggccaccttgagttcggacgcaggtacgttcgtatgtaattcgctgttctacaacttgctcaactggaccgccacccaggagcaggtgctgggcggattcgtcagcttccctccggtcgttccggcgcattccagccagcatggtctaccactcgaccagcagatcgccgctggccgtgatgtggtgcgcgaagccgtgcgctactatctcaagccctccagctccgacatcctcatcgcctagcacgctgtgcgccacgccggaatagaacatggttcgcacgcattgtaacgattgcgcgtcgctcaacgctcagcgctggtgcgatgcgctacagtgcttcaaggatgtgccaagagctttatgcgtgtgcgaaaggaataaacagcgatggtggatcgtttcccggtggtgctgcgaggatatgacaaggagaaggttgatgctgccttcgacgctactcaggagagtatgaagcgtgcgcagcagacgttggccagcatgcgtgagcagattgcggcggatgacgaccgtattctgcaactgcaggcccaacttcaggaagagaagaacaagaagccggaaggcaacagcttcgcttccttgggagcgaacgcccagcagatgcttgcctccgccgaacagacgagtaccgaactgctggaacgcgccaagcaggacgcgtcctccatccgtaccacggctcaggctcaggccgaaacactgatcaacaacgccaagctggatgcccagcatattgttgacgacgccaatgccaaggccgcctcgattctgacgaacgccagcaatcaagccgaatcagtgaccacctccgccaacgaggatgccgcacaactgcgctccgaaactgccaagaccatcaccgaacagcgtcagaccgtcgagcttgagctcagcaacgcgcgcgaagagcacactaagaagatggcttccgaacgctccactcaagagcgcgaaatcgccgacatgaaggcggaggcgacccagcaggttgccgcaatgcgcaaaagcgccaatgaggagatcaccaagcttaagtctgattccaacgatcagattgaggcggcgctcgccgaggccaacaagaagctcgccgacgtgcgcgagcaagtgtccaagatgatgaccgaagcccagcgcaaggccagcgaaatcattgatgcggccaaaaccaagggtcaggaaatcactgatgaggccgaggtcaagcgcaccagcacgatgagccaggtcaacgccgaggtcgagcagatccgtcacgacatcgccgctcagcaggatgaggccacgaagaaggtcaacgaactgctgcagcacctcgaagagcgtcgtgtggcggccaagcgggaagccgatgagttggtcggtcaggccaagaacactcgcgaccaagccgattcgtatgccgcgtccaagcgcgaggaggcggacatccaggccgccgcaatcgtacataaggcgggcgaggaagccgatgcgcagatcgaggagcgtcgcgccgccgcccaaagcgagcttgacggtctgtccaagcgcatcgccgatctgcaggaacgcgagtccgtcatcacccagcgtgtttcggaactgcgttctatgttctcgcaggcgttctccggattcgctttcggcggtaatgcggcggcctctggtcaggatcaggaagccgctgccgtggcggcattgccggtggttgcgcccgtcccggaagtcaagcctgtacacaacgaggccgatgaccagccgggtgagttgggcggaaacgagtcggctgccgacgatcacaatgagacagatgcggcaccggctgattcggctgattcggctgcgcagaatgagcagtccgaatcgtctgagccgtccgagcaccagacacagggcgaaccggaggccccgactcaggagaatccggccgtatctgagcagaacggcgaatgacaggccttcgattagactactagcggtaagaattacggcacctgcgctttcgagccaggtgccgtattcgtttgaatctgcgccacaagcgcaccatcacagaaggagtatgacatgagtgaattgacgcctctgaccggtgaagcgttgaataccctgcgcggcgatttcgcacagagcggcaccaaccgtctggccatgaacgcggtgaccgccgccggcatcgacaaggtggctcgcaattatgaccgcgctcgtctgatgcagcgtcgtttctccaccatcgttgacaatggcgaagccacccatcaggatcgctccggccgctgctggctgttcagctccctgaacgtggcccgtttcgtggccaagaagaacatgaacttgaaggagttcgagttctcccagaactacgcgatgtactacgacaagctggagcgcgtcaactacttccttaaggatgtggccgctctggtggctgccggagagccttccgactcccgcctgatgcagcacctgctcgccgacgtgatgggcgatggcggccagtggaccatggccatgaacgtgtacaagaagtacggcgctgtgcccaaggacctgttcccggagaccgaatcctccaagaacaccggtgaaatgaacatccagctgcgccacatgctgcacaccgccgtggcgcacatgtacgccgctgacggcgatgcctccaaggtcgaggcgattattgccgacgccactgctgccggccaccgtattctgaccatccacctgggcgagccgccggtttccttcgactgggaatggaccgacaaggatggcgaattccaccgcgacggcgagattacgccggttgagttctggaagaagtacgtgggtccggctgatcttgaggactacgtgtgcctggtggacgatccgcgcaccgagcacgccaagggcaagaagatcggcatcgagcacctcggcaatgtggctggcggcgacgccaccgagtacctcaacgtgccaaaccagttcatgaaggactgcgtcaagcagattctcgttgagcagggcattccggtatggttcggtgccgactgccacccgttcatggaccgtgagaacggcgcttgggccaccgacctgttcgagtacggccgcgtgtacgacgtggacttcgatttggacaaggaagcccgcgtgcgcttcggcgactccgccatgaaccatgccatggctttcgccggcgttgacgtggccgacgacggcaccacccgccgctggcgcgtggagaactcttggggcgccaagatcgccgacaagggctacttcaccatgtccgacgactggttcaccgaatacgtctacgaggtagccgtcccgaaggccctgttgcccgaggaataccagaaggccctcgaagagccagccaccatgctccccgcatgggatccgatgggcgctttggcctgacttcgtcagcctcccggaatcggcctgacggccaatgctgtgttttctcgcagcctgtcggctgctagggtctctccctctgtcagcgcgaagccgctgacagagggagagaccgcggtcgcaggccgcacaacaacacagcatcgccgcaggcgagtccacacaggcgagtccacccaaagtccataactgccggcccaacaagcagtccccgtaacaaactgctatagttgggcttttgcgtctatggcgacataccgacagtacgtatacaaggaaaggagtcgagcaatggcagcactacgtggtccggatagttccgaggatgaacgtcgtttgggggagcaggccgtctttcctgagaccgtcgatgtcaacattcgtcagcttgaccccattcccgcgccgcgtgctttcctcagggagcagccgctcaccgatgagatgagcgagctcgtgctccactcgcggcaggaaatccgcgatgtgctcaacggccgcgacgaccgactgctcgtcatcgtgggcccctgctcaatccacgacccgaaggccgcgcacgagtacgcagaaaagctggctgccgtcaagcgcgagttggaagaccgactcgtgatcgtgatgcgcgtgtacttcgagaagccgcgcaccaccatcggctggaaaggcctcatcaacgaccccgatctggacggtcgcttcaatattcgtaagggcatgtggctggcccgcaaggtgctcaccgacgtgctgagcctcggcctgcccgccgccaccgaatggcttgaccccatcaccccgcagtacatctgcgacgcgatcagctggggtgccatcggcgcgcgtaacaccgaatcccaagtccaccgcgaactggccagtggcctgtccatgccggtgggcttcaagaactccaccgacggctccatcaaggccgccgccgattcctgtttcgcggccggcttcgagcatcacttcctgtccattaacttggacggtcgcgtgatttccgccgaaaccaaaggcaacccggattgccatctggttctgcgcggctccagccacggcccgaactacgatgccgaatccgtgcgtcaagctctggaagacctcaaggtttccaaagcgtccggcccgagccagcatggcctcgtcatcgatgccgcccacggcaactgcggcaaagacgaaaaccgcgaagccgaagtcatcgaagagatcgctgagcgcctggcgcacggcgaacaaggcatcaccggcgtaatgatggaaagcttcttggtcggcggtcaccaaaagccggccccgctcgaccagttggtctacggtcagtccgtcaccgactcttgcgtgccgtgggaacgcaccaacgaactgctgcacaccctagccgacgccgtcaccgctcgccgctcggctaaatagctttgtctttgtaaaaatgctcactgagacccactcagtgagcattttttgccaataacggtggtcatgtcagtttgttcccgtgacaccttatccttgggaaggatactgacccaaggagagatgttatgcagcagcaggaggaagcagcacattcgctgcatccgttgcaagtcggtccgcagccgttgaacaccccagaagagcttcgcgccattcgtcaggcgatgggggaggggaagaacccgctcgttgccactgatgtgccgcgttgggaagatcaggtgggtgtcagtcgcatcatcaaccgccgcgtattggagttggagccgctgcccacgcccgcgcaagtgctcgctgaactcccgctgactgatcaggctcaggaaatcgtcgcctactcgcgtgatgagattcgcgcgtgcctgtacggccaagacgacaggctgttggtcatcgtcggcccctgttcggttcatgacccgaaggccgcgctggactacgcgcgccgattggccaagctgaaagatgagctcggtgaacagctgctcatcgtcatgcgcgtgtacttcgagaagccgcgcactaccattggctggaagggcctgatcaacgacccggatattgatggcagccacaatattcgcaagggcctgttgcttgctcgcaaaaccttgcttggtgtgctgaaggaaggattggcggccgccacggaatttctggagcccaccagcccgcagttcatctcggacgcggtgagttggggcgccattggtgcgcgcaacacggaaagccagatccaccgccaattggccagcgggctttccatgccggtcggctttaagaatgccactgacggctcggtgaaggcagcggtcaacggttgcttcgccgctgctcagcagcacacgttcttcggcattgaccatctggggcgtgcctgcgcagtcgagacccttggcaacccggactgccatgtggtgttgcgcggctcgattcacggcccgaactacgatgccgaatccgtggccaaagccatggaagacgtacgcgccgaaatgcccgccgaatccgcagcctcgcatggtctgattgttgattgctcgcacggtaactccggcaaggacgaacatcgtcaggccgaagtcgtgcgcaatattgccagcagaattgcagctggcgaacagggtattaccggcatcatgatggaaagctttattgaaggaggcaatcagaaggccgcgccgcttgatcagctggtctatggcaagtcgattactgacaagtgcatcagctgggaagaaaccgaggccttgctgcgcgagcttgcggaagccgtagccacacggcgttggcactgagttgcgtcatcggctctctcgcgggagcaatgcaacgaaacgtctctacccctcagcctgccattcggcggccacctcccctgacaaggggagccgaaagtgttgtgaaaggaacttacgtatgggtatgaaaactgtagctattattggcgcattggatgaggaagtggcgctgatcgccaaatcgctcacgcatgtgacgcacaccgccaagggcagccttgacatcgtgtccggcacggtcgactccttcggttctgacgtcatcaaggttgccgcaacggtaggcggcatgggactggtcaatgcggccgccaccacgcagctgctgattgacgagattgccccggacgccgtgattttcagcggcatcgccggcaacctcaacacccacctgcacatcaacgacgtggtgctcggcggcaccctgcgctacctcgacactgacatgcggctcgtaggccagtggaagcccggcactgcggacgctccggtggaggaattccactctgatgaccgtctgctggaagtcgccgacgaggcgcttgccaatgcgggcattacccacatcaccggcatcatcgcctccggcaactacttcgtggacacgccccaaaaggtcgaggaggtcatccgactcaccggggctgacgccgtggagatggaaggcgccgccgtggcacaggtcgccgcccgcaataacgtgccggcactggtgattcgtgccctttccgacaacgccgacaccgattacgaggtattcaaggagttcgacatctccgaatacgccgataccgccgcccgtctggctgtcgacatcgtcaagcgcctgtaactggtcacctccaagttcggcgttgccggtgtgggctggtacatggctatcatgactgccctcgctctgctcgctctgttcctgatcaaggaaagcaaggacaaggactacgagctgtaaatagagctccccatattatgctcccgccagcgggagcattttgttatgtcgtcccgccaaaaatgaacaatagacgaacttacgtagtttaggcatctcactacgcctcgcacgttttactctggaaatcatggatatctggcagatcgtcgtgattgtggtgctcgccgcgctgatactggtgtgggttgccgtcatcgcctacaacaaaggccgcgtttcaggccggctcgccgccgaacaggacctgtccggcgacgaggatacgcattctctattcggtgatgatgcgcccgtgcgccccaccgagcgtcgcctgattgaagtcctgcccgaagccctgatcgtcaccgaccgcaacggtctggtccaatattcaagccccggctcagtgccattcggcctagtctccggcgaccgactcaactcgcgtgaagtcgaggacatcctcactcaggccgccgccgacggtggcatgcgtgagcgtgaggttcagctgccggtcaatcgcaattcctatccgtcctctaatggccgaggactggaggccggccagtcacgcccgtccaacacgctgtatttgcgtgtgcgcattggcgatatcggcgatgacctgtacgccatcttcatcaacgacatgtccgagcagcgccgtttcgaggccgtccgccgtgactttgtgaccaacgtttcgcacgaactcaagactccggccggtgccatcgcgctactggccgaaaccgtgaccgacgccgccgatgatccggacgccgtacggtatttttccggccgtatctccaaggaatccgcgcgcctgaccgaactggtgcatcatcttatcgacttgcagaaagcccaaagcccgcaaagcgtgatcgatgcgcggcgcatttccgcgctggatgtggcacgcgccgccatcgccgccaatcagacccaagccgactcccgccatgtggatatccgactgagtgtcaacggacagtcagtacccacgaaggtcgaggagccggccgatggcgaaggttccttggaagaatcaggcagcccagccacgaacggtccgatgatcaaggccgacaaagaggccatgcaaaccgccgtcaagaacctcgtagagaacgccatccattactcgcccgaacacaccactgtggcggtcggcgtgggggagcgcgatggcaaagtcaccattcgcgtggtcgatcagggcatcggcatccccgccaaatcgctggaccgcattttcgagcgattctaccgggtcgacccggcccgttcgcgcgagaccggcggttcgggactcggcttggccatcaccaagcactgcgtgcaggagaacggcggtcggatttcggtctggtcgcgtacgggggaggggtcgacgttcaccatcgagctgccggccgccccggatgaggatgacgacgaggcccggtcggacgagtcgacacaagcgtagggccttggttggtgcccgacatggtgccattccattgccacacaatcacacagtgggcgaggtgcgcacaccgcgcgtagcccaattacgcaattacgtactttcgggaaacagcaggctaacggagaacaaatggttacgataatgtcggaaaactttgcgcctatgcgcacgggaacatacccaagaaaggctactatgacacgcattcttatcgtcgaagacgaggaatcctatcgcgagccgctggtataccagctcacacgcgaggggtacgacgtgtccgccgccgccactggcgaggaaggtctggaactgttcaccaagggcggcatcgatttggtgctgcttgatttgatgctgccgggcattgacggcactgcactgtgccgccgcattcgtgagcagagccgtgtgccgattattatgctcaccgccaagagcgccgaaatcgataaggtcgttggccttgagattggtgcggacgattatgtgaccaagccgtactctttccgtgagctgctggcacgtattcgtgccgtgatgcgtcgcaatcaggccactgcccaggcttccggcactgtggatgacgatattccgctggtgtgtggcgatatcgccatgcaggttggccagcatcaggtcaccgtacgcggcgaaaccgtgttcttcccgctcaaggaattcgaactgctcgaatacctcatgcagaacaagggccgtgtgatgacgcgtcaccagctgatcgaccgcatctggggttcggattatgtgggcgacaccaagacgctcgacgtgcatgtcaagcgcgtgcgctccaagatcgaggaagatccggcgcaccccaagtatctgactaccgtgcgcggtctcggatacaagatcgatactcccgcggagtaaatggaaggcggccttcgggtcgcctttttttgttgtggattgtgggctcgctgtggactcgccgcaggcgagcccgctccaaaaactacgtagcctcaacgtagcccacaaacatccaagtgttcatcttctgtttactgatttcggttttgggcccttgaaaccaccaatacgcttgtagttgtcatgaattgaccgggcagcgctgagccgcccgcgaatagttgatagagggattaagtaataatcatgcagaagaacatcctcgttcgctccattgccgctctgtccggcattgtgatgctcgcttccgtggccgcctgcggcgataacaccgccaccacgaccgacaacagctcctcctccgattccacttccaagtccaccccgatctccggcaacttctcgggcgccggcgcctcctctcagcaggccgctgttgaagcttggatcgccggcttccagggcaccaaccctgaggccaagatcgcctacaacccgtccggttccggcgctggcgtgcagaccttcctgaccggtgccaccgcttgggccggctccgacaaggcccttgccgatgacgaagttgagcagtccaagtccgtgtgcactgaaggcaccgccttcgatgtcccggtctacatctccccgatcgccgtggttttcaatctcaagggcgtttccgatgccggcaagcacatcaacatggacgctgccaccatcgccaagatcttcgacggcaagatcaccaagtggaacgatccggccatcgccgatcagaacaaggacctgaagctgcccgacaccgccatcaccgtggtgcaccgctccgataagtccggcaccacccagaacttcgtctcctacttcaaggacgtcacccctgacaactggacctacgacctctccgagaactggccgaacgaggttggccagggtgccaagggcacttctggcgtgatctccaccgtcaagcaggccgacggcaccatcggctacgctgacttctctcaggtcggcgacctgggcaccgtggccgtcaaggtcggcgacaagtacaacgagatttccgccgaggccggctccaaggtcattggggattccaagcaggacgacaccgttaagggtgacaaccgcatcgtcatcaagatcaaccacgccaccgaggccgagggcgcttacccgattgtcctggtctcctacgacatcgtctgcccggcctacaaggacaccaagcaggctgagttcgccaaggcttggctgacctacgtgacctccgacgagggccagaaggccgctcaggatgccgccggcaccgctccgctgccctcctccctgaagtccgagatcaccaagtccatcgaggccatcaagaccaagtgatgacgtcggcccgcaagggtcgtgtggactggacctgacaactgaacgatagactgtagtagtaagagcagtcgccgccaactttaagccgcagtcgtaaaccatacggctgcggcttaaagcgggtcaggacccgaacggtttggcaacgtcacagacgaaaaccgcaccacttgaatacttgataaccaccctatataaggagaatccgtgagttcgcaagacaaaacggctgtgcagccagttggtggcaagaccgccgacaaggtgtttcgcggtgtggcatacgcctgcggcatcctgatcctggttgtacttgccgctgtgttcctgttcctgttcttccgcgcctggccactcatcggtggcgatcaggccgccaacagccagaccgtgtccagctttaccggcggcaaggccagcagcttctggggctacgtgctcccgctgttgttcggtactgtgctcgtgtctttgctggcactgctgattgccttcttcgtgtccatcggcattgcgctgttcatttcgcattatgcgcctaagaagctcgccaccgcgctgagctatgtggtcgatttgctggctgccatcccgtccgttatctacggtttgtggggcggcctgattctggtgccggccatctacccgttctggaactgggttgccaaccacctgggcttcattccactgttcgagggcccggccgccaacccgccgcgcaccgtcgccaccgtggctgtggtgctcgccgttatgattttgccgattatcacctccatgtcccgcgatatcttcatgcagaccccacgcctgcacgaagaggccgcgctggcgctcggcgccaccaagtgggagatgattcgtctggccgtgctgcccttcggcaagtccggtatcgtgtccgcctccatgctggctctcggccgcgcgcttggtgagacgatggccgtgttgatgatcctgtccccgggcctcaactactccatcaagctgctgcaggcctcgcagaaccagaccatcgccgcgaatattgccgcacagtaccctgaagccaacgatctgggcgtctccacgctgatcggaactggtctgattctgttcctgatcacgttcgtggtcaacttcatcgcccgtaagcttaccgagaaagcgactgcgtgatgactgctgctgagaacactgaaaagactccgatggacggcgcgcccgaaatcgacttcgatcgtttccgcccgacccgttccgccatccagcgccgtaatatcatggaccacttcatgcgggtcctgatcgcggtggcgtttgtgatcgcctgcatcccgctgatctccctgctgtggaccactatcgtcaacggcatcaagcgcctgaacctgaacttcctgagctacaacatgaccggtgtggtcggtggtaaccagaccccgtccggtggttacggcggtgtgctgcacgccatcatcggtactctcgaaatcaccgctggcgctatggttatctccattccgatcggtttgatgtgcgccgtgtacctggtcgaatactcgaaccgcggcaagctcgccaccacggtctccctgctcatcgacgtgatgagcggcatcccgtccatcgtggccggcctgttcgccttctcgatgttcacgattctgctgggccccggtaccatcaacggtttcgaaggctccgtggctctctccctgctgatgttgcccaccgtggtcaagtccagcgaggaaatgctcaagatcgtgccgaacgatttgcgtgaggcttccttggctctgggcgttaccaagcagcgcacgattaccaagatcgtgctgcgcaccgctctgccgggcatcgtctccggtgccattctggccatcgcccgcgtgattggtgagaccgcaccgttgctgatgaccgccggctacatctccagcaccaacgtgaacctgttctccggccagatgaccaccctgccggtgttcgtctaccaggagtactcgaagctcagcgcgaactgcccgcccaacgccgacgccacctgcgtgaccacgattccgatggaacgtgcgtgggctgcggctctcgtgctgatcgtcatcgtgctgctgctgaacctcattggccgaatcgtggcgaaggtcttcgccgtcaagaccgaacgctaagccagtcgctaagcctaagccttaagaacacaaggaaatataaggaaacatcatgggacaacgtattgacgtcaaccacgagaacatctactacggcgactttctggccgtggaagatgtgaacatcaacatcgagccgaacaaggtcacctccttcatcggcccgtccggctgcggcaagtccaccgtgctgcgcaccttggaccgtatgcacgagatcatccctggcgctcacgtcgagggcgaggtgctgctcgaaggcaagaacctgtacgacaaggacgtggatccggtggccgtgcgccgcgacgtcggcatggtcttccagcgaccgaacccgttcccgaccatgtccatccgtgagaacgtgctggccggtgtgcgcctgaacaaccaccacctggccaagtccgacgccgacgatctggtcgagtgggctctgcgcggtgccaacctctgggaagaggtcaaggaccgtcttgacaaccctggcatcggcctgtccggtggccagcagcagcgtctgtgcatcgcccgcgctgtggccgtccacccgcaggtgctgctcatggatgagccctgctccgctttggacccgatttcgaccctggctgtcgaggatctgatcgacgagctcaagagcgactacaccatcgtgatcgtgacccacaacatgcagcaggccgcccgtatcgccgactacaccgccttcttcaacctgaaggccgtgggccagcccggtcacctcgagtacttcgcggacaccatcacgatgttcaacaacccgcaaaacgaagaagccgagcgctacatctctggaaggttcggctgatcgtttcctgcgcgcagcgtaatgatttgtgcgtaggagaaacggcaaagcccgccgcaaggcgggctttcgcatattcaacgcgagtattgccgagtattatcgttctcgcaacggagcgagctggaatactttgtcggactgggcggcgacttcccgcttcggtcgatcgacgggagaacggcgggtaaagcggtacaagacaagtccgcacgatgaatactccgtgataaattttctgttaacgtgcgagtatggaagaatggtcgcagcgaggtccagcaaaggagcataggtgagtactggtctgatcgtcagcatcgtcgttgtcgttattatcgttgtcttgattggttggggcgtcagcgcctataacaacctggtgacgctgaagaaccgtgtgaagaacggttgggcgcaaatcgacgtgcagttgaagcagcgcgccgacctcatcccgaacctggtgaataccgtcaaggggtacgcatcccacgagtctgaagtcttcactcaggtgaccgccgcccgcgccggcgtagtggctgcggccagcaacccgagcacgaccactgctcagcgcgccgccgctgaaaaccagctgtcccgcgccctgttcaacctgcaagccacggctgaggcatatccgcagctgcaagccaaccagaacttcatggatctgcagaaccagctcaaggaactggagaacaagatcgcctacgcccgtcagttctacaacgacgtggtcctgaagctcaacaccgccatcgaaaccgtgccgacgaacatcatcgccggtttgttccactttgaacaggcgcaatacttcgaggccgatgatgcctcccgtcaggtgccacaggtccagttctgacccgctccaggcccgtccggtaagccgccggccgggcccgtattgtcttaagagagggaagatatgtggatacgattcattcgcgccggaatcgtcagcattgttgccacggtggtgttggcagttatcaccttggcgataatcgagacttccgcgttcggcgattcggccgacctcagctaccgcacgctggactatgatgtggccgccaccgcgaacggtgatttgaaggtcacgcagcatatcgacgtcaagatgcgtgagcgtaccgacagtgacgacaacaccaagccgtggaagcagctgtttcagcaatacacgctgaactccggcaccctgactgatatcagcgatatcagcgtgcgcaacgtcacagacggcatcgactatgcccaacagagcgagcccaagctgcccagtgacgtcttttccgacaaggaatggaacagtgactacgccaaccattggtatgtcgccgatgtgagcgatggcagcgaccatccaaaggcatacacgcccggtaccgatggcctcaagcccagcgcctccgccaccgaagatgacacgaccgtggagatcggctggaatattccggtcaccaccgaggccgacagtatgaagttcgacgtgagcttcaccatgcacgatgtggccaccaaatggaaagacgtggcctccttccaatgggagccgttcggcaagaagaaccaagtgcctatcggcacggtcaccggcaccgtccacttccccaacggcatcaccggcaaaacctcatgggcatggctgcacaccgagcgcacttcggaaaccaagcgcaacagcgacggcagctacacgttcacggcctacaacatccacaatggcgactacctcgatgtggtcgcggcgttcgatgccgccaaagccaagggcatcgcccgcaagggaaccggcaatcatctcaaggacctgaaacaggacgaatataagcaacagcagcgctggctcgacaagcaacgattcgctgccagagctcgtctcgtgttctggattgtcagcatcgtgctcggcatcgcgttgtgcgcgtggggtatctgggctgtgatctccagcaaccggcgtgcgcaataccgtggcagcgtcgaatactggcgcgaccagcccggcatcagtccggcttccgcagcccgtctgattcgcgtggtcgatccgtcgacgcgccaatccgatgaagaccgccagctgaccgccaccatgctgtcgctcgccgtcaagaaggccattgccgtctatccggggccgtcggacatgtatcgcggcatcgacatgagccaggccacgccggtgggcttgagccaaatgattgccgccgaccaaggcaagcagtatgcggcaggcatcaccagcaccatcgtgattctgccgctcgccattgatgaggcacccaacgcgcaacagttgggattgagcgaatcggaagatgcgctgctgaacctgctcatcgtcatttcgcagcgcgtgggcagcccggtattcgacctgaaccagatgaaggcgacctgccagaactggcaagacggctatattgagctcggcaaattcaccggtgcatgcagcatggaataccagcggctgggtgccacgcgctctgtgggctggcaatggatcctacccggcgtattggccgtcgtgctgggatttggttcgctgctggccaacagctttatcggatacccggtggctggtcttatcgagctgccgatattcctggtcggcctgttctgctcgatggccggcgcggtgaccgtgctcaccgaccaaggccaggatatcgccggccggactctgggccttaagcgttatatggaagacttctccaacttcaccgaccgtggtgccgccgatttggccttgtgggattggtatatggtctacgccgccgcgtttggcatttccgatcgcgtgatgcgtgagctggccaaggcctatcctcaggtcaacgatccggcttggctggatgccaacgcctccaactcgttgttctactggaactaccgcccgtatggctggtacagccaccgccacaatgacgatgctgccgggcagatggacccgggcattagcggcccagctccggcttacggaggcacgtcgtttgccggcggattctccgacctcggctcgcagctgaactccggactcgctgacatcagctcgaccatcagcgcggcagcaccatccgccgattccggtggcgatttctccagcttcggctcgggcggcggctccggtttcggtggctcgttcggtggctcgggtggcggctcgttcggcgggcggtaaatccagcgttctgcttacgctggaatcggacacagaccgtctcattactgttgaagggaatcaccatggcattgttccgtaacctcggaccgttctccaccaccgccatcggccacggcgaaatgccgctgaccatcgaaaacaatcgtggccacgaggtcggcatcgaaaccctgcatgcctcgctggacgccggctgccgtcacatcgacaccgcttgggcctactactgctccggcggcgaagaacagaccggtgaaaagctggtgcgcgaggcccttgagacctggaaggggccgaaggacgaggtgctggtggccaccaaggtgggccacttccgcaacttcaccgacggccgccccacgtgggatgtggacggtcgcccggagaacctgattcgtcgcggcaaggagagcgcactggcgctcggcgtggacaccattgacctgctgtacttccaccgccccgatccgaaggtgccgtacaacgagtccgtcgaagccatcaagcagctggtggacgagggcgtggcgcaggaggccggtatctccaacgcctccatcgagcaaatcgacattgcgcgcggcattctgggcgacaagctcgtggccgtgcaaaaccagtactcgccgattcacctggagacccaggacacgctcgactactgcgccaaggttggcttggccttcgtgtgctggagcccgctcggcggctaccgtcacccctatgatgagaccaagttcgacccgttccgcgaggtcgcggcggcccacggcgtgagctaccagcaggtcgtactggcatgggagctcgccaagggcgaccacatgttcgtgattcccggcgcgcaccgtcccgaaaccatcctcgactccctgaaggccgaccagctcgaactcacccccgaagaactcgccaagctcggctgaactttctcagctccccttgtcaggggagctgtctcgcgtagcgagactgaggggtagtcgccggagtagtcccgggtagttccacaaggagataattgtgcgcaaaaaactcatcctcgacctcgataccggcatcgatgacgcgctcgccatcgcatatgccctaggcagtgccgacgagatcgatttgatcggtatcacggccacctacggcaatgtcgcggtgccgctggccgcgcgtaacgcgctggcggtactgcacttgttcggccgtgacgacgttccggtctatcccggagtcgaccatcccatcgccccggcaacattgccgaaaatgcgtggcaccacaccagacgagcgggcccaggcctacgcgcgctggcagaacggcggcgcggacggctggcaaacggacgcttcgtggtcaccaactcccggctcggtggcggtccaccattccaacggcatcggcggcgcaatcatccccgactccccgcgcgctccggaagcaccaggctcggcggtcgatttcatcatcaccgccgcgcgcgaatacggcccggacctgaccatcgtacctacgggcgcgatgaccaccatggccaccgtattccgcaacgctccggacctgaaggattccggtgtgaacgtgacgttgatgggcggcgcccttacattgcccggcaatgtaagcccggccgccgaagcgaacatctcccaagacccagaggcagcagactatctgttcaagtgtggcgcacgcaccaccatgatcggcctcgacgtgacccaccagaccgcgctcactcgtgagaaagcccatgaatgggcgtctctggggacgccagccggcgacttcctcgtcaccatgaccgactactacatcgacttctacctgaagaaccagccggagattcgcggatgtggactgcacgacccgctggccgtggccgccgcgctcgacccatcgctggtcacgaccttcgggttcaacttgcaagtcgatctcgagggcccgttccgaggccgtaccatcggcgatcgttcacggcttcaggaccccgacaaacacacgcaggtcgccttgggcgtcgatgtgccggaattcctggatcgtttcatggggcgcgtcaccgcggcggcccggtgacgcggacggcggccgtccggtccgctccacgccgtggatggatatgacccatggcgtggagcgcccttttgggaaccgacagaacataggggggcgctgcatgcgcagcgcccccctatgtgtcagatcatgccgcagcccggaatcaggccgccgggcggatcgagcgtgagatattgctcctccagatcgatgtcggggaccaaggcctccacgaacgggaccaacgcggtcttttcgaccacatcctcgcccttggaattctggccggttaccaccggctcggtcaaacgaatcttgagcagggattgggcgggggagtcgatcacatccaccactttgccgaccacttggccggcgggcagtcccagaccgttgccctcgactagacgggcctcaaggccaataagatccttgggataccattcgtcggcctcgagcatgtcctccgcatcgtcgacctcgccgtagagttcgacaccgtttagggcctcggcggcattgcggtcgtcgacgccctcaagcttgagaatccaacgatccttgaacgtgcgcgagccctcgacgatgtactcggtctcgccatcctggctgtagagcacggagtccggctcgaagcgccactcgggatcatcggtgtacaggcgcacggtgacttcgcccttcaggccctgtgcgcggccaatacgagcgaccctcagcaactcgagctgctgagggtcgtcgtgcatgtcttgctgtgccatgctgtgaatcgttccttatcggttatcgacggacgtccatgatgtcaacgcggaccttgtggtcagacagtgcctgaatcacggtgcgaatcgcgttggcggtgcggccgccacggccgatcacacggccgatgtcttccgggttcacgcgtacgcgaagcagttcgccgcgcgcgttctcatgagacttgacggaaacatcgtcgggaaaatcaacgatgttcttgatgaggtgttccacagcttgtgcaagcatagctagcctttcgtttccgctcaggcctcagccggagcttcttcggcggcctcttcagccggggcttcctcagcggcggcagcggcttcggcttcagccttggccttggcagcagcttcggacttggcggccttcagcttctgagcctggtcctcaacggccgcgatgcgggcctcggcgtccgggccagcctcaacggtcttcagggtgccttcggcaccttcaaggcccttgtacttctgccagtcgccggtgatgttcagcagcttgaagacgggctcggacggctgagcgccgacgccgagccagtactgagcgcgatcagacttgatctggatggtcgagggctgggtgttggggttgtaggtaccgatctcctcgatgaccttgccgtcacgcttcttgcgggaatcgacgaccaccacacggtagaaggcgtagaacttcttgccctgtcgcttcagacgaatcttggttgccaaaatggctctccttgtaatgctaggtgtgcgggttctcggtttgccatgtggggcatggccgtccggaatccacgtgtcctcgcggctcggggtgtagagggcgccacgcgcgcgcgaataactggcctattatagcgcacagggccggactgggcgtggcgcactgtggttgcggtgtggtgcgcgttccccgttgcgcaacattccggggaatgtatcgcgaaaatgccggctatcgcagtgcaagcgttgcggtcagggccagatgatcagtgccctcgacctcaaacgacttcacgccggacggtttgagcccgggagtgaacagcacgtgatccagctcgatgcgcggccacttgagccagctcgggaaggtgagattcgggccggcggcttgaatcagacttgcgtccttgaatccggacttgagcaacgcgcggaagctcggatggtcggtgctcgagttgagatcgcccataacgacgacgatattgcgattgctgacggattttgcacgggcgagttctcgcagacccagaatgccggccgaccaatccgcgcagccgcgcatcggcgatttcgggtgagccgaacaaagcgtcaccgtgcgattaccggaggttttgagggtgatggcgggaacgtcggcggcggggatggagaccacgttgggcaccgctgcgctcggctcgtagcgggaatagatcacgttgaatccgccattatcggtctctttggcgtctccgaactgatggtaggggagaagttcgttgatgtcggcttcggtaagacgtgtgatgaggtcgtcggtgacttcctgcaaggccaatacgctgatattgcgttcgcgaatattgcgaatgatttcagcggcgtcggcgcgtccgtatcgacaattcatcgtcataaccgagaactggggcgagagtgtttcacgcgttgtttcacagtgtccatcggagatggtttcgggcccttccttcggagtgtttgaggtacccgatgtattgctgttatggctttttgacagcgtcggcgaagttgtttcacgggctgtttcacggtgggattctttgcgtttcccggccgggtcgattgacgtaccccagtagttgatgcgctgtgagctggcaatcagcgcgaccacaataagcaacgacatcgcagtccattcatgttgccatgcggcgaccgcggccagaatcatcaaaggaacccacaacagcggcgtcagggcaatcatgtacggaagcggcatacgggcctcgagaccggcgggcagcgcgcttaaggtcgtccataacagtgcgatgattgccaccgcgctgaggattgtcgtcatggaagttcctttcgaaatataaattgaaccgagatataatttggctcccctctgcgaggggagccaagttgtgagatcagcgaccgaacagtccgccaaggcctccgccgaggttcggcggcagttcagtgccaccgtcgacgttgcccatcatctgctcaaggccagcgggcagggccgggttctgtggcttcttggcgaaggcggaaccgccggtcgaaccggaggacttgccggccagcttatcgcgcaatgccttctcctcggcctcgcgcttcatcggattgccggacttgccgcccttcttcttgttcttgcccttcttcttgccgccgcccatagccgggccgccgaagccggggatgccgccgcccatgccgccacgattggacatgcgcttcatcatctttgcggcctgctcgaaacgctgcagcaaagcgttcacctgagaaaccgtcacgccggaaccataggcgatacgggcgcggcgggaaccattgataatcgacggatcgcggcgctcggccggggtcatcgagcgaataatcgcctcggtgcggtcgatttccctctcatcgaactgctcgagttccttgcggtgctgggccatgcccggaatcatgccgagcagcgacttcattgagcccagcttgcgcacctgctgcagctgatcgaggaagtcgtccaggccgaaggaaccttcggagattttctcggcggccttgcgggcctcttcctcatcgaactgcttctgcgcctgctcgatgagcgtcatgatgtcgcccatgtcgaggatacgcgaggccatgcggtccgggtggaagacctcgaagtccttcaggccctcaccgttggaggcgaacaggatcggcttgccggtcacggacgccacggacagcgcggcaccaccgcgggcgtcgccatcgagcttggagagcaccacgccggtgaagtccacgccttcgtcaaaggccttggcggtcttgacggcgtcctggccgatcatcgcgtcgatgacgaacaggatttcgttgggacgcacggcatcgcgaatgtcgcgagcctgcttcatcagctcctcgtccacgcccagacgaccggcggtatcgatgatcaccgtgtcgtagagcttctgcttggcgagttcgatggaatcgcgggccaccttcaccgggtcgccggaggtctggcccggagctgcgacggcctcgccgccatcggattggacgcccttttcgggagcatagacgggcacgccggcgcgttcgccgaccacctgcagctgcgtcaccgcgttcggacgctgcaaatcggccgccaccagcagcggcgtgtggccggaatccttgagccagtagccgagcttgccggccagcgtggttttaccggcaccctgaaggccggcgagcatgatgatcgtcggcgggttcttcgcgaagttcagcggacggtcgacgccttggccgagcacgtcggtgagctcctcgttgacgattttcaccacctgctgggcggggttgagtgcgtcggacacctcggtgcccagtgcacgctcacgcaccttgccggtgaaggaacgcaccacgtcgagcgccacgtcggcgtcgagcagcgcgcggcggatttcacggatcgtgccgtcgatatccgcctcggaaagcttgcccttgctcttcagatgcttgaacgcattcgagagtctgtctgtcaaagatgaaaaagctgccataatgggcaacagtctagccgccacgcgggaaattgcggtgttggggacgacgcttttcggggaatgtgccgcgtagtagtcagggatgttgggcattcagacggcaaatgccgtgccgtccgctcgtggcgaagccaatcgagtgcttccgataccatggaaaccgtaaagaatcctgtgttttttggaatacttacgctgttttgaaaatcgctggacaccgcttatacgcagactgccgtgcgctccgaaccatgacgttcgggccaacgcagacatgccgtgcaataaggaaggcccactgatgcccacccaaaaactactcgaacgcaaagccctgatcgttggtatcgtcatcaacgtgctgcaggtcttagccggcatggccgtgttcttcatgaccggtctcaaggccatgttcctcgacttctccttcaccgcgatttccgtcctgtccggaatggtggcggtgtacctctcgtcgcgcacggtgcgaaccaccgagcgcttccccaatggcatgttcgcactggaacctatctacgcgatctgcaaggccattttcaccatgtcgttgttggtgtattcgctgattgacgtgtgccgagtagcgtacgactacttcgtgttcgggtccggcgaacgcattgaaaccggcccggtggtcatctacgagatcctgaccgtaatcgtgtgcttcagcctatacacgtattaccggcgctccaaccgatccatcggcgattccagcaccatgctcaccgccgagtgcaagagcacgttggtcgacggatcgatgtcgttcggcatcggcgtagttgccatcttcctgatgctgctaccggccggcggtccgcttgacttcctgcactacaccggcgatttcttcatcaccgtggctttggtggcattgaccatcaaggagccgttcagcgtgctcaaagaggcgttcgtggaattggtcggcggcgtgcatgacgacgatgaaaccaacgcctacgtggaggccgaggcacagcgccatctgcctgccaacaccgactacgagcagacgctgatcttcaagaccggtatgaactacaccgttgacgtgtatctgagcggcatcggcgaaaccattgatgtagctgacctcatcgaatgcaagcgctcgctggaaaaggagctcagcaagcgcctgcacatcgtggacgtggacttcgtgtttgactgattgatgggtttgaagcgactacttcagactccaagtggaaccctgcgggccgtcttcgatggcgatgccggcctcggtcagggcgtcgcgaatctgatcggccttggcgaaatccttggccttgcgagcttcggcacgggcgttgagctgttcggcgatcagtgcctccagcgctgcatgctcgggcgactcggccgtgccatcagcggcaccgccggcagcgccggcggacacccacggttcggccagcgggtccaggcccaaggtgtcgagcatggcacgcacggcgagcagcgcctcacgcacctcggccttggcggtttcggaatcggcgcggtcagccagctgtgaaagcaacgtattgccggaacggatggcggtgaagatcgcggcggttgcaccagacacattgacatcgtcattcatggcggccacgaaatcggcgggcaaatcgtcggcggagacggcagtgacttcctcgcgagaaggctgtccacccagcgccacaccggcacgctcgatgaagttcgagacgcggtcgtatgcggcctgcgcctcgaccagcgcctgatcggaccattcgagcatcgaccggtactgcacggagcccagggcgtaacgcaccacccaagcggaatgctcagccaacacgctcggcacggacaggccggtgcccagcgacttcgacatcttctcgcccttggcggtcacccatgccgaatgcatccagcgcgcagcggaggggtagccggccgcacgggtctgagccatttcgttttcgtggtgggggaagcgcagatccaagccgccgccgtgaatgtcgaagccatcgcccaggtaacggtgggacatggcggagcattcgatgtgccagccagggcggcccacgccaaacggcgtcgaccaacgggcgtcctcgggatcggtgtccttcggagccttccacagggcgaaatcacgcggatcatgcttgtcgggggaggcatcggccgggtcgaccggattgtacttgtcggcaccggtggcgtccacggacgggcccatgcggtcggccacggcggcggcctcatcgacttcggaggtctgcttctggtgagtgagttcgccgtaatgcggccaggatgccacatcgaagtacacgttgccggtgggcttgccgtccgcatccgtgaccacatagccgtgaccgttgtcgagaatgcgctgaatcaggtcgatcatgtccgacatgtggccggtggcgcgaggttccacagtgggcggcagtacgccgagcgtgttgtatgcctcggtgaattcgcgctcgtagtaataggcgcgggcccaccaacgctggcctgcggccgcggccttaacgagaatcttgtcgtcgatatcggtcacattacgcacaaaagtgactttgtagccgagcttcaaaaaccagcggcgcacgatgtcgaacgccacggcggcacggatatggccaatatgcggtgacgattgcacagtcgcgccacacacataaatgccgacttcgcccggcttgagcggcacgaaatggctgacctggtgcgaggcggtgtcatacagattcaggccttctgcggccttggcaacatgcaccggcgtcaggcttgaaggcatgacggaaatgttgaaatcctgcggttcttggctgtttcccataacactcaagcgtagggtccgaaccagacatgctgaatcgttactcgaagagtttgatgaacgcttcacaggtggggcccgaacgaggtgacagacggatgagaagcgggacaacagtctcgcgagaacacgtctttgaccgctgcggaaactgcgagattcatggatttgccctgctcgttacgcaaacggggaacgctcgtgccacaatagaagtcatggccacaccacaagtgctcattttgcaacatgtcccatgggaacgcccgggacgcatattgtcgaacctcgaggacatcggtcttgagacggtgacgatgaatatcgtcgacaaaaagaaaccggacttgcctgatttcggcgaactggctggcgtggtaatcatgggtgggcctatgggcgcgcttgattacgacaagtatccggggctgaaggcagaagccaagttggcgcgtgccgccgtggcttcaggcaagccgattctcggtgtatgcctggggcatcagattatcgccactgcgcttggtgcgcagctgcgcaagggcgatgcgccggagattgggttcgcgccgatcaagcgtgtggacaagcatgacttcttctccatgtgggataagcagctgacagtgctgcactggcataacgacgtggtgggcctgcccgcggaaggccagctgctgtcgcgttcgtcttccaccaaggtgcaggcattccgactgggatccgcgctgggcatgcagttccacctggaagtgtgcggctcgctgctggacgaatggctggatgagccgagcatggtcaaggatctcaaggccgcgggtggttccaagtcccaattgcgcgagcagttcgcccaatacgaccagctactgcaaccgctcgccgagcaagtgttctccggttttgcggcccgctgcaactcctacgctcagacgctgaacaaataacgtttgcgggccgccgctgggcaagcgtggcgctacattggtgagtcatgccgacttatgacattggactggaacacgtttcgctcgctttcgctaccaaaaccatcttcactgatgtaacgcagggtgtttttgaaggcgaccgcatcggcatcgtcggcaagaacggcgacggcaaatccacgttgctgcacctgttccgcggtgctcaggagccggattccggccgcgtgacaaagcgtggcggactcacgttcggcatgcttgaccagcgtgatccccttgatgacaacgccaccattcgcgaagccgcacttgaggggcgcgccgactacgaatgggcgtccgataacacttcccgtgaaatcgtcgaggcattgctcggcggcatgagcctggatgccaaggtcggctccttgtccggcggccagcgtcgccgcgccgatttggcccgactgctgctcaaggattgggatattcttgcacttgacgagcccaccaaccatctcgacgtggtcactatccactggcttgccgaacatttgaagaaccgctggtccaaaggccagggcgctctgttgctcgtgacccacgatcgctggttcttggacgaggtctgcgaatcgatgtgggaagtccacgatggcgtgatcgagccgttcgagggcggctattccgcatatatgctgcagcgcgtggaacgcgatcgccaagccgatgtgcgcgaaaccaagcgccgcaatctggctcgcaaggagctcgcatggctttcccgcggtgctcgtgcccgctccaccaagcagaagttccacgtcaaggccgcacgcgaattgattgccgatgtgccgccgatgcgtaacacacttgaactgaagcaaatggccacctcccgtctcggcaaacaggtggtcgatttggtcgacgtgacgcagattttcgaaaaaccgcagggcatggccgatatcgacccggatgtggcggcgctctccgcgtccgcttcccgcgtggatgtggtcaacgccatgtacgccgagccgcagctgcatggttccgttgaggtggcggtcaccgacatgactgacccgcgcctggtggacgccggcgtgccggaagccgtcgagtccgctgaggaagcgcgtaagaaggccgaggctgagagcggcaatccgcagcttgctgacgatcgcgaggttcgtcgcatgaacacgggtggtgaaaccatcggcggtggcactgctgcaacggattcggatgatgacactgctgcagccggtgtcacctcggctgcacgcaaggtgacggtttccggccgcgagattcttgacgatgtgacttggctgattggcccgggcgaccgcttcggcatcgtcggtgcgaatggtgccggcaagtccacgctgcttaagttgattgatggtacactcaccccgaccgcaggccatgtgaacattggcaagacggtgaagttcgcggtgctctcgcagcgcctcgatgagctggagaagctcggcaagtacaagatcaaggaagtgctttcccgctataagccgagctacattgtggatggcaaggaagtgacgccgggacagttgatggagcgtctcggcttcgaatccgcccagctgatgacgccgatccgcgatctctccggtggtcagaagcgccgcatgcaactgctgctgattctgcttgacgagccgaacgtgctcatcatggacgagcccggcaacgatctggacaccgatatgctcgccgtgatggaagacctgctcgatacttggccgggcacgttgattgtggtctcccacgaccggtacctgctggagcgcgtcaccgatcagcagttcgcgctgattggcggcaaagtacgtcacttgcccggcggcgtgcaggactacctcgatatggttgaggctattaagaacggcaagggattgccggctgacacgcctggcttcgcgggcaccggtagcagctcggcgaagtctggtaagggtaaggcggccgccgtcaacgctgccgcatctctccctcagtccgcttcgcggatagctccctcgtcagagggagccaataacggtgagaactccacctcgaagctcaccggcaaggccttccacgaggcatccaagcgcgtgaatgccatcgaacgtaagctcgctaagcttgaagagcagaaggccgatctcgaggcgcagatggccgcccatgacccgagcgactacgagggtctcaacaagctcaatgaacaactcaccgccgtcaatactgaaagcgatgatctcgaagccgaatggctcgaactctccgaacaattggagtagcgggagaaaccgtaacgttcacaaggcctcggcagtttgccggggcctcccgctatgcaaactcccacggattaatcaattccacgtcggtaccttcgaagtccttgatattgcgcgtggctatggccgcatcccaggaacaggcaattgccgcaatcatggcgtcttgaatactggtaggtgtgcccctgtgttcgcgttcgacaaggatatgggcataatccgcagctgcctgagtgtcaaatgcgaacgttctgtcctctaatgtcataagcgccagcttgacggtcgtatctgtgtactttcgtcgtttgccttcaggcatgcgacatattccggccaacaactcggcgacggtgatggcggtggttgccaaattgcttgtatcttggttcctcagccaattggcaacgtgttcgtctggctgtttcttgatgatttcgctgatgacgttggtgtccagaataatcatggccgattcctattcaaaagatactggcggtcgggaatcggcggaatttcgctcggatagtgggagttcccccttgtcgagtccctcaaaatccatgttcttcatgaattcgcggatctcgtcatagaaattggtctttcgcgtgatttcatgcgccaccgtgccagccagccattcttcaagaatggatcgcacctgagattccatggagcggttgtttttctcagccacttctttgagctgctgaatctgctcatcgggtatttttcggatggtcaatgttgccatgatgcacctccttgttgctgtcataatgctagcatgaggtgctgtcgttttgcttgcagtacgggtgatgaggtatgcacgcatgaaaaaaggcggatatgcatcatgcgcatccgccttttgagcttggactgggtcttcccgcagtcgccgaatcagcgcccggtaacctcggaaccgacgaccttttcgctcagggcgcgcgggccgcgggtcacggctacggcaccggagcgcaccagctcaatcacaccgtaatgctccaaaagccccagcagggcgtcgatcttgccttcggcaccggtggcctcaatggtcagcgattccggattcacgtccaccacgcgcacgcggaacagacgcacgatctccagcacgtcggaacggttggattcgttggcggccaccttgatgagcaccagttcgcgttccacggtggagttcgggtcgagttccacgattttgagcacatgcagcagcttgttgagctgcttgatgatctgctccagcggcacggcctccacgtcggcggtcaccgtgacgcgagagatgtccggacgctcggtgggggagacggacagcgagttgatgttgaacgcacggcgggcgaacaggccggcgatacgcgccagcacgcctgggcggttctccaccagcacggacagcgtatgacgctgggaaccaggctgggatgcaggatagttagccatgagtgttctcctctcctcagtgctcgctcgcagtggcagcggcggtctcgtgctcgaacacgccggtcgcatgctcgtccggaccggttcccggagccggggtgccgccagccagcggcttgatgccgggcttgtacgtcacctcgtcgttgggggcgccggcggctaccatcggccacaccatcgcatccttccacacgcggaagtcgatcagcaccgggcggtcgttgatctggttcgccttttcgatggcggcaatcgcctcttcctcggtgaacgcgcggatacccacgcagccgtatgcctcggccaacttgatgaaatcaggcacttcgagcggcgcatcgccgtcggccagtgccgccgcaccatcggcaccgtgcgcttcaccatcgagcaggttggtctgcgagtagtggtgctcgtagaacagcgtctgccactgacggaccatgccgtatacggagttgttcagaatcgcgatcttcaccggagcgtggtccaggaacgcggcggccagctcctcagaggtcatctggaaggaaccgtcaccatcgatcagccacaccggcttcttgccctcgaattcacgggccgagcccacggatgcgccgatggcagccggcagaccgtagcccatcgtgccgaggcctccggaggagatccaagcgtgctggttctcaaaatcgatgaactgcgaagcccacatctggtgctggcccacaccggtcacccagatggtggacggatcggccatctcagagagcttcttgatgacccactgcggggccagcgatccgtcggtcggctcatcccacgtcatcgggtattcctcgcgccagccgtcgatcgccttccaccagggggccagattcggcttgccctgaatggcctgcgtacgctgaatctcgggaatcaagtcgtcgagcacggtagccacatcgcccacgatcggcacgtcgggctgacggttcttgccgatttcagccgggtcgatgtcaatgtgaatcacgcgggcggtcggtgcgaaggcgtcgagcttgccggtcacgcggtcgtcgaaacgtgcaccgatggccacaagcaggtcagcgcgctgcacggcgccggttgcggcaatcgtaccgtgcatgcctagcatgccgaggttcttcgggtcggagtcgggaatgatgccgcgtgcgggcagggtcgtgaccacgggagcgccggtcaggtcggccagagccttgacctgtgcgccggcgttggagcgggcggcgccgccacccacatacagcaccgggcggtacgactgagagaacagcttcgccgcgtcggacagcacacggccgtgcgccttggtggtggggttgtagccgggcagaatcatgcgctgcggccatgagtagtacatgtcgccggtctgtgcggtcttggtcagatccacgaccaccgggccggggcggccggtgttggcgatgtagtacgcctcggaaagcacgcgaggaatgtcctgcgcgcgggtcacgaggaaggagtgcttggacaccgggtaggtgatgcccacgatatccgcctcctggaaggcatcagtgccgatggcttgcacgcccacctgaccggtaatcacgaccatgggcacggagtccatgttcgcgtccgcaatggccgtgaccacgtttgtggcacccgggccggaagtcacgatgcacacgcccaccttgccagtggccagtgcgtagccttcggcggcgtggccggcggcctgctcgtggcgcataagcacgaagcggaacttcgtgttgtctttgatctcgtggtagacgggcagaatcgcgccgccaggaatgccgaagacgtcctcgacgccgaggtcctccagcgaacgaatcagcgcctgggcgccagtcatcttctcgccatcgacgatggtctgcttatcgggggccgtgttgattttcggtacaccgctgaatgcctgcaaaggcgtgggtaaagccatgattcctctcacctcataggttttgtcgcgaacctgcccgaccttgggatggggccgggtgcccgcgtgtctgattccagtcgcttccccgagacttgtggccccggcgcgactcgtcgctcatgttggtattagtctattcgcaaatccgacagcgggcttacttagtccgcgtcttgaacgagtccagtgacttccagcccgcttcggcggccgccagctgcgccttacgcttgctggagcccttaccgatgccgatgatgtcgccgttctcgcccaatgagacgcgcgcggtgaagatctgcgcgtattccgggccggagacctccatatggtagacaggctcctccttgccgaggccgtgcgccttgacggtcagcgaggtcttccagtcaagtgccgggccctcggtggccacttcggcgagcgtgtcgtcaataagccggtgaatcaccttgcgtgcctcgtcgatgccgtgttccaggaaggtcgcgccgatgagcgattccacgatgtcgcataggatggagttcttctccgcgccgccctgctcggcttctccgtgacccagcagaatgtaggggcccaccttgagcttggttttggcgatggcgctcagcgcgtcttcggagacggccttggcgcgcatcttggccagttgcccctcggtcatatccgggtgaatggtgaacagcgtttcagtggagaccagttcgagcaccgcgtctcccaggaattcgaggcgttcgtaattggccacgccggggtgctcatgcgagaaggaacggtgggtgagtgcctgcacgagcagatccgggctgagagtggtgcccaacgcttcaagaagctcgttggccggcgtcggctgctgtggggtttcattactcatgattgttgtatggtccttcacgcgatggtgatgtgttgtgttgtgttgtttgcgatgcgatggtgtacgcaatggtgcacttatgcgaagaccccgccacccgtcgatggcagggccttcattcaagccgttatcgcaggactcacttggtgtgagccggctggatggcggagcggtaggtgcggccgcggtagttaccgcagctcgggcaagccatgtgcggcagggccggagcgccacagttcgggcagttcacggtcgcagcagcggtggccttccagttcgcgcgacgcgaatgcgtgttggcgcgcgaggtcttgtacttaggcagtgccatttgagtatcctctatttcgttcgaacaattgagcttaagcgtccgttatcttaacgcacggctcgtacaaacttcgttcaggcgcgcgtcacttggcctgctcgccgttctgctcggcctcgagctgggctttgagccccgccaatccggcaaaacggatatccgtcacatcgtgatgatggtcgggatcctcgttcagatcggcaccgcactgcgagcacagacccctgcaatccggtcggcacagtggttgcaacggcagcgattcgaccagcgtgtcgcggatcatcgcctcgatgtccgcgaatgcgccgttctccagcagcggatacgtgtcttccgactcgtcctcgccggcgatgatgtcgatttcgtcgtccttcttgctcttgccgcccttgccgttggccttgtcctgacccgactcgtacgggaagaacaccgtcacatcaaccggccagtcctcgtcaatcggcttcaggcagcgcgtgcactcgctgacgaatggcgcgaccaggcggccggtgaagatcaggccgtccacaatcgaatcgaactgcccgctcacgtgtacgggctcaccttccttgatgccgacaatgctgtcgccaatgccggaaggtgccgggaaatcggcgtcaatcggcttggattgaccggcgcgcgaagcaatctgcgctaccggaatggcccacggggaatcttcaactcgtgccatggtatgttcttggtgcctttcgtatgttggctggagttattcgttactggcgttatttcgcgttactgatgttgccggcgttgctggcgttactgggcttcgggatagtcgttcagcgtcaggtgcggcatctgttcgcgggccgcgcgctggcgctcttccagcacgttaagaccggcctgcacatcctgactgagtttgccgagctgctgggacagcccttccatcaccgtagtgcagtactggtccgcgccttgggtcagatggtcggctttggtctgtgcctggtcaagaatcgcgcgcgctttctgccgtgcaagctcggtgacgttctcttggccggccaggaactgtgcctgttcgttggcgtccctgatcatgttggctgcgcggctttgtgcggaggcgacgatggcgttggactgggtctgtgccgattccagacggcgctcggcctcgcgcatgagggcggaggcgcgctccaactgcaccggcagcattttcttcaactcggaaagctggtcggtgaattcgtcgcggtcaaccttcaccatgccgggggcgaatatgctggacttcgcttcgcccagtgccgcctcgagctggtcgatgatgtcatacaccgtggtgaattcctcgtggctcttgaccgtggccgggtcgtcgtccgtggtttctcgcaggtcgggcatttcgttcatgaacgaggggcgaatgccggcggcctgagcggtctgagcctgtgcccgggtctgctgagctgcttgggcctgcgctttggcctgcatttgtgccggagtaggggtaggcgcggcgggcggcgatccggcgagaacatcggcctcttcggtgggtgccggcgcggcttgcgtagacgcgggcggttccggggcggacggctccggagtggacgatgcggcgtccgcattcggtttggtcagatcgacgtatccagtagggtggtcatcgctcatagtcattagtgcatcagtccttccgctgacgttcctcggccagggcatcggccagcatcggcacgacgcaatcgggcaccatgccggtcacgtcgcctccatggcgggccacgtccttgacgatggaactggagatgtgttcaagaatcggatcggccggcaaaaacagggtttcgatgccagcgagcttgcgattgaccagcgccatgccgagctcggcttcatagtcgccgttctggcgcagacccttgatgataacggtggcgccgaccttcttgcagtagtcggtgatcaggccgtcggtggaagaaacggtgacgttcttgcaaccggctttgtcaagggcgcggcggatcacgtcgactctggtggcttcggaaaacatcggtgttttcgcggcgttgacggccaccaccacatgcacctcgtcgaaaaaccgcgccgagcgctcgattacatccaagtgtccggcggtaacggggtcatacgagccggggcatactgcgatagtcatgctttatagcctaccgctagtggtgtgcttcgtgctgccgagcgtgcattgttgtcgcgtcggcgtatgaggcagtgtgtgcggtgccgtatgtggcgtcggtgtggcgtcgtgtgcggcattgtatgtggcattgtatgtggcggggtggcgtgatgcgcgacatgggtgtgtggaggtgtgcggattacgcgccaatgggtttcgcgggtaacgacgggaatctatgatggagtgcagtcgaatcgttgaatacgaggaaagaagtgcaccatgacttttgccgagatgttcgttgatgatgccgaaccgctgcgcaacccggaccaaggtgccggcacgtcggtgctggagcgtccggagaccaaggagtcgccggttcgtgacgatggtggcgacgccgatcgttttgcgcactacgtatccaaggaccgtatcgctgaatcgcgtgcgaccggccgcccggtggtggccctgtgcggtaaggtttgggtccccaagcacgacccgtccaagtacccggtttgccccgactgcaagcggatttacgaggaaatgacgcgctaaaggtggtacttggctcccctcagcgaggggagccaaaatggtcaccgagccgaaatctcgtcgatcagcttgagctcctcgtcgctgaagtgggtgttcttcagcgcgccgatgttgtcgagaatctgctgcggcttggaggctccggtcagcacggaggtcaccttgccgtcgtgcagcagccatgccaggctcatctcggccagcgtctggccgcgttcggcggccagattgttcaggtccacaacctgcttgtgcagtttctcggtcagagcggaatcgttgaggaatcgcggatcgtgagccatgcggctgtcggccggaatgccgttgagatagcggttggtcagcaggccctgagccagcgggcagaaggtgataaggcctttgcccagcttgaaggcggtctctttcaggccgttcttttcaacggtgcggtcgaggatgttgtacttgttctggttgatgatgaacggcacgtgcagttctgccagaattgcggcggccttttccatcgtcggaccatcgtagttggacagacccacgtacagggccttgccggagttcacggcctgagccagcgcgcccatcgtctcctcaagcggggtttccggatccgggtggtggtggtagaagatgtccacataatccaagcccaagcgttccagcgactggtcgaggctggcgagcaggtacttgcggctgccgaggtcgccataggggcctgtccacatttcatagccggccttggtggagatgacgagttcgtcgcggtgatgtttgaagtacttggcgagcagcagtccgcagttcttctcggcctggccgggttcggggccgtagttgttggctaggtcgaagtgggtgatgccgttgtcgaaggcggtgaagaccagggacttcatctggtcgaatggcgtgatgtcgccgaagttgtgccagaagccaagtgagacggccggcaacttgaggccggaggtgccggcacggttgtaggtcatcgtgtcgtaacggtgcgggttgggggcatagatggcggttggctcgaacattgagtctccttacaatgtcattcttgttcttacgaatgcttacctgcgatgggcagaccgacgccgattgagcggtattcgtaagtgttcttggatactatggttccagttcaagtgaacttgaatgcaagcggctgcgacgcttcggcgtgttgccgcagtaaggagtcatgatgtcctacaccattcgtcaggtggccacgcagttccatatgcagccctctgcgccggtgaagactggccggattggcgcgagtacaaaaaccgcgcctattccattgaatgctgaggccatcgagtgctgagctggatgccggctgggcactaagaccgatgtgcgtcgatcgtgggcgcgtctatccgagtaaggccttgctcggcagtgcgcggtcgagcagccagacaacgagcgatatcacgaagaacgctatggccagcttgccgcagctaatgccgaacccttgccagccgagtgcgtcgaggttgatgaagtcgtacggatacggactgccgccggccgccggtccggaccccggccaaatcgccgcacgggccagcacgaagaccaagtatgcagggaagtacgccagccacgagaacatgtaatgccagcggaaacgccggtgcgggtcgaatagcacgaaatcgataaccgccataatcggggcgattttgtgcagcatcgtattggtcatgatgccaataacctgtggcacgtatgccgggtcgtccggaggcatcaggaagaacgccaccagtgcggtgactatggcgtacacagtcaggcaccccttaagccatgcaggcggctgaatacctttgagcagtgtggccgcgccggaccacagcatcacgatgcccagcacgaaaccggtctggaacgtgaaatacacccagaactgcggtttggaccatgcctcatatgtgcccacgaagcagaaaccggcgatcgcaaagcgccacaacgccacgatgaatctcatgcatcgagtctaccgcttcgccagtgggctgtatggctttgcccggactacacttaggtgcaacttcaccacttatgtaggaaaggccttgcaatggtcgattattcgccggctctgatgaccgacatgtatgaatacacgatgctcgacgccgctctgaaagacggtaccgccgaccgcaagtgcgtgttcgaggtgttcacgcgtcacttgcccgaaggccgtcgctatggcgtggtggccggcaccggccgcattctggatgcgctggaacatttccacttggatgaagcggatctgaagttcctggccgaccgtcacgtggtaagccccgagaccattaagtggctggagaacttccacttttccggtacgattcgcggttaccgcgaaggtgagatgttcttcccgaactccccgattttgcaggtcgaaggcacgttcggcgaatgcacgctactggagacgttgattctatccgtgctgaactacgattccgcagtggcctccgccgcctcacgtatggcgtcggcagccaaggatcgtccttgcatggatatgggcggacgccgcactaacgagtgggctgccgtggccgccgctcgagccgccgtagtgggcggattcaagggtaccgccaatctgctggccgcccagctgtatggtctgaaggccattggcaccgccgcgcattgcttcacgttggtgcatgattccgagcgtgacgccttcgaatcgcagatcgaggcattgggcaagaacaccacgctgctggtggacacctacaacatcgaggaagccgtgaaaaccgccgtcgaggtggccggtcccgaactgggtggcgtgcgcatcgactccggcgacctagccgccatggcccagcgtgtgcgcaaccagctggacgccctgggcgccacgaacaccaccattaccgtgaccaacgatttggatgagtacgcgctcgccgcattgcagaccgcgccggtcgactcctatggtgtgggcaccatgctggtcaccggctccggcgctcccacttgtgcgatggtgtacaagctcaccgaacgtgaaggcgctgacggcacgatggttccggtcatgaagaaatccaaggacaaggccacagtgcccggtcgcaaactggcattccgctcctacgaatacgcgttagccgaagccgaacacgtgatttccggctcggaggagaagctggccggtttcacgcctgaaccgacgtggaagaacctgctggtcgactttgtggatcatgggcagatcgacgctcagtggcagggccatgacgccatcatggccgcccacgactaccacgccaaggcgttgtccgaactgcccatcaccgcgcagagcctcatgaagggcgagccagtgattcctacggagactcaggtcctctgaccgtatctcactggccgcatccctttggttacattggctactcttccctctgtctgtgttggccgcactcctgtggtcgccgccgaggcggggagatccaaccccggtcgcacccccgtgtttgcaccccctgtggctgtgtcccggggctgtattggccgcgtcccctcgggctgaactgcgtcccggttcgccggacgtggttccagctgagggtggccccggcagattctagtggtggttgcaacacctggggtttgagcggccttccatggtcacgttgtcggttgttgaggttatcacgcggcgtcgagcagttcgatgatcttctcgcttggtttcatgaacc

SEQ ID NO: 19 - DNA, 187535 bp, Bifidobacterium longum
ttcggatggcgttgtgtctcatgggctcggagatgtgtataagagacaggaggggtgcgttgacggtgacgtgttggcgacggtgaacatatcggcggcaggagaagataagctgttctcaggggaacatcagcacaacaaaggagttacgcatgcgagatttcattttccacaacccggtgaagatctacttcggcaaagggcaggcgcgccatatcgcacaggaggtggagcgtgtcgagggcgccgttctggtggtgtatggcggcggatcgattaaacgcaacggtgcctatgacgatgtgatggctgcgctggcaggaaccgggcgcaaaatcatcgagctgcccggcgttacgccgaacccgcgattggacaaagcgctggaaggcgtacgactggtcaaggagcatggcgtcggcctgattctggccgttggcggtggctcggtaatcgactgcgcgaaatttatttcgttgggttccggcatcggtgacgatgaggatttgtgggatgactacatcgaaaccggcaaaccggcacctgaagggctgattccggttggcgtggtgctcaccaccgcggcaacgggctcggaaatgggagatgcggccgtgctcaccaattgggaacgtaaccgcaagctcggctatacgtcgttcccgctgatgcccaggttctccgtgctggatccaagctacctgatgacattgcccgccgaacagacggtgtatggcttcgaggacatgttctgccacacgtgtgagcagtatttctcctatccggtggacgacaacctttccgacgaaatcgccgagggaatccaacgtcatattctgcgttcgtggcgagcgtgcttgtccgatccgaaagattatgaggctcgctccaatgcaatgtgggattccacgttggctctgaaccgcattatctcgcgcggcaaggaagaggattgggtgacgcacggcatcgagcacgcgctgtccgcatacaccgatatcgctcacggtgctggtctggctgtggtccacccgcattggatggcatacgtgtatttggtcaacgatgaggtgacggctcgctttgcccgctgggcggtcgacgtgtggggtgtgacgcccaccggcaaaaccgatcgcacggtggccgaggaaggcattgatcgctatgtcgatttcctgcgtcgcgtaggtgcgccgctgactctttctgaggccggcgtgcccgacgatcccgcctctctcgacaagtacgccgatcatgccggtgaggccggcggctcattcgtgcagattcaccgtgacgatgcccgagcgattctcgaggcatgcaaggaaccggtgtcgttctgacggttggactaatcccgtgatttgagccgccgcgtgctgtcccgcaccaccaaagacgtagaaagaaccacgcgcttctgaatcttacgtccttcattggtatcgatgaccatgcgggctgcagtggcggccatgtcttgcaatggctggcggaccgtggtcaacgccgggcccatgtacgcggcggtctgtatatcgtcgaatccgataacggacagatcttcggggatacggattttcagttgacgggccgcctcgtaaacgcccatggcctgtaggtcattgcctgcaaagatggcggtcgggcgactttgttcgtcttcaagtaacgccatggctccttcgtaaccgcctggcgtggtgaaatcgccttcggtgatgagttcgggagaggtggggatattgcgttcggcgagggccgccgaatagccgtcaagccgggcacgtgagcagagcatttcatccggtccggtgatgatgccgatgcgcttgtggccgagttccagcagatgacgggtggcgatgacgccgcccatccagttgtccgcctgtacggagagatcatctaatgccggattgccggaagggtcgaagacgacgaaaggaatgccgtgtgattggaacatgctgcgttccttgtccgtcaagttggagaacaccagaatagcgccaatgggctggcggtcgatgatgccttcaacccaggaagagtcggggtgctgccggtcgccactttccgcaaccatgacattgatgttgtgcggcttggcctccgtgatgatgctcctgagcacctccagcgcccaaatggtctcaaaatcccgaaataccacctcgatggtgcgttgtttacgggagagggagacgcggcgaatgtagccgttgtctttcagggctttgtcaatggcctgccgggccgcctccgaaatatccgccttgccgttcagggctttggacacggtggccagtgagtagccagtctgtttggcgatgtctgcaagtttgaccttgttctcgccgttgcttttgcgctgttctgccgacgccatcattgaccgccttcatcagagaatgttgatatcagtatattcgaaactttcgtaaagtcaatttgacgataaagaatggtatgtatagataaaaaaggttggaatttcaacgattttgatagtaaaaaagtcgatataaatttcgtttgaccgtcaaactaaggctctctatgatagagatatcgaaaacataaagcgagttttcgataaagttaaagaaggttgatggaataggtgaaacggcgaggtttcactgaaaacatcattaattaccagctgttagatatgtaaccggctgatatacctttcgaaactttcgtaaatcgcggatcggtttcatgctggtcaagaacaataaggagacgataatgaagttcaagtccgtggccgccgcacttctggcggcggtaacctgtgtcagcatggccgcttgcgggagcggcggcgacacgaatgccgatggcaaggtggaaatcaccatgtggcacaactccaccactggcgacggcaaggcatactgggaatccgccgccaaggcgttcgagaaggaaaacccgaacgttaccatcaagattgaagccattcagaacgaggatatggatggcaagctgcagaccgctctgcaggacccgaattccgcccccgatatctttatggcgcgtggtggccagaagctacgtgatgtggtcgaagctgggcaagccatggacctgaccgacaagatctccgacaccgtcaagaaccagatggccactgctgaagccaccggcaccatcgatggcaagatctacagcgtgcagcagtcagtgcttcccggcggcatctggtattccaaggatctgttcgagaaggccggtattactgaaactccgaagacctgggatgagttcaagaccgtggtgcagaagctgaaggacgccggcatcacgccgattgccgtaggcggtaaggacgcctggccggccgcccactggtggtactggttcgcactgcgcgaatgctctgctgacaccttcgacaaggcccagtccgataaggacttcagcgataagtgctggacccgtaccggtgatgatgtgcaggcgctgctcgacctcgatgccttcaacgatggcttcctgaccactccggcccagcagggcgcaagctcctccgccggcctgctcgccaaccacatggcagctatggaactcatgggcggctgggagcccggcgtgatcaaggacctgactccggacaagaaggacatggccgacctcggctacttcgcattcccgaccatggacggtggcgaaggcgatccaactgccatcatgggtggttccgatggcatggccgtgggcgagtgggcgcctgaagaggctgtggacttcctcaacttcgtctccgagaaggaatggcaggagaagtacgctgaggcgttctccaccatcccggccaacaaggaagcccaggatgtggtgaccaacgaggctctgaagcaggtgctgaccgtctacaacgacgcatcctccgtgtccatgtggctcgacaccgtgttcggtcagaacatcggcaacgcactcaacgaaggcgtggtcaacatgatggccggtcaaggttccgcccaagacattgtcaagggtgttgaaaccgctgcggccaagggctgattcgctctgccccgaccgtaattcccgggccgcggcgaatgcttgcacagcaacaaccgcggcccaatttgttttcttaggaaggcctcaacaatgtcagtttcagcaggcgcgaaggtacagcgccgcacgtcgggcttaagcgacaaggttcgcaaacgtatcgaaatcaccatcctttcgcttcctgccctgatcatgttcctcggattcgtcatcctgccggtgttcatggccggctactacggattcttcaagtggaagggctatggcaagcccaccgtcaacggccagttcatcggttttgaaaactacaaggtcattctgaccgacccgaacttccagcaggcattgggacacacgctattcgtggtcgtcgcttcgctcgtcatccaggggccgctggccatcctcttcgccctgctgctcaaccagaaattcaagggccgcgcactgattcgtaccctgattttcgtgccgtacgtcgtttccgaagtcatcgttggcaccggctggagtctcatcctccagaccacaggcgcattgaacgcgctactcaagaaaataggacttggcggggcggactggatctccgatccgaaaatcgccatctggacattgatgttcatcatttcgtggaagtacatcggcttcgccgtcatcctgatgattgccggcatgcagtcgattcccgaagacctctatgaagccgcgaaggtggatggtgctggattctggcgtcagcagtggagcatcaccctgccactgctcggccccaccattcgtatctgggcattcatgtcgattatcggttctcttcagctgttcgacttggtctacatcatctggggccagtacgtgtcgtctaccgcaggaacgtccaccatggcaacctacatggtgcgcgaaggtcgactcgccaacaactatggttacggttccgccgtggccgtggtgatcttcatcatctcgctggtcattgccttgacctaccagcggttcgtacttaaccgagatctcgaaggtgcgctcaccgacgagaaggatgccaagcgtcgtgccaagcgtgcggcgaaggaagcggccaagcttgccaaggccaatggcaatgccgcagcagttgcaaatgaggtggtttcacaatgacgaccgcagtctccccgtccgtgggcaagggcaagaacaagacctatgatccgtatgcattgagaaaatccgcaaagaccccgtggggcaacccggtcgtctacttcttctcactgctgcttgtggcgctgtgcgttggcccggtgctgtacatcattatcggcggcttccgcaccaatgcgcagattacgagggacccggccggctggcccgatccatggaactttgagaattacaagacggtgttcacttcgaacatcttctggccggaactcgtcaactccctgatcgtctccattggcacaatggtgggcatcgtggtgctggccttgatggtgagcttcgtcattgcccgatacgagttcaaattcaacaaactgctgtactcgctgttcgccgccggcatgatgttccccatcaccgtggccatcaccccgttgtatctgctgctgcgcaatctgcacctgatcaactcgcatctgggcattattctgccccagatagcattcggcctgccacaggccatcatcatcctggtgccattcctcaagtccattcctaaggaactggaagaagcggcagagctggacggctgttctcgcatcggcttcttcggccgtatggtgctgccgttgagctggcccggcgtggccaccgtcggcatcctgagcttcgtgagcagctggaacgcctacatgctgccgctgttcctgctcaacgattccagcaagtacaccttgccgctcggcgtgcagatgttcagctcccagcattcggtcgataccgctcaggtactggccttcacctcgctgtcgatgatccccgcgctgatctgcttcaccattttccagaagaagatcgttggcggcctgaccggtgctgtcaagggctagtcgcagcaaccataaccgtgccgtggaaaggtacatggctctttgggccgattcctttcaacctcttcctttcctcctttccacggcccctttcttttcaatgaggagaagaccatgaagatctccaatcccgtactccccgggttcgatgcggacccctcgatgattcgcgtcggcgacacctactacatcgcaaattccacatttgactggtggccgggagtccgtttgcatgaatcccgcgacatggttcactggaatctgctgcccgggcccttaaaccgcgtttcccagctggatatgaagggcaatccctccggtggcggcatctgggcaccggacctgtcttatgcggacggcaaattctggcttatctacaccgacgtgaaaatcgtcaacggcgcgttcaaggattgcgcgaactatctggttaccgccgacgacattcgtggtccgtggagcgatccgattcgggtcaatggcgtcggattcgacgccagcctattccatgataccgatggacgcaagtatctggtgcagcaaacctgggacttccgtgaatatcatcatccgttcgacggcatcaccttgactgaattcgatgtcaaaaccatgcaattgaagccggaaacagcccgcaccatctggcgcggcaccgatgtgaaattggtcgaaggaccgcacctctacgccatcaatggctggtactacctgttttgtgcggaaggcggcacccaatacgagcatcaggagtccgtggcccgttcgcgaaccttggatgagctttcgttcgaaagcatgccgagcaatccgttcatctccaacttcgatacccccggcacctacctgcaaaagcaggggcatggagcactcgtggatacgcccggcggcgaatggtattacgcttcactgtgcggcaggccctggcggcacgagaacgagccggctcatggcgtgcgcggctggtgcacgctcggccgagagacttcgattcagaaggtcgagtgggatggcgatggctggccgtatgtggtcggcggccatgggggagagcgttatgtcgaagccccggccgacgccatcgcaactgaggcccctacggatcatagccagcatgacgagttcgaatcgagcgaactcgacctcaactggaacaccctgcgtgtgccattcaccgagaccatgggccgcgtgggcggcggctcgctgaccttgcgtggtcaagggtcgctggcaaacctgtttgaactgtcgctggtaggacgccgttggcaggcgttcgatttcaacgccgaaaccaaggtgacgttcgagccgagcaactacatgcagatggccggcctgaccaacttctacaaccacctatgctggtcgtgggtgttcgtcacttgggacgagaagcgcaacaaacgtgtaattgaagtggctcagaacgacttcgacacgtacacgtcgttcctcaaagacacagccatcgccattcctgatgacatcgaatccgtatggttgcgaaccaaagtgcgtactcgtacctacacctacgagtattcgttcgatggcaagacatggcatgagattccggtgacgctggacgccgccgtgctctccgatgatcatgtggcccaacgttatggcggattctttaccggcgcgttcgtcgggttggtggccgtggacctttccggatacggcaaagaagccattttcagccatttcgattacatggaaatatgatgacgccaggcggctttcctgataatcagggaaagtcgcctgactattcggcactggggaatgaaaggcgacacttgtggcaagcgacaatgaacattgcggcgaccgtggccgcgaatgtaccataaccgtctccaacccggtgctgcgcggcatgtacccggacccgtcctggatctgggatgcgacgcgcgaggaaatcgtgctggtcaactcctcgtttgaattggtgccggggttgcccattcatacgacccgtgatcttgtgacgtggacgcacacggcgaatgcggtggatgaggcgatgtctcatcgactgctcattgatggcgtcgaggattccggcggcctgtacgcgccgaccattcgccgtatcggcgggcgatatgtgatcgtatgcaccgtggcccgcgtgaatgaggtgaaggcgctcgctgcaggatgctcgcagaaggatgtcgatggctgtcgcgccgcccaaggcaatttcgtcatcgaggccgatgagttgaccggaccatggcgcggtccgtactgggtggccggggccgaaggcattgacccggacatctttgaagacggcgatggcacagtgtggtggacgcaaacgcgcccggcattacatccgcagtgggatggtcaaaccgagatctggacgcagcccatcgccccaggcacgtggacgttgcaagaccataaaaccgtgatttggcgcggctatggcatggatgcggtatgggctgaagggccgcatttgtaccgggtgggcgattacctctacctgatgaccgccgagggcggcaccagcttcgagcacagtgagatgataatgcgcacgcacgcaccgcgcggattcgcggcggcgctcgccggttttgagaagaaccttgccgcgcaagatatctggattgagccggcgcgtgacggtgaacgaagcgtggtgggtcacgataaccggctgtttgaggcttgcaaacgcaatccgatcctcacacaccgtcatttgggagcgggggagccggtccaatgcgttgggcacgccgatctgctgctgcatccgaccgtcggctggctgctcgcgtgtcttggcatacgcgagactccgggcgaggaacccggagaaacgttcagctactgtggccgggaaacgttcgtggcaccggtcgtatggcagcacaatccggtctcgtggaagctggacggtggggagccgaataagcgtatcgatatcgtcgatcccggttggccggtcgtggctccggggcttggccggcttcccgagaagttggtcgtggacgttgacgaggatggattgccatgtgcagtgaggggtgtggattctgcggggtgtgattgcgctgctggtaataatgccgcatgctctgctgagctcatccagctcgacgatacccgcctagtcggcgttcgaggccgtgacgattaccggttcctgcgtgtcgacgggcaggaatatgccgcgttcacccggcccgaatacacgatgatgatgcatcaggattccacccatgctgtcatggtcatggcggaagcggaatccggccaattgacggccgaaatcaccgataggggagataagcggtgcattgcgcttggagcgcttggggccaacgaatggttcggattgcgcttgcatggcaatcgtttggaattccttgccgggcagcctgcacctgacagcattgatgagggaacaatgcctgatattgcactaattgcgcacgcggacgttacttatgctcgtatcatggcagattgtgatgcgcgattcctcagtaccgaatgggccggcggattcgtgggttgcctgatcggcgtaaaacgacggtaatggtctcagcccgctctacaatattgtacaatcatattgtttaatcgttaaacaaatgcaagggggggcaatcgatggcgcacgatctcgaacaactcaagcaagatcacccggatgtggcgaaactgttcgccgatgactggttgcagtaccgtaagtcggagattttgccggaacttacgcgcgaggcgcagtccacgtgcgaccgcatcaatcgcatctactttgaagacaccgccgaagctgagcgactgttccgcgaactcgtgcccgaggccggcgagggcgtggacttccgcccgccaatccggcttgattacgggctgggcctgaaaatcggagaccgtacgttcatcaacatggacctgctgattgtgggcggcggcccgatctccatcggctccgattgcctgatcggcccgcgcgtgagcatctatacgccaaaccacgccatcgcccgcaagcctcgactggaaggctggcagcacaacgccgacgtgaccatcggcaacaatgtgtggctgggcggcaatgtggtgatctgccccggcgtcaccatcggagacaactcgattatcggtgcgggcgcagtcgtcacccacgacattcccgccgattccatcgctgtgggcaatccgtgccatgtgattgccgaagtcccggatgactggactcctgaagagcgggccgctgccgagggtcggtaggtttgctgctctggccaactgtcacggcgaaaccgggatacaggagagaaaggaacaatgcaatgacgcaatatcatgtttccgcgcaggcggcgaagacgaacggcgccggcagcgcggccgacccgtttctgaccatcggccaagcggcggccatcgcccgagccggcgatgaggtggttgtgcatgccggcacctatcgggaatctgtcgacccccgattcggcggagagagcgccacgaaccgcatcgtctaccgcgcggccgcgggcgaaccgcgcccggtaatcaccggctccgaacgtatcgacacatggcagcccgaaggcgatggcgtgtggaaagccgtaatcccgaacgcattcttcaacggatacaacccgtacgtggaaaccgtattcggcgattggaccgtatacccggacccaaaggtcgaggtacgccacctgggcgatgtgtatctgaatggcaaatccttctacgaagtcgcctcgctggacaaggtgcgcaacccacagcgttgggataccggccgtgacgccgccaccgattccatcgtgccgctgattgatccggatgccaccgtgaacgtgtggtgctgtgcggtcgatgatgaggccacaaccatttgggccaatttccatgaagccgacccgaatgcggaacttaccgaaatcaacgtgcgcgagacctgtttctacccgagccgcccgttcgtcaattacattacggtctccggctttgaaatggcgcaggcggcctgcccttacacgccgccgactgccgatcaggtcgggctggtgggcccgcattggtcccgtgggtgggttatcgaaaacaatcgcattcatgacgcgaaatgttcggcgatctcgctgggcaaggagatttccaccggcgacaacgaatcgacgcgcacccatcgtaagtccgggtaccaataccaaaaagaggccgtctacaaggcgctgcatgccggctgggagaaaggcgtagtcggcgggcacgtggtgcgcggcaacgtaatctacgactgcggccagaatggtgtggttggtcatatgggctgcgccttctcgctgattgaaggcaaccacatataccgcatcggctccaagcgcgagttcttcggctgggaagtggccgccattaaaatgcacgcagccgtcgacacggtggtgcgcggcaaccgggtgcatgattcggtgctgggtatgtggctcgactggcaggcgcagggcaccgtggtggattcgaacgtgttctaccgcaacacgcgagatgtgatgaccgaggtgacccacgggccgattacgtttatgaacaacgtgtttgcctccgagttcagtttcgacgattatgcgcaaggcgcggcgttcgtcaacaatctgttcgccggtcgcattcgtcacaccgccgtcttggaccgatccacgccataccatttcccgcacgtcaccgatgtggccggcgaggcattcgtctacggtggcgatgatcggtacgtcaacaacctgttcttggctgtggacgattccgccaaaccgttgtgtaccgcggatgccgccggtgcggccggtatggcggaagctggaaccgcgttctttgacggctatccgcgctcgcttgaggagtatgaacagctgattgaagaggctggccttggcgatgaggagttgtatcgcagcgtgaagcagccggtattgctggcttcgaacgcctatgtttcgggcgcgaaggccgcttccggcgaagccgaggccgtggtgagtggtgacggctcttcgttggcattgcgcgaaaccgatgatgagctatggatgaccgtttcgttgcccgaatcgattcggtcggcaactggaccggtgatctccactgctgatcttggccaaccgcgtattgtcgaggagtatttcgagaatcctgacggttcgccgattgttgtggaccgggatatcaccggtgctgcgcgcggcgcatgctcggctcgaggcccattggcggcgtatggcgatggggaagtgctcatctggtcgaagtgacgggatcgcggtttcgactgttgcctctgcctcggcctttgtgtggcactgagtggggctgggctgccagtatttggcaggccggccccttttcgatttgcattggtaacaaatatgatatatggttaaatcattaaactaaatactgtaagtccatgcatacctacgcaacgtcaatggagatactgctatgcgcgcacatcatgttctgctgctgtcgctctgcctgttggccgcagcctacgccgtactgctattcgtttcaccagccgctgcgccgattggcgtcacgctaaccgttgttggtctggtgctggtctcgacgcgctatgcgtggcgcgccaaattcctggctctattcaacgaagcatgatttgatgaatcttcttcctctcttctccttttaagcccggccgctcgccgggctttttcttttgaccgaggtcgaagtggggaagggtgtgctatgggcactttcgtgtcgggggtgccgtgttctcgacaacggcctaccgacttggggtgtatttcgacaatatgattcggcgatgtgcctcagcggatatgtgcggccaatgaaaaagcgggataccgatgtcgatatcccgctttcagcgaataggtaaggccagagcttacttcttcctggctttcttgacgcgcttgggggtgggagccattttcttgggttcgaagaacggccacttgtgcaaagcccaggcgtgcagtgcggggatcttggcaacggcgaagccgatgaccagaccgattaccatggcccaggtctccagatcatggcctgcgaccagcaagccgatgaacactatggcaacgatgaagctcaccatctgcgaggcctttgactgcttggcggtcaccaggtcggccttcatgggaacaagccccagaaacaggccgcaaggtatgcagatgacggccaatatcgcgctgagggttattgacaatgtggttgcatccatgatgttcctttagtgctgtgggttgtggttttctttggcgtctgcggtgtcggtgtctgcggtgtcggcaacgtcgtcgtgttcgttttcttcggcttgttcggcttcggcctcggcgtccgtgctgtcggtttcgtcgtcatcagccgcgtcatccttgccgggctggcgccaccacaggattagcgcgttggccgcgcagtagatggccgcgatgccaatgcataccagaaaaatgatgttcgaagtgctgatgatcgtgccgtcgttcatcgactctttgacagactgccatatccacatcacgcaggcgacggcggtcagggcgtacagcatcatacgggagcggtcgttcataggatcatctccagacttgttcaaacgacttgattatagccgtatttgtggattgcgtgggaaacgaaaaatgccgccatgtgtgcttcagcgaggagcgcggtataacagcggctcttcgcgatgctcgccatggcggcattcatcaggaatcgttattcagttgttatctcatggatttgctggcagcgtatcagccgcgggccttggcgtacgcctcatacacggcttcggtgggctcgccggtctccacgccctcgatggtgagctgccaggtcggcggttcggcctcgccggacagcacccaggcggcctgacgggcggcgccgatggccacgtattcgtcggtggccggacgggtcacgtccatgccgaggattgagggggccagcgtgcggatggccacggacttcgcgccgccaccaatgagcaggatgcggttgatctcggcgcccagcgagcgaatcagctcgaggcagtcgcgctgggaacacagcaggccttcgacgaacgcacgggccagattctccttggtggtgttgtgtagggtcaggccagtcagcgaggcggtggcgtccggacggttcggcgtacgctcgccgtcgaagtacggcaccagggtgatgccgccggcacccggctcggccttgaacgccagttcggccagttcgtcgtagtccacgcctagggcggcgcgaccggcgtccagaatgcgcgaaccgttgattgtgcaggcgagcggcagatagtggccggtgcagtcggcaaagccggaaatggcgccggtcaggtcgtacaccgggttttcagcgatggccgcggccacgccggaagtgccgagcgatacggacacatcgcccacggccatgccgaggcccagcgaggccatggcattgtctccgccgccggggccgatgatgcagccgccttcaacgtccttgccggcaatggcggggtcggccttgacggcggctgcctcacgcgggcccagcacggtgggcagcacaatggcgtcggcgtgggccttggcggcttcctcgccctcggcaggggccagcaccatggcgatgagatcgcggcggtactcgtcatgcgcggcatcgtagtaaatggtgccggaagcgtcggaacggtcggtgaacagggcttcgagatgagcgtcctcgccctcggccaccgggccatagccggcgatacgccagctcagccaatcgtgcggcagacagacggcggcaatcttcttggcgttctcaggctcgttctcggccacccacgccaccttggtcagcgtgtaggaggcgacgggggaggatccgacggccttgacccagcgttgcttgccgcgggcggtcacgtcgtccggttcgtcgccctcggccggagctgcaccgagcttgtcgatcaaggcggcggcctgcggggcggaactggtgtcattccagagcatcgcatcgcgaatcacgttgccctgcttgtcgagaatgaccatgccatgctgctggccgccaaccgcgagggccgcgacatcgtcaagcccgccggcctgctcggcggccttggtgaaggcctcccaccagaattccgggttgaccgaggtgccatccgggtgcttggcctgcccgaaccgaacctgttcgccggtggcggcgtccgtgatgcggaccttcgttgattgggttgacgtatctacgccggcaaccagtactctcgtcatgcattcctcctcgatgagggtcgcgctcaaaagtttcggcgcgccatagccaataagttagacgattaaactatactgtatctcaacgttcgattgcaaacggaaacacgcgaaggtgcggtccgattcaatcgtttgacgcacaatatcatggtgtgatagacggatgtgagcgcctgtgcggcgctcgagactaggggtgcgaggaggtaggggccaatggcaaatctacgcaggatcaatcaggaggatctgcgcaaccataacctgtcggtgacgctcgacaccttattgcgtgcgcagaaaccgatgagtcgtgccgatctggccaaggagacgggcctgaccaaggccacgctctcgctgttggcctcgatgctcattgaaagcggcgtggtgcaggaaggcgagccggtcgtttccaccacatatgggcggcccagcacgccgctggagattcgcggcggatccatcgccggcatcggcctgcagatcaacaccgatggttacggttgcctggcactcgatctgaacggcgacactctcggccgggagtgggtgagtgaggatatgaccggcactgacccgtacgagatcttcgccaagctcgatgcgatgactttcccgttggaaagccggctcaaacgacgcggctgcaaggtggtgggagccgggtttgcgctgccgggcatcgtcaccgacgacatgtggctgttggtggcccgcaatctgggttgggaaaacgtcaacctcacccggttcaacgtggtgcgccggctggatgtggtggccggcaatgaggcgaagatggccgccatcgctcagattccggggtatgccaccgaacgtgcgcccttcctgaatgtggtggaccgcacggactcctttatttacctgtctaccgatatcggcatcggcggcgcggtggtgcgcgacggcgaagtggtgatgggctcgcacggattcgccggcgagatcggccatctgtccgtggcgatggatgggccgttgtgcagctgcgggcgtcacgggtgtcttgaggcgtttgcgggccgtcgcgctttggtcgaggctgccggcattgccgaggatggggatgccaccagcagcgaggccatcgatatgttcctccagcgttggcgagccggggattcggatgtggccaaagtggtcgatcaggccgccgatgcgctggtttccgccatcgcttccgccgtgaatctggtggatgtcgatacggtgctgttgggcggactgtggacgcacttcggcgacgagctggccaccgtgcttgaaggccggctgcgttcggaaattctgggatacccgaatgtgaagattcgcgtgtttgtgccgccggtggcgctgcatccctcgctatatggcgcggccgaaatgggcttgcgacggttcatcgagaacccgttggggtacatgggggagaagtagcgccgggagatgctgcttgttgctggcgggtgcatggtatgggtgcatggcgcgcgtgccggcattagcgggctcgtgctacactttggcaagttggctgttttgtgcagcgaacgtggggccgtagctcagtcggttagagcatgcgactcataatcgcccggtccagggttcaagcccctgcggccccactcttttgcgtcgtctcctgcggcggcgcagcgcgtcttcacgtccagataggcgcgtacaatcccttaggttccggttcacgtcttgccataggggcatgacgacccgggtcccccgaatccataggagacgtaaaatgcagcagggtatccatcctgattatcaccccgttgaggtgacgtgctcgtgcggcaacaccttcgtgacccgcaccgctggcaaggaagatcacatgttcgttgacgtgtgctctcagtgccacccgttctacaccggcaagcagaagattcttgacaccggtggccgcgttgctcgcttcgagaagcgctacggcaagaagagcaagtagcatacttcacgccagtccgattcgatttggcatgctccggcatacccgatcgaggactggcgttttttgtattctttgacaagttttgttgcagcattgacctgcgcaatcgaataatcgaacagaacagcaccatacagaagaaagtgtgttatggcagacgaacagttcccggcggcggcaaccgcgcttgaggagtaccagtccatcgaagaacagatggcaagccccgaagtcgtgtccaacccggacaagctgcgcaagctgggtcgtcgtcacgccgaactgggtgccatcgtgggtgcctacaaagcctggttgcaggtgaaggacgatctggcagccgctcaggagatggccggcgaggacgccgacttcgccgaggaagccaagcgtcttgaagccgaactgcccggtgtcgaggagaagctgcgcaccgcgctgatcccgcgcgacccggatgacgcgcgcgacaccatcatggagatcaaggccggcaccggcggcgaagaagccgcactgttcgccggcgacctgctgcgcatgtacacccgttacgccgagaagcgtggctggagcgtgaacgtgcagtccgagaacaccaccgagctcggcggcgtcaaggacgtgcagatcgccatccgcgccaagggcacgcccgctcccgaagacggcgtgtgggcttcgatgaagtacgagggcggcgtacaccgtgtgcagcgcatccccgtcaccgaatcgcagggccgtatccagacttccgccgccggcgtcatcgtgttccccgaggccgacgaggatgacgacgagatcgagatcgatccgaaagacctgaaaatcgacatcttcatgagctccggccccggcggccagtccgtgaacaccacgtattccgccgtgcgcatgacccacctgcccaccggaatcacggtgaacatgcaggatgagaagtcgcagattcagaaccgtgccgccgcgttgcgcgtgctgaagtcccgcctgctggccatgaagcatgagcaggaggccgccgaggccgccgacatgcgtcactcgcaggtacgttcgcttgatcgctccgagcgaatccgcacatacaacttcccggaaaaccgtatcgtcgaccatcgcacgaactacaaggcttacaaccttgacgccgtgctcgacggcgacctgcaggccgtcatcgattccgacatccaagccgacgaggccgaccgtctggccaatcagaaatgactttgccggatggctcccctctgtgaggggagctgtcagcgaagctgactgaggggagcctaatgtccgatcaacggagaccgccagtgcttattaccgacatcatcaaccaagcctcttcgcaattgcgcgaagcgggtgttgagacgcctgagcatgatgccaagttgctccttgccgaggcggcaggcgttgaactgcgcgacgtcgacagggctctgcttatgggggaggaacttggcacaaccggacagcttgccgtcttccgtgccatgctcgaccgccgtgccaagcgcgagccgctgcaatacatcaccgggcatgctcctttccgctaccttgacctgaaggtcggtcccggagtgttcattcctcgtccggaaaccgaaaccgtggtgcaggccggccttgactggctgacaaaaaacggcatgatccatccttgtgtggtcgatttgtgcgccggctccggcgcgattgggctgtccgttgtcagcgaggtgcccggcagccaggtgtgggcggtggagctgtcgccgaacaccaccgaatggacgcgaaggaatctgtcggaaaccgcgaaaaagtacccatccattgcctcgaattaccatctggaaatcgcggatgccacgtccttcgccacattggcccaattggacggcaccgtcgatatcgtcatcaccaatcccccctacgtgccgcagaccgatattcccgagcagccggaagtgcgtgattgggatccggaattggctttgtatggcggctcgatggacggtacgttgattcccgagcgcattatcgagcgggcctgccgtcttctcaagcctgggggcgcgcttgtcatggaacatgacgtgacccagggggatcgtctcgtggcctttgccagggccaccggattcgctgccgcatcgaccggccaggactggacgggtcgcgaccgctacctgtttgcagtgtcctaagccccacgaatcccacatttccttgggattgcattctcgtttccgtaattgcgctgtctcataataagaacactttattgcgggttcaaagccggtctggttataacagtccgcgacaaacatcggatgagagagacgtggatgacggtcacaagccgtgtgatgtagttctgtggtatgcgaattatgtgagtggaacgtctcacgcgcacatcccgcgcgttggttgacagatgaacgatgttgaaatatcccaaggaagaaggaagaggatgaacgtgaagttctccactaagttcgttgcggccagcgcggccgcggttatggcgttgtccctcgcgggctgctccggcggcagcatggatgattcctccagctccggtgccaaggcctccggcgactccatcaccatcggcaccgtgaccaccaactccggtaccgccgccgcttacggcgaggccgaggtcaagggcttcgagctggcggtctccgagatcaacgccaagggcggcatcaacggcaagaaggtcaagctcgagtccatggacgacaagggcgacgccaccgaagcctccaacgcctacaacaagctcgccggcgacaacaacgtgctcgccgtggccggcccgaccatttccgccaccaccgcagccgtggccccgctggccgaccagtccaagctggtcaccatcgccccggccgccacctccgactccatcgaaaccggcaattacctgttccgcacctgcttcaaggactcctaccagggtgaggtggctgcacgcttcgccgccgagaacctgaaggtcaagaaggtggccgtgctctacggcaccggcgatccgtactcctccggcgtgggcgaggccttcgccaaggccgccgaaaagctcggcctcgaagtggtggacaaggaaagctcctcctccgccgacgacaccgagtactccgcccagctgcagaagatccaggcttccggcgccgagctgctctacgctccgtactactactccgtggctggcccgtacatcatcccgcaggcccgctccgtgggtttcgagggctacgtgatgggacccgacggatacgatggcctcaagctcaccggtgacaagtcccagtacaacaagacctactacaccacccactactctgccgacgacaacaccaacaccaaggtgcaggacttcatcaagtcctacaagtccaagaacaacgccgagccgaacacgttcgccgctctgggctacgacaccatctacatgatcaagcaggccatcgagaaggccggtaagaacgccacccgtgaggatgtgcgcaacgccgtggccagcatgaccttcgacggtgtgaccggcaagttcaccatggacaagtccggctcgccgaccaagtccgtgatcgtgctggaaatgaaggatggcaagccggtgtacaacaccaccgtgcagcccaagtgaattccatgaattcccaccgcataatcacgatgtcctagcgtgacttccgcatgaacaggagagcgaccggttttgccggtcctctccctttcgtgttttcacgggctcggatgcataaggacagccgccgatatgcggatatcgccaggcgcgggcgtatcgcgccatcaatcgcaagacatacgaatatctctacgcgcgcagcggtagagaaccacaacattgatagaaagggggagctatgaccgatcagatcatcatgttcatcagccagctgttcaacggtctgaaaatcggcagcgtgtacgcgctggtggcattgggctacaccatggtctacggcatcatccgactgatcaacttcgcccacggcgatttcatcatggtcggagcctacgtgctcatgctcaccattccggccatcgtggccatgggactgcccgcctgggtggcggtcattcccgccatcctggtatgcgtggccgtcggcgtgatcgtcgaaaaggccgcctataagccggtgcgtgaaaagggcaactccatgaccgccctgatcaccgccatcgccatgtcgttgctgctggagaacggctcacaggccatcttcggcgccgacttccagaccgtcccgaccatcttccacctgccgtccatcgcgttcggcaagctcaagctgccgggagacaccctgctgaccatcgtcatcggcctggtcatcatggtgggcctgcagctgttcgtcaaattcaccaagcagggcaaggccatgcgcgccgtctccgaagacaaggaggccgccgtgctcatgggtatcaacgtgaactccaccatcgccctgacattcgccatcggctccggtctggccgcggtcgcctcgctgatgtactgcgccgcctacccgcaggtctcgcctatgatgggcgccatgctgggcctgaaggcgttcgtcgccgccgtgctcggcggcattggttccatcccgggcgccatgatcggtggtctggccatcggtctgatcgaaagcctgaccaaggcgtatatcggcaccatcacggcgggcatcatcacctcggcgttctccgacgccatcgtgttcgccatcctgatcatcgtgctgctcgtcaaaccgtccggcattatgggcaagaacgaaggggagaaggtctgatcagatgaagaagacaatgctttccaccaaacagtcctatctggtgtgcttcatcggcatcctcgccgcgttcggcatcgtgatggcgctgtgcgaatccggcttggccgactcctacatcaagggcatcatgatgaccgcgtgcatcgccatcatcatgaccacctccctgaacctcaccatcggcgtgctcggccagctgacgctgggctgctgcggtttcgaggccatcggcgcctacgtggccgcactgacctccaaatacatggtcgccgccggcattgccatcgaccccaccgcccgcttcctgctcaccacgctgatcggcggcgtggtggcctgcgtgttcggcatcctgatcggcattcctgccctgcgactgcacggcgactacctggccatcatcacgctgggcttcggtgagatcatccgcgtgatcatccagaacctcaaggtagccggcggcatgggcctcgacaagggcgccgccggacaggcgctgatcggcatcgaacgcaccgccaacctgtacgtcgtgttctggatcatggtggtcaccgtggtcgtgctcttcatgttcggccgctcccgttacggccgtgcggtcaaggccatccgcgacgacgagatcgccgccggcgcctccggactcaacaccacgtacctcaaggtgctcgtcttcgcaatctccgcgttcttcgcgggcatcgccggcggtatcttcgcccagtacatcggctcgctcaaccccaccatggccggttggctcaactccatcaactacgtgatcatggtggtgttcggcggcatgggttcgctcaccggctcgatcgtctccgccatcggcctgaccatcctgcccgagctgctgcgcgccttcgccgactaccgtatgctcgcctactcggtggtgctggtgctcgtcatgatcttccgcccgcagggcatcttcggatcctgggagttctcactgccgcgtctggtcaaccgcatgctgttccgcggcgccgccggcaagggcgcgaaacccgcggccagcgccaagcagcatgaccagtccgacgacaagaccgtgaaggaggcctcacgatgagcgacgcaacccagcccatcctcaaagccgaacatctcggcatcaccttcggtggtctgaaagccgtgtccaacttcaacatgaccatcaacaagggcgaactcattggcctgatcggccccaacggcgccggcaagaccacggtgttcaacctgctgaccggcgtgtacaagcccaccgaaggcgagttctggctggacggaacccggatgaacggcaagaagacctatcaggtcgtgcgtgccggcatcgcccgaaccttccagaacatccgcctgttcaagcagctcaccgtcgaggagaacgtgctcgtcgccttcgatgagtcgttcacctaccacatgggcagcgccatcttccgcaccccgggcttctggaagcaggagaacgagatgcacgagaaggccatcgacctgctgcgcatcttcaacctcgagggactggccaccacccaggcggccaacctgccgtacggccagcagcgcaagctcgagatcgcacgcgccctggccaccggcatgaaactgctgctgctcgacgagccggccgccggcatgaaccccaccgaaaccgaggatctgctgcactgtatcaacacgatccgcgaccgtttcggtatcgccatcctgctcatcgaacatgacatgagcctggtgatgagcgtatgccagcgcatccaggtgctggactatggccgcaccatcgcatccggcacgccggaggagatcgccaacaacccgcaggtcatctccgcctacttgggcagcgacaacaacgatgacgcggacggcgattccaccaccaaggcggaaccggagccaagcattgccaagacactgacggaaggagcgcgctgatgctggaaatcaaggatctatgcgtttcctatggcgcgatcgacgcggtcaagggcattagcctcaaggtgaacgacggcgagatcgtctccctgatcggagccaacggcgccggcaagaccaccaccctgcacaccatcaccggtctggtgccggccaaatccggcagcattacctatgatggccacgatctgctcaaaacgcatgcgaacaagatcgtcacgctgggcatggcccatgtgccggaaggccgccacgtgttcacccgcatgagcgtgcaggagaacctggagatgggcgcgttcagtctcaaagaccagtccagtctgggtaaggatcttgagatggtgttcgactacttcccgcgtttgaaggaacgtcgccgccagctgtccggcacgctttccggcggtgagcagcagatggtggccatgggccgcgccctgatgagccatccgaagaccatcctcatggatgagccgtcgatgggtctgtccccgctgctggtcaaggagatcttcgacatcatcgtcacgctgcgcaagcgtggcatcaccgtgctgctcgtggagcagaacgcgaagatggccctgtccatcgcggatcgcgcctacgtgctcgagaccggcaagatcaccatggagggcaaggcctccgacctgctgcacgacgagaaggtgcgcaaggcgtacctcggcgcgtgacgtctcacattactatgctcccgctggcgggagctacctcacgaagtgaggctgagggtggttatcggagatttccggcaaccaccctcagtcagctccgctgacggctcgccagcgggagcattcatatatcactgcgcgtaatactgtagcgcggaagcatccttatccgtaatctcgcgaatcggacgggccggattacccacggccacggtgtgcggcggaatatcgcgcgtcaccaccgagccggcaccgatcacgcaaccctcgccgatcgtcacgccgtcgattaccgtcacattgccgccaaaccagcagttcgagccgatgacaatcggcttgccatactcgcagtcgtatgcggaaccatcaggtgcctgcctcacgttacgatcctgccaacgcaacggatgcatcggtggcagcagcgaaacgttcgggccgaacagcacgtcgtcgccaatcgtcaccgggcaacaatccagcacagtgaagttgaagttggcgaacacgcgctctccgatggtgatgttgcagccatagtcgaagaaaatcggccccatcacgtcaaggccggcaccgtggccgggcagcagctcatcgagaatcgcggcacgggcggcatgatcggtacgcgacgcggcgttgaagcgcgcgcacaggtcgccggccttctcgcgcagggcattcaattcagggtctaccgaattgtacagtttgccggcgagcatctcctcgcgctcgctggcgcgcggcatacgcagttcgacgggaggcatggtggtggattcagcattgatttcgctcattgaacactcctgtaatttcgcgaaagagcatggatggactcattgtatctacggtctgtgcgtgtggggcgaatcggaaaacggcagtacggcaaacgagcgatgatgaactatgcaagtcggggcgcaatggtgcaatggtagattgtgaatacacaagcgaacggaggtggcgtgagcgtggaaggcggaacaacgctgaaagtcacggatgaatcgctggcacaggcggcgcgtgtcatccgggatggtggattggtcgtcattccaacggatacggtatatggagtggcgtgcgatccgcgtaataaggccgctatcgaccgtatctaccggctcaagcgtcgcccgcgctataaggcgttgcaggtactgctcgcatccaccgaccagcttgatgagctcggtctcgacctgccgtccccgctgaatcgtttgtcggcggcgtttctgcctggcgcgttctcgccgattgccgtagcccggcccgactgcacgttggagactttggccgacaccgccgatggtcgccccggcacgcaaggcatccgcatccccaattcggcgctgtgcctcgcgattctcaaggcgactggcccgctggccgcgtccagcgccaaccgttccggcgacgaaagcgcgcagaccgtccaggaggcggttgacgcgttcggcagcgaagtcgacctgtatctggacggcggtcccacccaaggccatgtctccagcaccgtcgtcaaagccgatccgtacgcgcgcgacggcatcgagatcctgcgtgaaggcgtcatcgcccaaaacgtgattcgcaaggccctccacctcaacggcggtggactcggcgcatgagaatctacctactgattgccgccatcgccggtggcgtcacctggctggtgactccgctgattcgccacgtcgccatcgaaatcggtgcggttggcgaggtgcgtgcccgagacgtgcacaccattcccacgccgcgcatgggtggccttggcatgctgatcggttttgccgtggctaccgtattcgccagtcggctgccttttctctcgggattgttcaacggcaattaccagatgtgggtgattcttgccggcggcatcatgatcagtctgctgggcatggccgatgacctgtgggatctcgattggatgctgaaacttgccggtcagctgctgatttccgtattcgtggcttggggcggattgcagatcatctcactgcctttgggcggttcgctgattaccgcctcgccgagtctgtccatggcgatcaccgcattcctgattgtcgcctcgattaacgcggtcaatttcgttgatggcctcgatggcctggcggccggtatcgtggcgattggtggcatagcgttcgccgcctattcgtatatcatcgcccggtcttccccgagttatgcttcgtcggccacgctgatcgacgtgatgatggtgggtatctgcgtgggcttcctgctgcataattggcatcccgccaaactgtttatgggtgattccggttcgatgctgcttggctatctcatcacctgcgcttcgattgtgatgaccggacgtcttgacccggcctcgattcatgccagcatctatctgccggtgttcatgccaattctgctgccgattctggtgttgttcctgcctgtgctcgacatgtgtctggcgattgtgcggcgtttggccaaaggccagtcgcccatgcatccggaccgtatgcacctgcaccatcgcatgctgaagatcgggcattcggtgcgtggcgccgtgctgatcctgtggggatgggccgcgctgatcgcattcggttcgctgacgattctgttcttcaaagcgcagcatgtggccgtgggcatgcccatcgccgtggtggtgctgaccatagccacgatgtacccctatctgcggcatcgtattcccgagatccaagccgagaacctgacgctcgaatccgcacgcaagaacgcgcagcatgctacggttaagtcgcagtctgcagtaggggagagccgggattcgattggctctcaggcagcggattcgatgactgattcgcctgcggattcgcgggactcgcaggcgggtgaggtgcaggacccggcagcggataagtgagcgctcacaagcgtgtgtcgtgaaggtcagcgcgtgttcatatagtgtttgtatggctacaaacctcgatgaattgaacgcccaatcggcgtatgctccccttcctccgattttcgccaagctcggccttgcttatgatgatgtgttgctgctgccgaacgagacggatgtcattccctccgaagtggacaccagcactcatctgactcgcaagatcgtgatgaaggccccggtcctctccgctgccatggataccgtgaccgagtccgagatggccatcgccatggctcgtaacggtggtatcggtgtgctgcaccgcaatctgtccatcgacgaccaggccgctcaggtcgatgtggtcaagcgttccgagtccggtatgatcaccgacccgctgaccgtcaaccccgaggtcactctggccgacctcgacaagctgtgcggcaagttccacatctccggtctgccggttgtggacaaggaaaacaagctcgtcggcatcatcaccaaccgtgatatgcgcttcatcgcctccgaggattacgacaccctgaaggttaaggatgtcatgaccaaggagaacctggtcactggcccgtccaacatttccaaggacgacgctcaccgtctgctcgcccagcacaaggttgagaagctgccgctcgttgacgaggaaggccacctgaccggcctgatcaccgtcaaggacttcgtcaagaccgagcagtacccggacgccaccaaggatgagcagggtcgtctgcgcgtggccgccggcgtcggcttcctcggcgacgcctggcagcgtgcctccgctctgatggaggctggcgtggacgtgctcgtggtcgacaccgccaacggtgaggcccgtctggcactcgacatgatttcccgcctgaagcacgactccgccttcgacggcgtgcagatcatcggcggcaacgtcggcacccgctccggtgctcaggccatgattgaggctggcgcggacgccgtcaaggtcggtattggccccggctctatctgcaccacccgtatcgttgccggtgtcggtgtcccgcagctcaccgccgtgtacgaggctgcccaggcctgccgtgccgctggcgtgccctgcatcgccgacggtggcatccactactccggtgacatcgccaaggccctcgtggctggcgcttcctccgtgatgctcggcggcacgctcgctggctgtgaggaagccccgggcgagaaggtgctcctgcacggcaagcagtacaagctgtaccgtggcatgggctccctcggtgccatggccccgcgcggcaagaagtcctactccaaggaccgctacttccaggccgacgtgacctccagcgacaaggtcgtgccggaaggcgtggaaggcgaagtgccgtaccgcggaccgctgaacgccgtgctctaccagatgctcggtggcctgcaccagtccatgttctacatcggcgcccacaacatcgccgagatgccggagcgtggcaagttcatccgcatcaccgacgccggtctgcgcgaatcgcacccgcacgatatcgtgatgaccaccgaagccccgaactactccggcttccacaacaactgatcggttgatgcccgctagcttgcgctagttaggggttgattccttgtgaaaagggtctgcttatgcaggcccttttcgcgtatgtggctcgagatagcttgtatgcgctggggtatagtctgaactgttcttgtaataacgggtgacatgacgaaaagaggcttaccatggtcgacagccatgatgcagaaacttacagcgcaaaggattcgcgcctgatttggattgactgcgaaatgacgggcttggatatcttcggcggcgacgaactcgtcgaggtgtccgtagtgcccactgactttgacctgaatgtgctggacgagggcgtggattacgtcatcaagccgtccgagaaggccgtgaaccatatgaacgatttcgtgcgccagatgcacacccgttccggcctgatcaacgagtgggagaatggcctgagcctggccgaggccgagcagaaggtcaccgaatacgtgctgcgcttcacgccggaaggcgtgcgcccgctgctggccggcaacaccatcggctccgataagaagttcctcgaccattacatgccgaacctcatgagccacctgcattaccgcagcgtggatgtgagcacattcaaggagctcgcccgccgctggtacccggccgtgtacgagaaccgcccgccaaagaacggtggccatcgtgctctcgcagacatcatcgagtccttggacgagctgcgctactaccgtaaggcgtttatggctcccgcccccggcccggacgatgccgcatccaaggccatcgccgccgacatcgtagccaccagcatcctcaataagtagtccgccgtacttggctcccctccctgaggggagtctagagaggttgatatgcgccaaaccgaagccctggccattctgaacgccggcgcgaacgtgttcctgaccggtgcgcccggtgccggcaagacctatgtcttgaacgagttcatccgccaggctcgggccgacggcgccagtgtggcagtcaccgcgtccacaggcatcgcctccacgcatatcaacggccaaaccatccattcgtggagcggcgtcggcgtggccaccgccctgagcgccagcctgctcaaactcatcaaatcccggcgcaaacgcaagattcaggccacggacatcctcgtcatcgacgaggtttccatgctgcacgcctggctgttcgacatggtcgaccaagtctgccgcgaagtacgccgtgatccacgcccgttcggtggcatccaggttgtcttgtccggcgacttcttccaactgccgccggtttcggtgtccgggcgcaaccgcgacctcatcgcccccacgcccgaattcatcgccagtcgcgaacggtatgcccgtgccggcttgaaccccgaaggcttcatcaccgaatcgctggtatggcccgaactcaacccggtgatctgctatctgaccgaacagcaccgtcaggataccggcgaactgctgaccgtgctcaccgacattcgcgaaggcgacgtgacccagtccgaccgtgacgtgctcgtcactcgtctgggcaaactgcccgagcccggccaggtcgccgtccacctgttcccggtgaaccggcaggccgacaatctcaacgacatgcgcctgaaccagatcatgcttgagccgcacgagttccacgccgagacagcaggccctgccaacctggtcgaccgactcaaaaagaacatgttggcccccgagcgattgatactcaaggaaggcgcggctgtcatggccctgcgcaacgacaccgatcgccagtacgtcaacggctcgctcggcaccgtgcgtggcttcgcacaggagaacaagggcggctggccgatcgtggaattcgagaacggcaacatcgtcaccatgaaacaggccacatgggagatgatggacggcgacaccgtgctcgcctccgtctcccaggtgccgttgcgctgcgcgtggggcatcaccatccacaagtcgcaaggcatgacgcttgaccgtgcggtcatggacctgaagcgcactttcgcgccaggcatgggatatgtggcgctgtcccgagtcgaatcgttgggcggcctctatttggccggcgtcaacgaacgcatgttcctcgtctcgcccgatgccgtggtgctcgacggcgacctgcgcgaagcctcggccgcggcctccgaccagttggccgatgaaggtgcaagcgcgttcaaacctgttgagccggacgaattcggtgccaattccgatgatgacttcgcccaggacgcgttattctgatctttagaagcgctccgtagcggctaccatggaataagaggtggtagttatggtgctatctgagatatttcgtggaaacaatgaggttcgcgaggccgcccgagccggtgtgcaaatcgatacggtcagtgtggctagtgcgtcagatgcagcaagcgcggcagacggcagcggcaaaatcactggcgcaatacgtccgtcagcggtggccggttcgttttatccggctgaccgcaccgcgctcaaacagctaatcaaccagcagctcgattacggccgaaagcttctgcaacagttggagcccacacttccagcgggggtgccgagggcggtaatagtgccgcacgccggatacatatattccggcacggcagctgcgctcgcttacgcgctcttggagcgtgggcgggggagcgtgactcgcgcggtaatcgtagggccgactcaccgcgtggccgtgcgaggcgtcgcctgttccacggcagcggcgtttgaaacgccgctgggcactgtgccggtagacattgcagccgagcgtaaggctctgggcctgtctgtcaatgagccattgcgctccggtacacatgcccgtccgggcgcgccggctcccgcaatgatcgtcaatggcccaacccacgcacaagaacatgcggtagaagtgcagattccgttcctgcagaccgtgctcggcccagacctcactatcgtgccgttgaacgcgggcgatgccacgccacaagaggtgggtgatgtgttgcgtgctttgtggggtggcccggaaaccgtcatcgtgattagttcggatctctcgcactatcatccgcacgaagtcgcccgcgcgttggatgaccagaccattgcggacattgcggctttgcatctgccgattcaccctcgccgggcctgtggcgcatacccgatcaacggccttctggatgtgttaaaaggccgcaagggcatgaggctcttcgagctcggctgttccacttccggcgacgacggcgtggtggcgctcgccggccaacctcgccccgcaatgcgagacgccgacgagccggtagtgggatatgtctcgtttgccgcgtgggaatccaagccggaagcagatgctctagccggtgcagatgacttaggcacatcgggtacgccatcccacggtgaggtgctgctgaaacttgcccgtgccgctatccgggaacggctgcatatcgagcatccgaccgccgctgattcgaccgcgtccattcttgccgcaaacccgtggctgaacgagtccggtgcctgtttcgtcaccctgaccgagggtggccggctacgcgggtgcattggttcgttggtcgcccaccgctcgctcggcaaggacgtggccgagcacgcagtggatgccgccacccgcgacccacgtttcaacccggtcaccgccgcggaatacccgttgctcaacgtggaggtatccgtcttgggcgagcccgagccgattaccgtgaactcctgtgacgccgattcgcgcggtaccggctcgaagaccgcgactctggcattgctgcaatccggacctcagaccgacgccgtcaaacgggacggcagcaacgtcgaacgcccggtacgttcgcgcactgaacttgaggaagtattacgccccggcaaagacggtctgattctcgccgaccgtcgtggccgcagcgccacattcctgccacaagtgtgggatgagctgcccgatccgcatgatttcgtcgctcacctgctcgccaaagccggtatccgcccttcctacgactggaccgatagcgaaatcgactgtcaacgctacgaggtgaccgcctatgccgagcactaacgcagcaaccatatctcctcccgctggcaggaagtggcgcgaagcgccggagggtggtcatcgggaatcgtacggtcatgcggcgtcagtcacagatgttcgtaaccccgccatagcccgctggcaaacgcaattccacgacggtaccaaccgcgctcgctgcgaactatgcccgcgccgctgcgtactgcgccccagccaacgcggcttctgtttcgtgcgctcgaaccacgacggcctcatcgtctccgacacctacggccgcagctccggcttcgccgtggacccagtggaaaagaagccgctcaaccacttccaccccggttccagcgtgctgagtttcggcacggctggctgcaattccggttgccgattctgccagaattgggatattgccaaagcccgcagtttcgaccggctcggcgtggaagccagtccggagaaaatcgcgcaggtcgcggccgaccggggcatcgattcggtggcgttcacctataacgatccgatcgtgttcgccgaatatgccatcgacacggccgaagcctgccgagcgctcggcattcatcccatcgccgtgactgccggatacatgagcgccgaagcccggcccgacttctacgccgccatggacgccgccaacatcgacctcaaaggcttcaccgaagagttctattggaaagtgaccggcactcatctggccgatgtgctcgagaccatcgactatgcggtcaacgaggcacgcacaccagaaggcgaacacgtgtgggtggagctcaccacgctactcatccctggattcaacgatgacgacgcccagctgcatgctgaatgtacatggatacgcgagcacttgggtccggacgtgccgctgcacttctccgcattccaccccagttaccgcatgatggacgtaccgcccaccccgcacgagactctgacccgcgcccgagacatcgccctcgaagagggactcaattatgtgtacacaggcaacgtgcatgatcgtgaaggcgataccacgtattgcccaaaccctgaatgccgggccaagctcgtggaacgcgattggtatcgaatcattgccaatcgtttatctgccggatacggtggcaatgggcactgccccgtatgcaggactgctatcgccggacgttggtaatctgcctcaggtcgcccgcgcgattcaccgcagatcgccaatacgcgtggcaatcgtcctcatcgatttgaggctcgcctcatagcgcgcggctgccacaatcagaatgatgccgcccaaagcaagccacaatgccggccagctacgcagcatcgggcgtacttgcggcaaacgcacacccacaatcagcgcggccgctccggacaggccggcgataagatccaccggggcatacggttgcgggttggtccatgcaagaccgaggagtattacgccggcaagaatggtggcgcatgtctcaataacctgtgatgcggtcagccgtcccgacgaacgcccgaatcgctcttgcgcgactgatggttggttcggctgggccattgccggattcgggtaggggcagggagaagcataggcccggcccggctgttacggttgatacgggcaggccgcttgttccgggaccgacataggcgattgcgcaaacggtggcatggccattggctgttgcgataccgcttgttgtggaactgccgttgggaattgcgggggctgcagcagaaaattgcggggcccatgctggggccggttgatacaccggctgctccgaggattccggctgattcccctgttgctcggtcggttgcgtcatcgtgcccttctacccttctagccgtcattgttgcacgagtgagtccgaatgccaagatgaaggtcggaatagtgcgaatagcaggcgggcttgtcggttcacgcgaatatcgtggaacacatgacttccaatacccttcgtatgtcaaccatgttcctgcgcaccctgcgcgaggaccccgctgatgccgatgtcgattcagccaagctgctgcagcgcgccggctatatccgcaaggccgcacccggtatctggacctggctgccgctcggtctgcgcgtgctgaacaagatcgaggccatcatccgcgaggagatcaacggcatcgccgcccaggaagtgcacttcccggccctgctgccgcgcgaaccctacgaggccacccatcgctgggaggagtacggcgataacatcttccgtttgaaggatcgccacgaggccgattacctgctggcccccacccacgaggagatgttcacccttctggtcaaggacatgtactcctcttacaaggacctgcccgtcaccctgtaccagatccagaccaagtaccgcgacgagttccgtccgcgcgccggcctgatccgtggtcgtgaattcgtcatgaaggacgcctactccttcaccatcgatgaagaaggcatgcgcaaggcctactatgacgagcgcggcgcttacgagcgtatcttccagcgtcttgacctgaagtacgtacctgtgttcgccatgtccggcccgatgggcggctccgcatccgaggagttcctggctccgatgccgatcggcgaagataccttcgcgctggcaccttccggcaaggcatggaatgtggaggccctgagcactccggaactaccggaaatcgatgcttccaccactcccgccgcttccaaggaagccaccccggatgccaagaccatcgataacatgatcgagcgtgccaacgccgaccacccgcgtactgatggccgtgaatggcaggcttccgacatcctcaagaacgtggtgatcaccgtcaagcaccctgaggatgaagagcatgacgagccgtggcgtgaagtgattgtcgtcggcgtgcccggcgaccgtacggtggatatgaagcgactggaagcccagttcgcgcccgccgaacttgaggaagccactgaggaagacctgaagcagcaccccgaactggtgcccggttacatcggaccgatggtgcttggcccgcaggccgaggctgctggcgtgaagaacccggttcgctacctgatcgacgcgcacgtggtcaagggttccgcttggttcactggtgccgatgagaacgaggtcgactactacaacctggtgtacggccgtgacttcaaggtcgacggcgtggtggaagccgttgaggttcgccacggcgacatgagcccggatggttccggtccgttgagcttcgagcgtggtgtggaaatcggccaggtgttccagctgggtctcaagtactccaaggcactggacctgaaggtgctcgaccagaacggcaaggccgtgccggtgtggatgggctgctatggcatcggtgtttcccgcgtgctggcctgcatcgccgaaacacaccacgacgaagccggcttggcttggccgtccgtgattgccccggctgccgtgcacgtggtggccaccggcaaggacgccgtggcgtttgaaggtgccgagaagctggtcgccgagcttgaggccaagggccttgaggttatttacgatgaccgcaagaaggtgtctccgggcgtcaagttcaaggatgccgagctgatcggcgtgccgctggtcgccgtggtcggccgcgattacgtcaacgacggcaccatcgaactgcgcgaccgcaacggcgaaaacaaggtcgccgtgcccgccgccgaagccgccgacgcgctcgccgagcgcttcgccgccctcagttgagtcccacttactcagcctcggcgttaatcgcatcaagcgccattctgcccagtcgcagaatggcgctttgttgtggataaccgaaacttatccacattcttaaaatttcaactgcgtcacagtatccacatttgccagttgcccttgtgcgcttcaaacgtcatgcctcacagtggaggtaccgctggggcgtgcaagccggcaatgaagccggagacaggctccggcggtccacatccaaacaacaggccagcaggccgaggaaaggaccgatcatggcaaatcaacaagcagcagtgaccgtcaccggctttgtggccggtgatccgacactaggcggaaccgagagcttccgcgtgctgacattccgtatgggcagcacgcgcagtcgactcaacccgactaccagacaatgggaggattacggaaccgcatgggtgggcgtcaaagcgttccgtgctttggccgtgaacgccgccagttcggttcgccgcggtgaccgcatcattgtggtcggctcactcatcaccgagcagtggaccaatgagcaaggcgaaccgcgcagtagaaccgttctcgaagccaccaacattgggcatgacctgaccttcggcaccacgtcgctgatcaagccacagcgtgccggtaatgggaacggaggcaatggtggcaacggtaacggcaatgccaacggtgccgtcgaaggtatggatggcggaaacgggcaacgagcatcgtcgccgtacgttaggccaacgcaatatggcgcgggcggtgccgcatccggtgtgggtattgacccgtatgcgacctcgtcggaatctggccccgtcgaatttggggtcacctccgattccggccaatcgccgtcgccatcaaccgagtccgcggccgtggccgatgccgtcatgtcgcaaccggacgccgacaccaatcaaccacagcccgtggcccaacaaacctacgtcgacggtttcgccgaatcttccaatcccagtgattccgaattctgagtgccaaccatacatcatgaaaaaccgctgtgttcgcctgtaatcgaggcaaacacagcggttttcctttacataacggggattaccaaatacgcacacggtccttgggcgcgagccacatggcgtcgccttcggtcacgccaaaggcatcgtagaagaggtccacgttgctggcgatgccgttggtgcggaattcggccggagaatgcgggtcgatctgcaggtactgttcggccagctcgtcgcggttcttggtgcgccagatggaggcgtagctcaggaagaagcgctgcaggccggtgaatccgtccatttcgggggcggtatcgagcagtgccttgatggcggcgggggagccgtcttctttggcgtcggacttacctgccgccttgccgagcgcgaatgcatacgccttgagcgcgatgttcacgccgcccaaatcgccgatattctcgccgatggtcagcgcgccgttcacgtgcggtgccttatcaggctcgtcagcgtacttctcggccagctgcagcggcacaaagctgttgtactgggcgatcaatgcgccggtacgggcctcgaagttcttgcgatcctcgtcggtccaccagttgttgagcttgccgtcgccgtcgtactgcgaaccctgatcgtcgaagccatggccgatctcgtggccgatcactgcgccgatgccgccataattcgccgcatcctcggccttcgggtcgaagaacgggggctgcagaatcgcggccgggaacacgatgacgttcatgctcggctcgtagtaggcgttcaccgtctgcggattcatcagccattcgtccttgtcgaccgacttgccgaccttggccagctgatagccggtctcgtacaggttcgcggccttggcgttctcggcgggcagcgcatccgcggaaacactcagcgccgaataatcgcgccagtggttggtgtagccgatcttcggcgtgaacttggagatcttctccagagccttggccttggtgtcctcgcccagccaatcggaattggtgatggacacgcggtaggcgtcaatcagattggcgaccagctcttccatgcggcgcttcgagctttcggggaagtgcaggcgcacgtattcgcggcccacatcttcaccacaaatgccgttgaccaggctcaccgcgcgcttccaacgatcgcgctgcttcttggcaccggagagcaccttgccgtagaagtcaaagttggtggtgtcgaagtcgcgagacagggaggaggcgaagcccagaatcatgtgaacacgggcccacagcttaaggtcggccagatcggcctcggcccagaacgcatcaagaccagtgaggaagctcggctcgtgcacaatgacgcgcgcgaacacagacttgaaatcaatcggctgagccttggcggcttcggtggcgtcataagcggtctgccaagcgtcgatccaagaaccgagatcgaagtttttcagcgtggcggccagatcggcgtaatcggtggggttgtaggtcttcaccgagtcgcgcgtggccacattgtcccaatggttggcggcgatcttggtttccacggcaaggaagtggcgggccatgccgagcgcggcttcgctgggaaccgtggcgggagcgttgctctcgtcatcgccggtgttggacggcagctcatcgccaccgttggattcggcggcgggcgcgtacccggcgttcaccagctgggtggcgaccatcgccacgtatgcttcgcgcacggggacgtagtggtcctcacgatagtaggcttcgtccggcaggcaaaggccggcctgctcaaggtgggcgatattgcggtccgggtcgccggggtcgccgtaaacggccaagccgaacaggtcggggccgccggctgggttgatggtgccgagcacgcgcgtgagagcggccttgtcgatggcggaatcgatgaggtcaagctcgtcgcggattgggtcaagcccggcggcctctatggcgtcggtgttgaggaatgagcggtacagggcctcagacttgacagccgggcagtcgtcggcgtcgaggatgtcgcgtacttggttttcggcgtcttcggcaagcttgtcgaaggagccgtagcgcgaacgatcgtcgggcaatcggtaggtgtcgatccatgggccattcacgtagcggaacaggtcgttggtcggcttgatgacggaggagaacgatgccgggtcgatgcccgacgtcagcgtttcggtttcgttggtcatggccctaagcctaatcgcggcgggggagaagcgttgatggtgcagatattgcgttatgggcattgcgctgtcagtgaactagacagattgcctaattgtggtgatggttcaaattagacaacttgtctatcatagtatgtggaatctgaacatggaccttgagctaaggagttacgatgagcaatccgaacgaggaccagtggaatggccagacgggccagcccaaccagagccagccgaaccagccgaatccggcgggtcaaccgggccaaccgcagtatggtgcgtatgacagcaatcatggcggccaatatcctccgcaaggtgcgccgggagcgcaagacactcagaatcagcatgcgcagaacggccagccacaaggcgaaccgaaccagaacccgtactacggcccgtacgcctacaatccgaactatggcccgaacggccagccggcatgggggccggacggtcggcggtatcaggcggacggccaatcgaatagccaagcggacgggcagccgaatggtccatggggcgatcaaagtcaacccggctggcagcagaccaactggtatgtcggcaatttcagtccattccgcctgatcgaggaatggctgccggaaaaagccaagaccaagattcgcatcatttacggcgtggtgggcgtggccgccatcgccttgggcgctgcgctgttgctggtgccgaacaagacgctggctttggccgcattgttgctcggcgtgtatttcgtgatttccggcgtggtgcgcatcgtcagcgctctcgtggagccgggtctgccgggcggctggcgtgtgctggacgtgttcgtcggcattctgctgacctttggcggcgtggtggttgtgcgcaactacggcatgaccggtcagacgctggcattactcattactttgatggtcggtttcggatggattatggaaggcgtgctgtcgctggttgaatcgtggcgtatcccgcattccggctgggccatcgcctatgccatcatctcgattatcgccggcttcgtggtgctgatgagcccgctgagctccgccgtattcatgattatcttcggcggatgcgccatggtggtgatggggattacttcagtgattcgcgcgttcactttcggcaagcgtcgcaagtaatctcacgcttcatgcaaccagtccccagacaatcaatccaaagcgcccgtgcaggctatgtgctgccgggcgctttttctcggccttggctattaatgggctgcgagtggatttcaggtaggcttctggcggttgacctcgggctggtctagagttgagaacaagtctcaacaaggtagaaagaatctcatgatcgaactgaaaacccctcgtgaaatcgaggaaatgaagccggctggtcgttttgtcggcggcattctgaaggaactgcaggagaccaccaaagttggtaccaacctgctcgaaatcgacgagttcgtccacaagaagatcgtggaccgcaagggcgccgaatcctgctatgttgactacgctcctgacttcggcaccggcccgttcgcccactacatctgcacctccgtcaacgatgccgtgctgcacggcgtgccgtacgactacagcctgaaggacggcgacctcgtctccctcgatctcgccatctctgtggacggctgggtggccgattccgccgtcagcttcgtggtcggcaaagacccggaccccgaagacctgcgcatcatcaagtgcactgaggaagcgctcgccgccgccatcgacgtggccaagcccggcaaccgtctcggcgacatctccaacaccatcggcgacgtcgcgcgcgaatacggctacccgatcaacctcgagttcggcggtcacggcgtgggccacatcatgcacggcgacccgcacgtgccgaacgacggccgcgcccaccacggctacaagctgcgcgaaggcctggtcatcgccatcgaaccgtggttcctcaagaccaccgacgagatcttccaggatccgaaggacggctggaccctgcgtgcctccgacggctcgcgcggcgcccactccgagcacaccatcgccatcaccgagaacggcccgatcgtcttcaccgatcgcaccaacctctgatcggcgtttggcgtatggtaggtgcctgattggcctgtgatgggcgatcagcgtctcattagccgtccgtctgttcgcggttttcccgcgaattcgagacgtaacaagccgaagtgcgtttgctttgatagcatgagcgcacttcggctttcgtgtatcgaccggcattcgccagcggtaacacagaagacatagagtaccgaacactagtgttcgcgaacgcgtgaacgttaatgtttggggtaagtggttcatgaagaggaaggtgcgcgaatggcaacggcacaacttgatgtcgattcgaacaagttcaacctgcccgtggttaaggctagtgcagggccggatggcatcgtcgtttccaaactgcgcaacgatggctgggtaacgcttgatcccggattcctcaccaccgcgcagtgcgaatcgaaaatcacctacatcgacggcaagcattcgattttgcgctactgcggttaccccatcgagcaactgtgcgagaactccgattttctggaggtggcgtggctgctgcgccacggcgagctgccgagcagggctgagtatgagcagttctgtgcggacatcaatcacaagacgatggttggcgaagacttccgtaccttcatgggttcgttcccgcgctccgctcacccgatgagcgtgcttgcctccgccatcaatgcgctggccacgttctacccggacaccaccgatatttctgacaacgaccagcttgatgaggccgccaagatcatcatggccaaggcccgtacgattgtgtcgtacatcttccgccgtcgtcgcgatgagccgatgctgtaccccgattacgcgcgcggctatgtggacgacttcctgcgcatgtgcttcgctgtgccgtacgagccgtttgaatccgacccgctgtatgtgcatgctttgggtcgtttgttgattattcatgccgaccatgagcagaactgctcgacctcggtggtgcgtatcgccggttccgcccacgccaacctgtattcggcggtggccgctggcgtcaatgcgctgtctggtccgttgcatggtggtgcgaatgaggccgtactgcgccaattgaaggcgattcgtgattccggcaagtctgtggccgagttcgtgcgtgatgccaaggagaatggccagaagatttccggccttggccaccgtgtatacaagtcgtatgatccgcgcgcggcgattgccaggaagtatctggaaaagatcatggagcgcgaagatacgcagaagctgccgtctgacgagcgcgcgctgttcgccgtggccaccgagcttgaagatattgcgctgaatgacgaatatttcgtatcgcgcaacctgtatccgaacgtcgacttctacacgggcttgatttatcgggcgatcggcttcgatccggccatgttcaccacgctgttcgcgctgggccgcattcccggttggattgcgcagtaccgtgagatgttggccgacccgaataccaagatcggccgcccacgccaggtctacaccggtccggtcgagcgcgatttcgtgccgatggacgagcggtgattgttggtttgagaaagcgcttcgctggagattccagtgaggcgctttctatatgtacagcgcaaaccagctatgctgcgacggctgcataagaactagcagggctagttctgaaattgaaataatgtgtgcggtatcgaggcgcaccgagggaaggcgtacgaaggtacgtcgaccgaggggcaacgaagataacgctccattatttcaatttcagttcttgtgcagcttggcgttgagctcaattcccaccttgcggtagcgggcttcgatgcggccgttcaccgagttgcggataaacagaatgttgtctttgccggagagctcagcacccttgaccacttccagcggttcgccagcggcggccttggccttgtcccagatggtgatcttagtgccggcggtgatgtacagaccggcttcgacggtgcagttatcgcccagagagatgccgataccggcgttggcgccgagcagcgagtgctcgccgatggaattgcgcagcttgccgccaccggacaaggtgcccatgatggaggcaccgccgccgatgtcggaaccgtcacccacgaccacgccttgcgaaacacggccttcgaccatggagacgccgagcgtgccggcattgaagttcacgaatccggcgtgcatcacggtggtgccggaagacaagtaagcgccgaggcgcacgcggtcggcgtcgccgatacgcacgccggtgggcactacgtaatcgatcatacgcgggaacttatccacaccgaacacgttgacagtggcggcaggagctgcggcagacagtccggcctgggaggcgaaagcgagagcggcttcggtggaggcgcgttcgacgtcggccttgcgcagcgtgaagtcttcaacggcgaaggggccgtagttggtccacaccacattggcgagctgggcgaagatgccgtcgaggttcagcgtgttcggcttggccatgcgcatgctcatcaaatggagcttcaggtaagcgtccgcggcattactgatcggctcgtccaactggctgacgacgaataccggcacgcggcgaatgccacgggcgtcggcctcatcgtgagccaaagtaccgaaattgtggttcgggcgatcggcctcggccggtgcctcaccgagattcagttcggggtaccagacgtccagggtggtgccggcggcgtctacgctggccagaccccagccccatgcggtacgctcttcgctcatagttgctccttattgttgtacgcgctagtgcacgcttgtggacgcgcgatgcgattaatgattcccaccttagccttatgtgcgcctaggtgagggacgatgcccgcgaaatggcttgaaatcgtatttcccggtaaaaaattaccgagtgtgattggcgatgggatgataggttctccggtgaaattcgctggtgaacaactcgacaaggaggtgtgcgatgtgatgttgcatcattcgggagcataggctgtggccatgcgacgcccggcatcatagagtttgcgcttgagcgaatcgggctcaagaatcactacgcggccatcccaggaatactgcaatgcccaccagaacacagcgcgttcgggagcatcgacgatgacttcgaactgtgtgccgtccggcgaatgtttgatttgagggtcgtcgaaccattcgaacacgttgttgagcatggattcgtctcgtacggccatgcggatgcgaatcggggcatcggctacggggtatggacggtggcgcatgaagttcactgcgtcaaaatcagctggtgctggtttttccagtggcactgtgccgttcctgcctttggcgctgacgttggcgattcggttgaccacgaaaatgcggaggttgtcttcgccatgcaggtggcagatgaggtaatagcgtccgttcttgtacaccatctggtacgggtcggcggtgtaggtaattcggcctgcacccgtacggcttttatgtggtatcaaggtgccatccgggccgtaatcacggtattggaaggttacgccgtggccttcttcgatggcttgattcagctggtcgatagtggataggaactcaccgttgatatgcgtgtaggtggccacatggtccaggtagcctactgcctgcccggcggctcctgcgagctcgcggattttaccgatgaggtcgtccatggtgtcgaggctgatgcgagatagggtaagactgtctagcagcagtcgcatttcggcggtggacaggaatgcatcaagataccagccgggttgtggattcttgcattcgatgccggcaagatcactttcggcgagatgcccgatatgtctgccgagaaattccgtggcggtaagctttttgagctgatttcgtatggtcttctcggtcggcagctcgcttggatcttccagctggtgtttacgggcaagttcatcgagtatttgccgcacggtcaggccatgcccaaagtagctgtgacgccacagcacctcgaagatttcgagggtggtgttccctgcataggatttgcgttgcgccggcttgtctgcatccatacattaaggctaccgcgcgcttcgtctaggatggaaacgttgggttgaaatacattcgctggaaaggaggctcgcccatgagcaaagggtatggtgtgtttggccatgttcccgataatgcggatgacgatggcctcctgccttatgaggatgatgattccggcgtttcctggggccatgcgttgcgtcgtcgcaatccttggaaaaggggagacgacgaagatgccgattacgacgacggtcggtatgacatagatgacactgatgacactaatgggggcaggggcatctatgccggtaaaaacggcggagtaggcggcatttctggtgagacgggtggaatacttggtagctcaggcgcggccggcagcagagacgtaacgtttggtggaacggacagtttgtccgccgccgatgcggtgatgccctatcgtttcaggcaaggacgttccgtatggttcgacgatgaggacgaaggccatttcgccgggtctgcgaagcgtgccgaagcccatgccgtccctatccttgcgttacgcaacgatgtggaatcgtcatcgtcgaatgccgtgctcgctcgtgcccgtagcattgcgcgcaaagcggccaccatggttatcaatccggtatacagcgaaaatcatcgaaccgggtatgccgaacttgacggtattctacgtggcaccaccagcccatcaagtaggtatcgcaccagcgtgcaattcgacctcgatacgggggaggaggtcggcggcaagtgctcatgcccggcttacggccgtggctatggcatgtgcaagcacatgattgcgctcgccttcatattctgcgatgatccgcagcgttttgaaggctaccgtgccggggctgtgaggccgtctcggacgctgattgactatatggagcacgccgataggcaagacgctcaagccaaaattcgtcgtcgcaatgcggttatgcgtcggtttgatgccacgcaagggaaaaacggtgcaaatgctcggcgtacaaaaagcggatacggctctcgtgccggcacccgaggcggcgggtatcagggtgacagcgagactgtgggcttggggcaggtgcagcttgtcccgatattgagtttcatcgacggcgtgtggagcgtggagttcaagatcggctcggcttccaatgggtccagctatgtgctgaaatcgattccgcaatttgtgcttgccatggcgaacggcgactatgcggattatgggcagaagcttgcctttactcatacgccggatatgcttgatgatgattcgcgcccactgctggacgtccttgatgatgcgatggccgtgcgtcgtgcggccgagcagcaggacaggtattacgggcatatcgccatcgaccgtcatctgacgctttcagcaccggaagtggtccggttgctgtccgtacgtgagggcagaggcgtacagctcgtgctgaacacatggttctccgggcagcctgcatcggtgccagttgatggtggcgagccagattttctcatgcgcattgcgcggcgtgatttcaatacgtatggtccggatgccggatacctgcttaccggagtgccagcggtggaaaccgtgattgacggcggcaagaatgtatggctgttgctcgcctccactaatccggccggtgcggtatccgccatgatggcgggctctcagcgtaaaagcgcagcaggatgccgattcgtccgttgcccgaaacgattgattccgttgcgaggactattgggagacctgtttgaacccgatggcgaggggcaggtcattgccggcgatgacatcgctctattcgcacgcacgctattgcctcagctggttggtgctggactgttggaggccagtgagattcctcgcgagctggctgaattaagtcctacggaatgcagcctccagttttatctggatcgtgatgagcatggtgtgcaatgcgaggtcaaggcacgctacggcgatgccattgtcccgttgctacccgatggcccgacggtgcatgctgagggcgagcgttccatccccttgtctcggggcgtgattgggcgtgatttcgacgctgagcatcttgcgattgatgtagtgcgtgaattctttaccatgcctgaccagcgcaagcgcgttgcggccgccactcatcagacggtgaatgggttccgaacgccggccgcgcgaaaggccaccaaaaaattcgtgtctgatgcggccactatcgatcgcgatgacaccacgcagatcgttcgtctctttgacgagggattgccggcactaaaggaagtgggggaggtcttcaccacaccggcttttgaccggctgatcgcgcccaagccaccaagcgtcaaagtcggattgtccatcaaaggcaacttggtggagatatcacccctcgctgatgaagtgccgccggacgaagtgggtgccttgctatcttcgtaccgtcggcgtcaacgattccatcagttgaaggacggaacgcttgtcaaactcagcggcgcgaatctcagcacgttggaccgattggccagtgacctcgatctgagcgagcagcagctcaactccggactgatcgagttgccgggcggtcgagcattcctactggatggtgagctgccggatgacggctccgatgtagtcaaggacgcttcgttcaccgaatacatcgacgatctcaagatcatcgaccctaagtcgtatgaagtgccggatagtctcaagcatattctgcgcccttatcaggtcgaaggcttccaatggctgaacacgttgtgtgacaagggttttggcggcattctggccgatgagatgggcttgggtaaatccgtgcagcttatcgcgttgctcctgtctcgatatcagcggaataccggcgagatgggcaacggcagccttggcccatcgctgatcgtgtgcccggcgtccttggtgtacaactggggtgccgaattcaccaagttcgccccgagcttcaatgccgtggtggtggccggtaccaaagccgagcgccgtaccgccatcggccgtgcgttccgggcggatgaacccaccgtgctcatcacctcatacgacctgctgcgccgagatgtcgatgattacaccgccaatgagcaacgtttcaatgtcatggcattggatgaagcccagtacatcaagaatcacaccacgaaaatagccaaagcggtcaaggccgtggccgccgaccatcgtttcgccttgaccggcacgccgatcgaaaaccgactctccgaactttggagcattttcgacttcctgatgccggggctgctcggctcatataagcgattccatgagcgttatgagttgcccatctccaatgcccgggccgcggatggcagcacggctgaaggtcgggccgccgcacaagtcaatcctgaggccgctcgggtatctcgccaattgcagtcgttggtgggcgtgttcatcaagcgcaggctgaagtcccaggtgttgaccgatttgccggacaagctagagaccacgctgaccgtgcggcttgccggcgaacagcgcaaactgtatgcggctcacgagcagcggctcagaatgcagctcgaacacagcgaagaagccgatttcaacacgtcgaagattcgcattctcgccgagttgaccaagttgcgccagatctgctgcgacccgaggctgctgtacgccgatgccaaggatcaatcggccaagcttgccgccatcaccgaactggtggaaacctgtgtgaacgaaggcaagaaggcgctgatcttctcccagttcaccagcttccttgatctgatcgccgaacgtttcgacgcgcaaggcctgcgctactacaccatcaccggctccacgcccaagaagaagcgtctcgaactcgtcgaccagttcaatgcggacgatacgcctgccttcctgatttccctgaaggccggcaacaccggactgaacctgaccggtgccagcgtggtcatccacgccgacccatggtggaacgccgccgcacaggatcaggccaccgaccgagcacatcgtatcggccagaccgaagacgtcaacgtgtatcaggtggtggccaaggacaccatcgaagaacgtatcttggagcttcagcatactaagagcgagctcgcccgccagttcaccgacgcttccttgcttgccgacgaagccggcaccggcgccagcgccctcaccgaagcccccgcctccatcgccaccctcaccaaggacgatctcctcaatctgctgggatgagaagatcctgctcggtgctcttgagcttggggatggaaacagtctgggctttgtggacccgttcgctaagccgagaccggagtcgatagcggtgtggcatggtgcgtgcgtggggagcgtgattcagttgttggctgaggcgattcggacgctgtcgttttgtgctttgttttgccgttgaccaattgaaatgctcgttggtaggagacccccaataaagctccgatttgtcgatacgtgagtccctcgttgcgtagggcccgtgcggcgagtcgggattcggcagccgcttgtgcgttggctttttttgctatttcgcgctgccggaacatttctgttacgtgttgtttggcttgtttcggcaacacaaacgtcaccttgagctccggattgtcgtcgtcgttcgtgacagtgatgagatctttagccattggctcgatatcgtcaagtcctttggcctgggtcgaccgttcgatagctggtacctgaacgtaccaatatcggtcatcgggttgcacaagcacgtcatagttgctcattgccaccacccctttccgagtttctgctcgctctcgttgatgatatccagcgtggttcgttctgagacttcattatggcgggggatgggtatcctcaacccgtccaggcagtaaacctcatgtctgctgccttgccgtaacaaatagaaatcgagccctcgctgctttgccgcttgccgaagtttcttgatgatgagttttcttcgtgtcatcataactctcaatcccgcactagacaaaatgcgtatgtcgaattgccgggtgggagttgtgggtaaacgtagagatgttcattggtccttctttctgttgtctgacgcgtcgttgcgtgcgggtgcatttgacggtatgggatgaggtctctgattggcaagctgaacgggggtatgtggttctagcttccgagttatccacattgataaggtgcttttttaaagtgactttcccgtgttggtcgtggatgctgcgagcaaggcaagaacggttgatcacgtcgcgatgcgtgtgggtgaatggtgaaagtgtttttcgatatttttgtatcgatattcgatatattatgatggtggcatacggtgcagtgcaggttcatccattgatattgatattggattaaggagcatagccatgaacgctggtatcgcattcatttctcgtaaatctcgcaaaacagacgtcgcttggcgctatgccattgccgtggtgcttgtcgtgtgttgtattgggctcgcatatgtggagattgttgtggcgccgtggtttatcaatgaggtggtgtctatgtttccggagaccacgttgcttaaagaaccgtccatgttctgggaatgggcgattctgctcgccgttcaggcgactttgctgtgcacggcggcgctacagcacctgctccatgccgatgtgatatggagtgagtcccatgcgttcgtagaaggcttgggctttggggttgcaggcccagacgttgagcgttacgttgtggcagccggattgacgggcgaagccgagcacgtagcgatacaaggtggagcctacatggtggccgcgggaccgctcgtcaacgcatagatcatcgatgtacagggttttgatatcggtcaggatattgctgttgaggtgctgctggaacacgcagaatgcgtagccaagcacttggtcggtggcgggggagtcggcgttatgttcggcgtcagtgccgtcattggcagatggcgcaaccgccacgaacacaggggtctgatcgttggtcagaatcgccttcaattcctcgtccgtgtatttcttgacaccgcctttgaacagatccggtcggccggcatgatgcacttcgagcacctgccgcagcagttcgtcgatttggggaatatcggccgccgtggccctacgaatcgtcatgtcatccattgaactcagtctaatcgggcagtctcgaccggcagatgatcattgcccgcgataagagacacggatgggcaagatgggtgatcgttcgttcagggtctcattctcgccgcaacgtcacggtagtctggagtgcgtgaatcgcaagaaacagccagtggagaagtatgagcggggtacccgttcgtacacgatgtcgcatattcgtggcaaagacaccaaaattgaggtactggtacgcagctacctgtttcgcaaggggttgcgattccgcaagaacgacaagcgttaccccggacacccggatgtagtactgccgaaataccacgccatcgtgtttgtcaacggctgtttctggcacatgcatgaaggatgttccaaacattcgatgccgaaatcgaacgtggaattctggcaggcgaaactactacgcaatcacaatcgagacatcgcgcagcgagccgaactggaggccgctggctggcgtgtaattaccgtatgggagtgcgaattaacgaaagccgtgcgcgacgaacgcctcgcacggctgtatgagcagattgttgaaggagatgcagattcagcggaataatttcagctcccctctggagggaagctgaaatcaggattcaaacgggaacttcaggccccaacggtcacgaatcgcatccatcagctccatgatgcggatggtgtcggcgtgcggcatcgcctcgcattcgatcttgccgtccagcagcgcgttggccgcatcggccacctcatactcataaccggtcaactgcggcggcaccgcaatgctgcgcacgggcttgtgggcgttgtcatagatgtcgatggactcgggattgttgatattggtgaccaccagataaccctcggtgccccacacatagccgccgcggtcggaggaaaccagcatcgaactggtggaaacggccatcgtgccgtcgctgtaatacaacgtggtggaattctgcgcatccacaccggtttcggcgggcaccatcgacgtatcgaaatgatcaagtgtacggccatggtcggcgccgaccgccatatccaggaagttcagcggatacacgcccacatcgagcagcgcgccaccggcacaggccggatcggtcatacgtgccttgccggacaccggatagcacaggttggcgctcgccgctttcacctcgccgatctcgccggactcgataacttcgttgatgagcttgcggctgggcatgtagcgcgtccagatggcctccgtgcacagcatgccggtttcctcggccacggccagcgcctcacgtgcctgcccggcgttcgcggtgaacgacttctccaccagcacgttcttgccggctttcatacacaggatcgcctgttcggcgtgcagactgtgcggggtggcgatatacaccagatccacatccgggtccgccaccaactcctcatacgatccataagccttgtcaaaatgccattggtcggcaaaagcctgtgcgcgcgtaatatcacgggccgctaccgcatacgggtgaatccatgaggaatacagtgaatcttcagccatctgggtcagggtgccggccatggtgtgagctatgcggcccgcacccagaatcgcgacgttgattttttcgccgctggcctcgaactcggcgcgcttgccattgaatcgactcattattcctccttgaatgcgggttggtgcactcaatcgacctacagtgattatagaagaagaaaccttgtcccgtgaggcggatagaaccgaaatatggaaaacgaagcagcgcagcagcccaaatctccggccgcgtctccagtcatgtcccgccgagcgcgtgaggccaatcccttccgtgccatggtattcggcgaacaagcagacaagatgatcgcccaaggtaccagcgtcatcaaattaagccttggcgagcccgatttcggcgcgccgcccgccgtacgcgacgccatgcgcgaacagtacgacggccgggccctgccgtacaccgccgccatgggcctacctgaactgcgtcaggccatcgccgacttctaccgcgagcgtcatgaccttgacatcgaccccaagcgtatctgcgtgaccgccggcggttcggccgctctgctgttggccaccgcgctgaccgtggaccccggtgacgatgtgattgtggccgacccctcctacccatgcaaccgcgaacttgtgcggtcgtttgaaggccgggtcatcgatgtgccgacctcggccgccacccgcttccacctgaccgccgacctgtgcagccagtactggacgagcaagaccaaggccgtaatgatcacgtcgccgtccaaccccaccggcaccaccatcgacttcaacgtattggacgaggtgtgcaagttggccgccagccgcggcgcatggcgcatcgtggacgaaacctaccttgatttggctgaccgggagccggacggtaccgaagtcaagtccgtactggcctgcgaccccgatgccatcgtatgcaacagcttctccaagttcttcggcatgaccggctggcgcctcggctgggcgattctgccggacgagcccactgtgctggaagcggttgacgatctggccaccaactactacctgtgcgcccacacgcccacgcaacatgcggcgctcgcctgcttcacgccggaaagcttggcggaatgcgaagctcgtcgtcaggaattgctggcccgtcgccgcattgtgattgacgggctcaagcgcatcggtttgccggttgaggtggagccgaatggcgcgttctacgcctacttcgacatctcccgcactggtctggatgcctggacgttctgcgaacgcgcgctggatgaagcccatgtggctctgactcctggccgcgacttcggcgcggccacggcggatacgcatgtgcgcctgagctatgccgcctcacgtgaggccctgaccgaggggctggaacgtctcggaacgttcgtcgaatcgctgtgaacggcgcggcagccggtgtgattgttgtacagtagtcgagtttgtgtgatgttcggctggcctcacggtgttggttgccggccgaacgactcgccatggtggcgcacggctggctgattgcgatggtcggcccgttgttcggccatcacgggttaggtaaggtcaggaataggaatcatggtcaatctgcgttcgcataccacgcgacttggtgtgcttgatatcggttcgaacactatccacatgcttatcgtcgacgccgcccccggcgctcgccctgaccccgaggccagcaccaaatccacagtgcgcctgatgaagtatttaaaggacgacggctcaatcaagaagtccggcatcgaggcgattctggaagccgtgtcccagtgcatgcggctggccgaggaatacgaaatcacccagctgctggttatggccacctccgccctgcgcgaggcgccgaacggcaacaaagtgattcacaagatcgaggaactgattggtcagggcgtcactgtgctgtctggcacggatgaggctcgcctgaccttcctggccgcccgccgttggtatggttgggatgccggccgactgctggtgctggacatcggcggcggttcgctcgaagtggcgatgggctccgacgaagagccgaccgtagcgctttccgccccggctggcgcgggccgcgtcaccactgaatttctgccttccggcatggccacgcccgacgagttggaagacgtgcgtaagaacgtgcgcaagattctggagccgatggtcaaggttttcccgcaatccaagcacccgaatcatgcagttggcacctccaagaccttccgctcgctggctcgcctgtgcggtgcggtgatgcgtgcgccgggccgcgaagattcatggattatgactcgtgagcagttggaagactggattcctcgtttggcggcgatcgcgcctgagcagcgcgtggctttgcccggcatcacgcctgaacgcacgatgcagattgtgggcggcggcgtggtggccgacgagatcatgaaggccctgaatattcaggaagtcgagatctgcccgtgggcgctgcgtgaaggcgcgattttgcgctggctcgaccaattcggccgcacccgcctcggtttctagtcctattgaggggaatcacccaaccgccacggtagccaacaatgccgcatgatcagagccctcgactttgaccaccttgcattgtccggccttcatgccctgatcaagcaccacgtggtcaataccggcgaacattggcacagccgcacggttcgtgggccatgagaacgtaaacccatgtccggattcacgtgcggcatccacgaaccggtcgccaagaaaatcacggaatggcgtgtgatcgtaagtggcgttgaaatcgcccatgaaaatataccgtgtatccgtatgctcgcgcatcagacccaactcatccagcgatcgcttccactgccgccagtagccgggtacgggagcggtggtgtgcacggatacgaatcgaatctgctggccacccatatccaccgtgccgccgggcatgaatgaggcgctggaattcacgtcatcgtcggtcggatcggcaagtggcgtggccgaccagaggccgttaccgaatacgccgtcagacgatgagacctgcgcatacggcagataatgctcaataccagcctcattgagttttttgacgaaatcctcggtggtctcctgcaaagcaagcacttcgacgcgctgatcgcgaaccagctcgacgatggcttgcgggtcggcctgccccttatacacattgaaggtcatgacgcgcgcgtaggcatcgctggtgttgggggaggctgcggccacggcgttctgcgcggcttgggggagtggatcggtcgagtagaagaacggatattgccaatagccattgcatgcgattgcggcgatggcgattagtgcggcaaggatacgccgcgacacgatggccaacagcagggcaatcaagccaagcaacgtgaaccatggcgttgccgataccacaatcggcgcaaatggcagttcctgtaaatcggcaggcagcgcgcgggcggcagcgccggcaagggcaagaagcgcgaacatcgtggcgagaaaaccaagcagacgatgccgtttgtgtggcttcacggcagacttggatactgggcgtgccgtggctctggcagagcgtggcttggcagcggcgcgagctcgtacgcttgcgcctgtggtagtactccgtgcctttgccatgctgccctttcctccggcttgtttactgttactttgcttttcgtgcgatttgccactgtaccgtgtacggcttgtctttcagtgtcttttcgccgtgcgcaagagcagttcgcaccaaactggcacgaaagaccgggccatgacctgatgtcgggttcctccatgtggcttgctcaggttgccggatggcttgcgcaagctgccacgcgaacatgatgcgactgggcgtgtggccgtgtacaatgaaacgtcgttgcccgagtagctcagtggatagagcaccgctctcctaaagcgggtgtcgtcggttcgaatccgatctcgggcacttggcttcggaaacatgacggtatctcagcctctattcatcggtgatgagccatgggcattaggcatgtgtaaacgtataggttccactatccatcatcccgtcgtgtgaaactatgcaaagacatgtggggcttcacggttgtcgtgagggtccatggctatcgaatacacggaagagaagcggtttactgttgagcaggttgaggcgctgttcaagtcggtaggttgggaatcggcgcagtggccggaacggttgttcaaggcattgcagcattcggatacggtgatcagcgcatgggatggcggccatttggtcggcttggttcgcgtgctcgacgataccgaaatggtggcctatatgcattgggtgctggtagatccggcatatcacgggcagcatatcggcagccatctcgttgaactggtcaaggctaagtatcgcgactacttcttgctggaagtcatgcctgaggaaagcaaaaacgcaccgttctaccagaagcatggcttccacctgatggacgatggccgcgccatgcaaatcgtcaatcgcggctgacgggctggcagtgcggacggcgcaagagcggcggcatgcgccaatcgtgggcaacgtacgtagtcgttgacggttatcccgtagcaatgttcacaatacgaccccttgtccatacagtgaaaataacggctgacgttcgacgttgctgcgctatgactagagaccatgagtgaagacaaacagtatgacttctatgtggccggtccgttctttgatcctgaacaaacggcaagtatggaacgtttggaaaagatattggaagaccatggcaaggtactgttcaagccgcggtttgtcagccagatcgaagaagtaggccctgaaggatgctttgcggacgatatccatggcattaatgctgctaaagccgtggtcgccaatcttatggacgaggacccgggcacgatgttcgaaatcggatatgcgcatgcgctgggaatcccggtgtacggctatttcgaaaaccttacgccaatggatcgtgtcaatctgatgattgcgcaagcggtcgaactggtgttcgtcggtcctgatgatgtggcgaaatacttggaaaccggcgagcatacggaagtcgattacatccagttctaaacagctctaacaggttctctgcaagcagggttggcggcgttctcgtacatagtcatgtacgggaacgccgcagtggtatagggatattccaacaagcggcataatggggtcgtgggaaaaccagtcggatacaagtgaagtgtctgaatttcgtaaggagtgccgttatgagtaaccacaatcccatgaatattgccaccgactttgccaaggccacgggaggaaccgctcgcaaagttgttgctttgaccgataaaggtccgttgaatggctttaagaaattcctgtcgcgcggatcgatgattgatatggcggtaggtgtggtgatgggctctgccgttaccgctgtggtcaattccatcgtcgacaatctcatcagtccattaatcggcatgattggcggcgtaccggatctttccggactgctgaccatcacgttcaacaactcgactgtttcatttggtgcgattcttaacgcgctgattaacttcctgcttgttggcgtggcggtgtatttctgcgtgattttgccgattaataagcttcgtgatctcactgctgcccaggatgaggctgacgctgaagaacaggggcctagcgttgaagagcagactctcgccacgctgcaggagattcgcgacgagctgaaaaaggccaataactccgccgagtaatctgctgaatgtacggtgcgacagatttacctggtttgcccgaaataacggattgccggggccatttggtctggacaatccgttgtttcgcgcgtgttttgtagcatccgtggagttacatggggagtatgactgaaaacatcgctgataaggccataaacgatactcgtatcgtcaagcagttcaccaatcccgtcaaggagccgattgacagcgacatcaacctgttcgatctgctcgataaccgcgccaagcgcgatcccgaaggtgccatgatcgaatacaagggcgatgatggcacttggcacccgtacagcgcccaagtattccgtgacatggtcatcgacttggccaagggcctggtcggacttggtgtcaacaagggcgattcagtcgccatcgtctcgcgcacccgctgggaatggaccgcgctggatatggcgatcatgtccatcggcgcgctcaccgtgccggtgtacgagaccaactccgccagccaggtcagctggattttcaacgattccaaagtcacgctcgccatcgccgaagatgacgggcagcgtgacaagatcgaatccgtgcgcgatgaggtgcccaccctgcgcaacgtgttcgtaatcgaggccggcggtctgaacgccatcaagacctacggcgaaagcgtcaccgacgccgaattctgggaatacaaggaagcctcccacggcgacgaccgcgccaccatcgtctacacatccggctctacaggcaccccgaagggcgtggaactgacccaccgcaacttcgccttcctggtgctttccgcgctgcagtacatgcctcgtgccggcgcatggcccaaccgccgtctgctgctgttcctgcccctgagccatgtgttcgcccgattcctggaattcttcagttttggcggcacgatttcgctggccttgagctccaatatgaagacgatggtcaaggacttcgagaccttcgaccccacgctgctgcttgccgtgccgcgtgtgtacgagaaggtctacaatgccgcctcccagcgcgccggcaccggattcgctggcaagatgttcatgcgcgccgccgagaacgcgcgcgaatggtccaaggccgagcagaagggtgagcagctgccgattaccggacgcatcgcccacgccttctacgagcaggtggtgtacaagaagattcgcacgattttcggtccgaacgccgacttcgccatcaccggcggcgctccgatggactccgagctttcccacttcttcaacggcatcggcatgccggtgctggaaggctacggcatgaccgaaacctgcggcccggtgtgtgtgagcttgccagaggacaaccgcatcggcaccatcggcatgccgatgtgcggtatcaccgccggcattgccgaggacggcgagctggtggtcaaaggaccgctggtgtgcaagggctaccacaacaaccctggggtcactgcccagcagatcactgatggctggctgcacaccggcgatctgggcgatatctccgaagatggcttcatctccatcaccggccgtaagaaagacctcatcatcaccgctggtggcaagaatgtgtcgccgggtctgcttgaggcttccgtgatgacctcgcctgtggtcaaccagtgcttggttattggtgataagaagccgttcgtggccgctctggtcacgctggatctggcggatgccaacaattggctggaatcccagggcgccaaaccggaacccgatctggcctcgctggccaagaacgccatcgttcacgctgaggtggagcgtgcggtgaacgccgccaacgagggcgtttcccgcgccgagtcgattcgtaagttcgagattctgccagacgaattcaccgaggccaacggcatgctgaccccgagcctgaagacccgtcgcgcgcaaatcgttgagcactatcgcgagctcattgacgacgtgatctacgtgccgttgaagaagtagctatcaactccctctgatccaaaaaataagctctctctgacgagggaactgtcagccgcaggctgactgggagagaccgcggctagcccgcgaaacaacaaggccgggtgcgacttgcacccggcctcagcttattcagtccaaaatcgccgaaacataatcggcggcggcctgatccagctccgcatcgccgatggtggcggtgccctgcaccaggaacggctcagcatagttcatgccgaccttgtacgccacgacctcaaacgggcttagcagctcctccatggtgtggctgtactcgccgtccttgcggtacttggcggcgtcggaaccagtggtgaccaccagtttgagctccttgcccttcaacgcatgggctccggcgtaggcccagccggcggtgatgacctcgtcttcccattccttgagtagcgcgggggaggagtaccagtagaacgggaactgaaggattacgcggtcggcagcctccagcagctcgtgctctgtgtcggcgttgacggagaagttcgggtattcggcgtattcgtcgcgcacgatgatgtcgtcctcgccctgtgcggtgagttcggcgagcaggcgggcgttcacgcgcgagccgtccttaagatgcggatggaatacaagaatcaacgttgacatgggatttcccttctataaactgctgccaatgtggcctaatcaccactatcgtatgccgggaagcagaactcagtccagtccggactcaggtgcgagccgcgggatgccgcgccgggaggcaactcagtcgaggttggactgcgtgcctgcggtggcttcgttggcggcttgctcggcttgtgcttggtcgagcttggcacggacgtcgttgagcagaccctgggcgcgcttagccaaggcctcgccgatctcccattgacgcatcgactggtcaagattgaggccgccggtttccagtgcctggacagcctgaatcagcttgtcgcgcgcctcctcatatggcatctgggcgatgagctcgcgttccttgtccgtcagggacgtggcgggggtgttcatgtcggtggatgtggcgttttcggtcatgatgttctccttatatatacggtatatatgcgtggctgcgtatggcgtgtcacgcggttgcggatgtggtggttgcggtaatgacacccttcttcaaggtgacggtgatgccatccccagggcttacctgcgaagcatcgtctagtacgtggccatcggcggactgcaccaccgcatagcctcggttcaacgtggattgcgggctgagtgcggtcagtgaggcgtgagctcgctcgacggtgagctgggcatcgtccacgatgcgtcgcagcccgatatcgagccgttgcaacgagtcgtcaattaagcgctgatgaggctcaagcatggtgtgcggctgtgtcaggctcgggcggttcgcatatccctcgataagtcgaatctcgttctccacgcgcgaacggacccgcagtcgcatacggtcgatggcaccttcgatgagctgcgactgctcacgcacatccggcaccacgcgcttggccgcatcggtaggggtggaggcgcgcagatcggcgaccagatccagcaatgtccagtcatcctcatgcccgatggaggagattaatggtgtagtgcaggcatacgccgcacgaaccacacgctcatccgagaaaccgatgagatcctcaaacgagccgccgccacgggccacgatgatcacatccacgctcgggtcggcatcgagttgtgcaatggcctgaaccacctcggccgggcattgctcgccctgaacatgcacatggaccaccttgaaggttacggaaggccaacgaaggttcacattggtgatcacatcgccttccgcacgtgcctgaggtgcgcaaatcaggccaatagtcttcggaaactccgggagaggcagtttgtgatcggcatcgaacaggccctcgcccttaagctgcttgcgcaattcgtcgatcatggccttgaggctgccaccggctccgaccttgagaatcgtgtccccgcgcaacgacagcgaagtgcgcttcatccacaggttcggtttgccgtgaatcaccacgcggtcgccctgaacgaactggctggctgcggccgcgaacctgccgaagccattgacttccatggcgatatcctcgaagtcgtcgcgcagcgtgatgtaggccgagccggcgcgacgggtattgatctgcgtgatctggccggtgacccacgcggacggccatcgttccacggcaccgtagaacttctggctcagcacgcttaccggccacggattttgcgcggtggtttcagcggcgcgtgcaggcagctgatcgatagggcgaggctcattcggcagattgatggcgccccgatcgggcgcgaaagtgccttgacccggctcaaagccagacgaggccagtgaagcggcggtcggtggacggccggtagatgagtagcccattgcagtagtcatgcactccactataagtgcgttggttgatgacggtaaaaatttaccgtcgcctgaaaacggtgtgatgatgaatgcaagaaccgtacgaagcgatgtatcagccgatgatggagatggtctggtgcatcagaagaaaggagtcattatggcgaagaaacgggtgctatgaagaggagtgagatatgcgttgcactgacgattgagagtcgtcagtgagctcgctgtgcgacacgcgagcagaaaacagttacgctaatcacacacttgtagttttggcgaaaaatagccgaaaaaccctataaatagttcgacacaccactgttgagcactagatataggggtggggatgccgtattcttctagaggttcaagaaaacgatatcaatgtaatttcgtgtggcccacgtcgagtgcggccaaaatgcggaactcaggagagtgttcgccttataggaaaggggtgcccgatgggcgcacaggtgctggaggaaaccgtcaccgataacgagaccaaggtggccgccaaggcctccaccgtgctcgttgagaagcgtgatggtcgtgtggtcgacttcgaccccatcaacatcatctctgcggtcaagtctgctttcggcgacctgaacaaggaagtcggccccgaagaagatgccatgatccgtggtttcgccaaccaagtcgaaggcgaaatcaaggggcgttacaccggccccgccaaaatcgaggacatccagaatctcgtggagcacgccctcattgacgcccacctgtacgatgtggctcgcgcctacaccaattaccgtctcgacaaagacattcagcgtgccaaggccactgatgtcaacgaggccgttgctcgcttcattaatcatgacccgaccctgattcacgagaacgcgaacaaggattccaacgtctactccacccagcgtgatctgctggccggtgccgtgtccaaggccgccgcgttcaacatgctgccgccggcggtgtccaacgcccacatgaagggcgacattcacttccacgatgccgactattcgccgttcactgcccagtccaactgctccttgccgaacttctgggacatgttggccaatggcttcactcttggcaacgctccgatggcttccccgaagtccatcgccattgcggccacccagattacccagatcatgaaggacgtggcctccagccagtatggtggccagaccgccaaccgtgccgacgagcatcttgcccagtatgccaagaaggattacgagaagttccttgaggaagctcgtgagaccatccccgacggcatgccggttgaattcgcccgtcgtcaggtcgagagcgccaagaagaacgagcccgccaagctgcatttcggttcccgtgaaccgctgccgatggacaccccgttccacaccgacgttgacgaacttgagcaagagcgtgaaatcctcgccaagattcgtacccgcaaggccatctatgatgccatgcagaccatggaataccagatcaactccaaccgtgtgtccaacggccagaccccgttcgtgactgtcggctttggtctcggcaccgactggttctctcgtgaagtgcagcgcgcaatcctgctgaaccgtattcgcggcctcggcaaggaacaccacaccgccatcttcccgaagctcgtctttactgtgaagcacggcgtgaacgccgacccgggtgacccgaactacgatctgaagcagcttgccctcgagtccgccaccaagcgcatgtacccggatgtggtgttctacgagaacatcgtcaagatcacaggctccttcaaggctccgatgggttgccgctccttcctgcagggttggatcaacccggagaccggcaaggatgaagaagacggccgtatgaacctcggcgtggtcaccgtcaacgtgccgcgtatcgccatcgaatcccacggtgacaaggctcgcttctggaagctgttcgacgagcgtatggaagtcgcccatcaggccctccagttccgcatcatgcgctgcaaggaagccaccccggtcaacgccccgaccctgttccgctttggtgcgtttggtcgtcttggtgccaacgacaacgtggaccagctgttcaagaacgagcgtgccaccgtgtcgctcggctacatcggccttgccgagaccactgcggtcttctatggcaagaactggattcgcgaccacggctgggatccggaaggcaaggagttcgcgctgtccatcgtcaagcgcatgaacgagctgtgcaagcagtggagcaaagcggagggttaccactattccgtgtactccactccggctgaatccctgaccgaccgcttcaaccgcatggaccgtgaaaagttcggccgtatcgaaggcgtgactgatcacgacttctacaccaactccttccactacccggtgtggttgcagcccactccgatggagaagctcagctacgagaaggacttcccgtactacgcttccggcggcttcatcaactactgcgagtacccgtgcctgcaggacaacccgaaggcgctcgaagccgtgtgggattacgcctacaacatcggcatcggctacctgggtaccaacaccccgatcgaccactgcttcgtgtgcggcttccagggcgacttcgagccgaccgaggaaggcttcaagtgcccggagtgcggtaactccaacccggacaagtgcaacgtcaccaagcgcacctgcggctatctcggcagcccggtccagcgtccgatggtgcacggccgtcacgaggaaattgcccaccgagtcaagcacatgagcggcgaaaccggtcgtgtgacgctggatgacggaaccactcgcgagtggttcgaagagaccaagtagggtttatacttgctcccgctgacgggagctgtagagcgtaagcgagactgagggcggtcatcctttatggtgttgaccaccctcagtccgtctgatgacggacagctcccgccagcgggagctaatgctttccgtaaggagggaatcatgccggagctgcatacgaccaagcccgaacccaagcgccatgactttgcggccggcgagaccgggcgtggcccctccgtaccctccaacggtcttgccaacgatccgaaagccggtcaatgggatggccggcgcatgtccaagcggatgatcgccgactacaaaaccttcattgtcaccgacggagaaggcgtgcgcaactccctttacgtctccggttgccccttccactgcgtcgactgcttcaacgcctccatctgggatttccaagccggccacgaatacacgcaaaaacttgaagacaaaatcatcgaagatctgaaagccccatgggtgcaaggcattacgttccttggcggcgagccattcctcaacactcccgtgctggtgccgctcgcacaacgtatccgccaggaattcggtcataccaaagatatctggtcgtggaccggctacacatgggaagaactcatgcgccccggagaaaccccagacaagcttgaattgctacatctcatcgacattctcgtcgacggccgctacctcagagaccagaaggactcgctgctgcaattccgcggctccagaaaccagcgcatcctcgatgtgcccaagtctctggaagccggcgaaccggtcatctgggccaagctccacgatcaagaacgagatatccccgaaatctatttgaaagaccgcgaagccggcgaaggccaacaggcctcgtagtagcagttctggaatgccgcactcagcaatatcgttggaactgttgggaaaaggccttcccgtgagcgaaatcgcctcgcctcgtgccatgttgggcaggtggtcggactaatattccataagaagtagccgggcgaagccgtccgcagggtatctgccagccgtcccgaaacggttcatgatgcctcaaagcgtgcactcccggaagtcggaattaagaggaacacatggttgacatcgccactgacgcgagcgtaaagcccgcttcacacccgaagcccctgcgtgtgggattggacatcggttccaccaccgtcaaggccgtggtgcttgatcagtccgattccctgggagacaccctcttctccgattaccgacgccaccacgccaacgtgcgtgccaccgtggccggcctgttggtcgacatccacaagaagcttgtggacctcggacgcggcgatgaaccgattcgcctgtctatcaccggttccggcggtctggcgcttgctgacaatctgcatgtgcctttcattcaggaggtcatcgccgaaaccgaggcaatcgacaaggaatacccgcaggccgatgtcatcatcgagctcggcggcgaggacgccaaaatcacctacctgaaacccacgcccgaacagcgcatgaacggttcgtgcgcaggtggtaccggcgcgttcattgaccagatgtccacactgctcgacaccgacgccgccggcctcaacgagatggccaagagctacgagaacctgtatccaatcgcctcgcgttgtggtgtgttcgccaaaaccgatttgcagccgctcatcaatgatggtgccgccaagcccgatttggccgcctccatcttcaccgcagtggccacgcagaccatcgccggcctggcttccggacgcccgattcacggcaccgtcatcttcctcggcggcccgttgttcttcatgtccgagctgcgcgccgcattccagcgcgcgcttgagggcaaggtcgacgagttcatcgtgccgaccgacgcccacctgtatgtggcctacggttcggcattgcaggccgacacggattccgacgatcagggccaccatttcgaggcctacacctgcgacgaaatcctgaagcgtttggacgagctgaagaacctgccctccaacacgcccaccatgccgccgctgttccccaccgaggccgatcgcgaggacttcaacaagcgccaccacaaggaacacatccacatcggcacccttgaaggcgcgcacggcccgcacttcctgggcatcgacgctggttccaccaccatcaaggccacgctcgtcaacgacgaccgtgaaatcgtctggtccagctacgccaacaacgaaggcagcccgctgaccgccgccatcaacatcgtcaagaagattcagtctgagctgcccgaaggcgcgtggatcgcacgctcctgcgccaccggatacggcgaaggcctcatcaccaccggactgcacttggacgagggcgtggtggagaccatggcccactatcgtggcgccgaaatggtcagccccggcgtcaccgccgtcatcgacatcggcggccaggatatgaagtacttggccatcaccgatggcgttatcgattcaatcgccgtcaacgaggcctgctcgtccggctgtggttcgttcctgcagaccttcgccatgtccatgggcctgacgattcaggaattcacgcaaaaggctctggcttccacccatccggtggacctcggttcgcgttgcaccgtgttcatgaactcctcggtcaagcaggcgcagaaggaaggcgcctccatcgaggacatcgctgccggcctgtgctactccgtggtgcgcaacgccctgtacaaggtcatcaagctgcgcgattccggcgaactcggcgacactgtggtggtccagggcggtacgttcctcaacgacgccgtgctgcgcgcgttcgaactgctcaccgaacgcgaagtcacccgaccgaacatcgccggcctcatgggcgcgttcggcgcggccctcaccgcccgcatgcactacgaggacatcgcggacgacgacaacgcgcacgtcggcgcggacgggcgttccgtcgacgcggcggcggctgaggagtccgccgccggcgacgagccgaacgccgccgcgcacgccggcgaaatcgtcgtcgacggcgtgcgccacaccgtctcgtcaatcctcaccggcgaagccctcaacgaaatgtcgatgaccaccgaacgcgacgtgtgcaagctgtgccagaaccactgcaagctcaccatcaccacgttctccgatggctcccgcttcgtgaccggcaaccgttgcgaacgcggcggcgatgccaagaagaaacgctccgaccgtccgaacctgtacgactacaagtacaagcgctgcttcgcctaccgccgcctcaccgacaagaacgccacccgaggcgagattggcattccgcgcgcgctcaacatgtacgagaactacccgttctggttcacgctgctcacctcgctcggtttcaaggtgatgatctccggccgttccagccacgaactgttcgaaaccggcatcgaatcgatcgcctccgagaacatctgctacccggccaagctcgtgcacggccacatcaaatggcttctcaacaagggcatgaagacgatcttctacccgtgcgtcagttacgaggacaacctcgtgcccaacacggacaaccactacaactgcccggtcgtcgccaactatccgctcgtcgtcggcgcgaacatgcccgaactgcgtgaccccgacgtgcgctacatgcacccgtacttcaacctcgccaaccacgagctcatggtcgaccgtatcgtcgaggagttcgcatgggcgagcgtcagccgcgaagaggccgaaactgctgtcaaggccgcctacgccgaagacaaggtcttcaaacacgacgtccagcaggaaggcctcaaagccctcgcctacatgaaggagcacgactgccgcggcatcgtgcttgccggacgcccctaccacatcgacccggaaatcaaccacggcatccccgaaaccatctgcgcgctcggcatggtcgtcctctccgaggattcgatctgcgaactgcagccgggggagaagctcgacctgaccgacttcctgtccgaaggcgaagaggacccgcgcaagaagaacgcgaacggattccgccacgtcgacgaccgcaaggtcaccgtcaaccgcatgccgttgcgcgtcaccaaccagtgggcctaccattcgcgcctctacgcggccgcgcacttcgtcgcctcctatccgggcctcgaactcgtgcagctcaactcgttcggctgcggcctcgacgccatcaccaccgaccaggtggccgagatcctcgccgacaaggccgacgtgtacacgctgctcaagatcgacgaggtctccaacctcggcgcggcgaagatccgcctgcgctcgctcaaggccgccgtcgaggaacgcgaagccaacaaggcccgcgaagccgccgcggccaaggccgtgcaaggccccaagtccaccggattccgcaagaccggctccaccgcgccaacccccggccgccagattctgcttgacagcaccatggccgccaacccgaagctcaccaaggccatgcgcgccgcctccaagcgtgccgccgaacgcgacctgcaggccgcagtcgccagcaagaacggcacttcggacggcaccaccggcgtgacgaacgccaagaatgccaagaagtccggccacaacaacgccaccatgtcccgctacgctcatcgcgagaagttcgtcaaggacatgaagaaggactacacgatcgtcgccccgcagatgagcccgatccacttctccctcgtcgaatcggtgatccgctccggcggctacaagttcgacatcctcaagcacgcctcgcgcgaagacgtggagactggcctcaaatacgtgaacaacgacgcctgctatccggccatcatggtcatcggacagctcatcgacgcgattctcgaaggcaaatacgatccagacaaggtgtgtctcgcgattacgcagaccggcggcatgtgccgagccaccaactacttcggcctgatccgcaaggccctgatcgacgcgggttacccgcagatcccggtcatcgcgatctccacgcagggcctggaggacaatccgggcttcaaggtgacgcccgcgctgctgcaccgcaccgtcaaggcgctgatcctcggcgacctgctcatgaagtgcctgtaccgcgtgcgcccgtacgaggtggagaaggtcgcggcgaaccgcctgtacgagcagtgggacgtgatcgtgcgcgaggcgctcgaacaccacggcttctcgaagacggccgcgaagaccccgtggctcaagcgccgctacctgccgtaccccgtgctcgcccgagagatcgtgaagagcttcgacgctctgccgttgaaggacgtgccgcgcaaggtgcgcgtcggcgtggtcggcgagatcctcgtcaaataccagccggatgcgaacaaccatgtcgtcgacgtcatcgaatcgcaggattgcgaggccgtggtgcccggcatcatggagttcatgaccacgcgcccgtacatcaccgactggaacgagaagtatctcggcaccggcggcaacaagacgttgtacgcgctcatgcgttggagcctcgaccgctacaacgcgccgatcaaggcggccatcgccacctctcacggcaagttcaagcaagacgatccgatgcccgaactcgtcgagaaggctgccgaggtcacgtcgatcggcgtgcaggccggcgaaggctggctgctcaccgccgagatcctcgagcttatcgaacagggatgcccgaacgtgatctgcgcgcagccgttcgcctgcctgccgaaccatgtgaccggccgcggcatgttcggcaagatccgccgcctgcacccggaggccaacatcgtgtccatcgactacgatccgggcgcctccgaggcgaaccagctcaaccgcatcaagctgatgatcgcggccgcgaagaaggcgcacaaggcgaagttcgccgacggcgacgagccgcagggcttcactgccgccgactgacctcaaaccgacgtccaaccgacgcccggtcggcaccagaccggcgcagaccgggcaaaccggtctgcggcctacgacaaggcgggtgtcccattccgtatggaacgggacacccgccttattcgttctggtgcttttcggccggcaccggtcacacccgtcctacccgagcctgcctgccgtgaaccggtacagcgcgtcccatggcaggtcggtcacgtcgatcgcttcggcgcgctggctcacgagctcgtcgtaacgttccgaccgcatctgcgccttcacgttgccgcgcacctcgtccagcggagccttcccgtcgacgccgtcctttgtccagtcgtgctcgtcgtagtagcgtcgcacctcgtcgtcggacaggctcatgccggggttcgactcgtcgcccgtataggcgttcttcaacgcggacagttcgtagctcaggtagctgtcgatgtcgaagccggtacggccgtagacgatgccgccgtccgatttcagttccgcgttgccgctgttcacggcctccatgcgcgcgacgatgctcgcataggagtcgtcggccacctgcccgagatccacgccgatgaggtacgcggcgtgccgacgtcgcagttcgtcgatggcacggctcgcgagccaacggcacgggacctcgccgtcgtgcgccttatcccagccgtcctcggccgggtcgacgccgtacgtctgccgaaagtacagccgcgccgcgccgtgttgcgccttgagcgccgcgacgtactccttgcgttcgatgacggtgtcgccgaagacgatggtggggaacatgtcggaatcctcgcttgcattggagccggtatcggagccgatgccggcggatgcgcccgcgcccgcaggcgtgcctgcgggcgcgaaggcgccgtcgccgtgcgtgacgacggcgacggtcaatgtgacgagcaggaccgccgccaccgcgactgcggcgatggcggcggcgaaccggtgcctacgtggcatcggtcacctgcggcgacgggccgcggcggccagtccgatgccggcggccgcggtcagcgcgaccatcgcggccgcgccggccacgtcggcgccggtggcggtcagcttgccgccggtggtcgcgccgtcgctgccggaaccggtggaaccgttgccggaaccggaaccgttgcccgtgccggaaccgttgccggaaccgtcacccggcttggtgtcggggccggggtcggggtccgggtcgggcgtcggatcgggatcggggttcggatccggtttcgggttcgggtccggatcgaccggcttcttctccaatccgtcgatggcgtcacgcagtgcgttctgcgcggtctcgacctgttcggcggtggcggcatcgtcgtccagcacggtctgcgcggcgtcgcgcgcggcgacgagcgcggcccacgactcatccgtgtagtccgactcggccaatcccagagcctcctcgaccgtggccttcagcgtggacttgtccaccggaacgggttcggggcccggcgtggaggcggccatgtaggcgatgaccggggagatgtgcgcggacggcttgttcatgccggacgcggacgtcgcggtgacgcggatccaatcgcccgcctcgaccgcgatctcgcccttgtcggcgacgcagttggcgaactcctcggaacgctgcttggagacggtcaggtcggcgaagcacaccaccttgtcgtcgtgcatgagacgaagcgtcaacgccttgccgttgctgccgtcctggcgcaggtacggctcgtcctcgcggatggacaccttcaccgtgccggccttcggcgccttccacgccatggcggagccaccagcggacgcgggcgaatcgctgatcaggccatggatggcggagcggtcggtgggcaggctgtggttcgcgtagtccacgcccggaccgtagtaggtctcgtacatccagttcggatacgtcgcgtcgaagtcggcgatatccgaccacacgccgtcggcctcggtctgacgctgcccgtaccagatcggaccctgcacgcgcacctggaagtcgttcacccaatcccacgtggtcttcgacttcaccacgtagtcgtcggacacggtggaacctttcgcggagaagcggagcacgtcgttctcggcgagttctgcgccggcctccaaccgcacgccgtcacggtacacgcccttatcggcgccggacggttcggccgtcaccttggcgagcagctgcgcgacggtcatcggactgtcggcggagaacggcgcgtagacgacgttcacaccgtcgacagtcgcggtctccaactcggacgagccgagcgcggcgggcgcggtcacctcgaagcgggcggtggaggagacgctggcgccgtcgtcggcgaacgtcaccgtgacgggcacggtgacggtgccgccgaccctgctgttcagcgtgaccgtgccgttcgccatgtcgacactcgcgccggccggcgcgttcgcgccgagcgcgaacgtcgtgccttccggcacagacgcggccgcgccgtccgccttcagcgtgaacttcggcgtgcgcttcaggtccgtgccggcgtcgccgcgcacggtcgggtacagcacgttgagacgctgcgcgtgcgattgcgcgacacggaacgtgacggtcgtctcgtcgctcgaaccgtccgcgtacgtgacgacgacggtgcgggtgacggtcgcgccgtactgtccggcggcgggcgtgaaggtgacggcgccggtggacgcgtcgatgacgggcgaggcctcgccctcatcgccgccgtccttgaaggcgaacgcgacgccgtccggcgcgtcggcctcgccgccgtccgcggtgaacgcggcggcgacggccgactgcgtgccgacgacggcgtccgtcgcggcgtacgagacgtcgtagcgcacgttctgcttcggcgcggcgggcgccttgtcctcatatgtgatgaccgggctgatgtgcagcgacggcgccttgactccggtctcggcgtcggcgacgatgcggatccagtcgccttcctgcacgtcgatcgaaccgtgctcggcgaggcactgcgcgaactgttcggaggacttctgatagacggacaggtcgtcggccgaacagagcgtctcgtcgttgcgcatcagcgacaatgtgaccttcttgccggcgttgtccgcgttctgacgcaggtacggttcagcgatcttgtcggcgaacgtcttgagcgacagcatgacggtgccggactccggcgccttccacgccatggccgtgggcaggccgtcgccgggcttgtcgatcagcaggccgtgcgtctgcttgcggtcgccggagagttcggcgagggtgccgttgacgccgacaccgtagtactggtcgtacacggtgttcggccacgagccgtcgtatgcggagatggtggtccactcgccgccggcggacgtgcggcgctgcgccttccagtcgaagtcggcgacgccttgctcgtagtccgcgacccaatcccacgtgatgcgctggcggatcgtgtactcgtcggtctcgtccgtgccttcggcggagaagcgcaggatgtcgccatcgcggaccggttcggagtcggcgagcttcgtctcgtcgtccttggcgttccggtcggagcctgggagcagggagagcaggcggtcgagcatgttcggttcggactcggcggacctggcgtcggcggacttgccggacttggcgtcggcgactcggtacacggccttgtccacgcccttgtcggcggacacgttggagagcagttccttgacggtcaccgggttcttgtcggtgaaggtcacgtggatgaccttggtcttgtcaccggtcccggaatcggtttcggttccggtctcgtacttggaggaggccatcgtgacggacaccacgtcgctttccacggcgcccagatcgggcctgcccttgactgcgttgccgaggaagtcgttctccaccgcgtagtcgttgaggtcggagacgaccttgccggcgttgatcgccttcgagcccgcgaccggacggtagccgtcgaacgcggctttctcgccggtgcgcgcatgctcggcgccgctcttgagggcggatgtcggagccgaaccggcgcccgcaagcactgcggacacgtcgtcggcctcgatggcgttggcgtcggaggtgggcttgttcgcgtagttgacgtacatgttgttgtcgtacgtctggccgccgttctggctgccgcggttccaggtctccgtcttcttcgtgttggtcgcgttgatgaagatgttgttctcgaacagggactgcgagttggaacgcttagtcagcacctggctgtcggcgtccacgtagacggtgttgttgtagatgtggttgccggggccgttcgacggcaggtcgaacacgccctgacggtcgttctgcgagatattgtatcggaacgtggtgttaaccgcgtaccagttgcagatcatcagcgaggcgaagctgttgccgtacgagtagttgtactggtacagcgtgccgtcgccgtagtcggcgtcccacgcctggccgtcgccgttgccgtgctcggcgttgaggttgttgtacatctcgttgtactggaacactggatccttgcaacgccacggccagatgccggccgccacgcgtccgccgtaggagccgggctgcgtgtagtcctgcgtgttgatgtgcttcgagacgctgtcgcccacattgtgttcgatgaccgggcggtcgcagtacatcagggtgatggcgtcgccgccggcgcccttgacgtagttgttctcgatgcgcacgttggtggaaccgtacttcgcgatgagggcgtcgtcgatggagccgtcgccgtagttcgcgtcgatgtagttgaggtaggcggtgtagccgacggcgatgccccaacgatccacgtccttgacggtgctgtttctgatggtgacgtggtcgaagcgtgagacgtgctccctgagccagacgtcggtttcggcgctcgtgttctccatggggtagtgggccatgaagtagatgccgccgttggccatgtgcttgttgtagatgttgccgtccacgtcgtggatgtaaaggttgtcgagcgtcacgttgctcatcgtcgcgccgttctcggcgatgccggccacgccggtgcggtccatgcgcgaggcgctgcggtcgagttttgtgccgtcggaatcaggggtgtcggtccacttccacgtgtcgatcggatcgtagacgtccgcgtcgtcgttggtgatctccaggttggagacggtgatgtacgacacgtccttgagtagcagcgtggttgagacggtgcccttgttcttgtggttgccgacgttggcacggtagtcctgctcccactggctgcctttgacgccgttcgacgcgatgaccggcttgccttcgtcggcgtcgccgtaggcggagatcgtgatcggcgcgtcggcgttgccggcggtgtccttgatgtgcaggtactggtcgttgaattcggagccgtattccatcagcaccgaatcgcccggaccgaggtccgaggcgatgtcgttgaccttggtcagggacttccagggcgcgttttcgctggtgcccgcgttggcgtcgtcgccgtgtgccgacgacacgtagtaggtggtgcctgatgacgtggtcgtagcggtctcctttccttgcgttgctgactgcgcgaacgcagcggtcggcaacgccagcgcgacggccacgcccattgcggccgtcgcggctatggcttgtctgccctgacgggatgtcatgccgctttccttcctttcgattgtggcgcaccggcgtgccggtggggtgccgggcgtgtccgatatgtcctcggtccgtttccggtatggccttcggcgtggtttcggtgtggaaccggagcggtcgccggtgcgcttcggtgtgcgttccggtgtgcttccgacgtgcttatggttgccggtgttttgtatgggttgttgctgttttccgtgttctgttgttttctgttgtttttcttttattccggctgttcgccgtgggttgatggtgggttgatggtgtggtccggcctctctgccggacgtttctgtaaacaaggtttacaaatcaatgagtgtatccgacatcgcgcataacggcaaagccgtacggtgtggcgcggcgttgcggaggcgtggcgtgcggtgatgggggcgtggcggcgcggtgtggtgcgacggcgcggtgcggcgttgcggcgtgatatggcggatgtccggcgacgtgccggttatcggaaaaagatatagccgattcgcgggcgcgcggcgacgcgcgtcgcgcgactcgcctacgataccgttcatggtcactcccagaatcagctatgcgcacctgctcgccgagccgaacccgaagcatgtcgagagccttctgaagttcttcgaggcggggcgctccaagcgcggcaccggtggtttaggtgtcgagattgagcatctgccggtgcatgacgccgacgacacggccgtaagctactacgagccgaacggcatcgaagcgttcctcaaacggctcgctccgtattatgacgaaagcaaggaatactgggagaacggccatctggtcggactcgcgcgcgaaggcgttgcggtgtcgctcgaaccgggcggccaggtggaggcttccatcggcgtgcttcatgagccgggcgacctcaacggcctgtacgccgacttccggtgtgaggcggacccgatcctcgaggagctgggcttccgtttcgtcaactacggataccagccgaagtcgagtttcgtcgacgtgccggtcaatccgaaaggccgctatgacgcgatgaccgacttccttggccgcgtcggccagttcggtccgtgcatgatgcgctgctccgcctccacccaggtgagcatcgactatgtcgacgagaaggattcgatcgataagatgcgcgtcggcaccgccatcgggccgattctcgcatggttcttccgcaacaccccctacttcgagggccgtctcaacccgtatccgctgctgcgccagcgcatgtgggactacctcgacttccagcgcaccaacgtgacccccggcctgttcgaccagcgtttcggctgggaggactacgcgcgtgacgtgctgtccacgccgctgatgttcgccgacctgacgcacacgcccgaagcggtggaatcggggctgagccgcaaggagctgcatcgcgccgccttccgtgagaacgctggcgaggtctacccggaccgcgagctcaacgcgtacgaaatcaaccacatcatctccacgcatttcaacgacgtgcgtctcaagaacttcatcgagttccgccactgggattcgctgccgatcgaacgcgtcgaacggctcaccgagatcatcgcgtccctgtactacgtgccgtccaaccgcatccgtctcgaaagctacttcgacgggctcaccgaggaagacgtgttcgaagccaaggcgaacatccaggcgcacggccgcgaatccaacccgtatggccagccgctcgacttctggcgtgagttcctcggcctcgagggcctgctcgacgatattcccggagatccgaagcaccccgacgtgttccagcgctgaccgggttccatgccggccgtgattcgggccggagcgtcctggcgggcgttctggcccttgtcgtaccggccgcggcctgccaggtgccgggtgtgtttggtctaggattacgaaaaccccggtcggtggtcggctggccggggtcgcgccagaactccctgttcaccatcaccgccgacacgcacgaggtgcgccacaaccccgaatactacgtgatgcgccacttctccaagtacgtgcgccccggcgcgaaggtgctcggcaccaccagccacttcaactccatggccatcgccttccgcaacccggacggcaccatcgtggtcgtgacccagaacgcgctggaggacgaacgcccgttcgagttcgccgacccggccgacgcctcccgtggcttcaaggccacgctcgccccgcgctccttcaacaccttcgtcatcgagtgaccgcacggaacccagaaaggcgaacacaaccatgaccgcgaccacaccggaaaccacagtcgaaacgctgccctacaagaaccccgacctgcccgcctccgagcgcatcgccgacctgctctcccgcatgaccctcgaagagaaggtcggccagatgatgcagctcgacgcccgcggtggcgacctcgacgagctcatcgtgaacaagcacgtcggctccatcctgcacaccagccccgaggacctgccgcgcgccgtcgaaaccgtgaacaccaagacccgtctcggcatcccactcgtcatcggcgacgactgcatccacggctactccttctggcccggcgccacgatcttcccctcccagctcggcatggcgttgagctgggacccgaaggccgtcgaagcggccggccgtgccaccgccgaagaagtctcctcgaccggcgtgcactggacgttctccccggtgctgtgcatcgcgcgcgacacccgctggggtcgcgtggacgagaccttcggcgaggaccccatgctcatcggtgagatggcctccgccatggtcaagggctatcagggcggtgcccaggccggcgagacgctgccgaaggacgcgatcctcgcctgcgccaagcacttcgccggatactccgagacccagggcggccgtgacgcctccgaagcggacctgagccaccgcaagcttgaatcctggttcctgccgccgttcgaacgcatcgccaaggagggctgcggcacgttcatgctcggctacgagtccatcgaaggcgtaccggtcacgttcaacaagtggctgctcaccgacaagctgcgcggcgcatggaagtacaacggcaccctcatcaccgactgggacaacgtgggccgttccgtatgggagcagaaggtcaagcccgactacgtgcacgccgccgccgacgcggtcaaggccggcaacgatctggtcatgaccacgccggggttctacgacggcgccatcgaggccgtgcacaccggtctgctcgacgagtcgctcatcgacgaggctgtcgcgcgcatccttgcgctcaagttccgcctcggcctgttcgaggacccgcgtctgccggacgagaagcgcatcaaggccgtcatcggctccgaggatcaccgccgcgtgaacctcgagctcgctcgcgaggccgttgccctgctgcgcaacgacggcggactgccgttcgacgcggcgccggccgaagcgatccccggctccggtgacgcgcccgcgcgcaagcgcatcgccgtggtcggcccgctcgccgacgacgcccagaaccagctcggcgactgggccggcagctccggccaagtcggctggatgcccgacggtcatccgcgcggcatgatcaccaccgtgctcgacggcttccgtgcgctcgccggcgacggatgcgaggttacctacgcccgcggtgccaacgtcatcgacctcgtgcccgacccggagggtgagttctacccggacggccagccgcgcccgaagatcggagtgagcgcgcccgttgaccgggccctgctcgacgaggccgtcgccgccgcgcgcgaggccgacctcatcgtcgccgtcgtgggcgatgtggtgcagctggtcggcgagacctgttccaccgccacgcttgaactgctcggcggccagaacgcgctgctcgacgcactcgccgacgtctcccgcgagaccggcaagccgatggtcaccgtgctggtgagctccaagccacaggtgctgccgcgttccatcgtgggcgattccggcgtgctcgccggccgttgcaacgatccgaagtccggcgccggatccatcctgtgggcgccgaacccgggcatggagggcggacaggccatcgccgagatcatcctcggcgaggtgaacccgtccggcaggctcccgatcaccttcccgtgccacgcgggccagctgccggtctactacaaccagatccgcggccagcacggcaaccgctacgccgaccttacgcaggacccggcgttcgcgttcggcgagggcgaaggctacacgacgttcgcgtacggtgagccgacgatcgtcggcggggcctcgaacgcggacggcacgttcgcgcagaccgacaccgtgcacgccgagatcgccctcaccaacacggggcgccgcgcgggcaccgaggtcgtgcaggcgtacgtgggcgacgtcgtcacctcatacagctgggccgaccgcgaactcaaggcgttccgccgcgtcacgctcgaaccgggcgagaccgcgaccgtcgtgttcgacattccggtctgcgactgcaccatcgccgacgccgatgcgaaccgcatcgtcgaacccggcgagttcgagctgctcatcggccactcgtcgcgccgcgacgacctcaagcgcaccaccttcaccgtcgcgtgaatctgctctgcgtgagatgctctcgcgtgagccggtcccgtgtgaatcggtttcgtgtgggcctcatatgtttccgcccgctccggtcgtatgctggagcgggcggtgtcgtttgtgcggaacggagcaatgatgcggaatactgatgagagggccatgccggaagacgatgggcgaatcaacggagtgaacctcggcggctggctggtattggaacggtggatgacgcccggcctgttccgtgcgagcggcgaggaggacgagatctggctgcaccggtccacggacccggccgaactggagcgcctgctgcgccgtcaccgcgacacgtacatcaccgaggacgacttccgcgccatctccgcgcacgggctgaaccttgtgcgcatccccgtgccgtttttcatcttcggtgacgtgcccgggcatcccggatgcgtcgaatacctcgaccgtgcgttcgactgggcggagagggccgggcttaaggtgctcatcgacctgcacaccgtgcccgggtcgcagaacgggttcgacaatggcggcctgaccggcgtggtccgctggcatacgacgccgcggcaggttgcgttcgcactggacgtgctcgagcgtctcgcgcgacgttaccgcgaccgccctgcgttgtacggcatcgaagtgctcaacgagccggtcgaccgtctcacttatctcatgtcgccgtcgagctcccgggcgaaggatccgggggaggcgcgggggagcggccacgttccgatgcgcttcctcaaacggttctatcgggcggcataccgatggctgcgcccggtgctgggcgacgggccggtcatcgtgttccatgacggattccgcctgaaccgctggcgcggctggttcgtacgtgagggcatgcgcggcgtcatcatcgacacgcacgcgtatctcgtcatgtcggaacggcccgaggtgctgttccgcatactgccggacgcatggcttatgcgctggtaccggctgttcgcggcgtggggcgcgcgccgcatccgccgtgccgcgcgctttacgccggtcatggtgggggagtggtgcgtggcgaacgggcttgcggcgcgcatgggggagtgcggggcgcaaggtgaggtcgcgtccgttgatgcgtctggtggtgcgttcgacggatatggtgcgttcggtgacggcggtgcggatgttggagacggcgcatccggtgacgtcggttcgcgcgcgggcgacgccggggacggcgtcccgtcgcccgccgcgcgccgccgcgccgtctacctccgcgtcgccgccatgcagctcgacgcgtggaacgtctccgccggtcaggtctactggagctatcgactgcgcggcggtcgcggcgagtttgaccgtctcgcgcctcccgcgcccggtatgggtgacggggacgccgccgtgatggacgacacgcgcctcgacccttgggatctgcggcatgtctggcatgcgggatggatggggtgatggttcgggatgacggtgattgatgacgcggtggcggaggtgatgtgcgagacgcgcgatttacggaagggtcagcggtatccgtcccataagggggaggggaacagcacatcctcgcagtcgacccacatggcgttgagatcgcgaccgggagagcgcagccagcgcagctgaatgccgtccatcatcgacaggcccgcctgaagcacgtgctccacgttcgcgccgtcgggtactgaccagttgatgttgagcgcgttcgtcacgctgcggcgctcgcggtccgcgaaatagtcgtgcgccggatgctttgaatcgagggcttcgatcgcgaaaccctcgacatgcccgccaagcagatcgccctgctcgaacaggtcgccgccgcgaaccagaacgtcgtggtcgtgctgtccaacggctccgtcgtctccgtggccccgtgggccaagaacgccaagggcattctcgaatcctgtctgctcggccaggccggcggccctgcgctcgccgatgtgatcttcggccaggtcagcccgtccggcaagctcgcccagtcgattccgctggacatcagcgatgacccgagcacgctgaactggccgggcgaggaaggccacgtcgactacggcgagggcgtgttcgtcggctatcgctactacgacacctacggcaaggttgtggactacccgttcggctacggcctgagctacgccacattcgagatcgatgacgtcgccgccgccaagaccggcgcgaacaccgccaccgtgaccgccaccgtgaccaacacctccgatgtggatgccgccgaaaccgtgcaggtgtacgtggctccgggcaaggccgacgtggcccgcccgaagcacgagctcaagggcttcaccaaggtgttcctcaaggccggcgaatccaagaccgtgaccatcgacctcgacgagcgcgcgttcgcctactggtccgaaaaatacaacgactggcacgtggaggccggcgaatatgccatcgaagtgggcgtgagctcccgcgacattgccgacaccgttgccgtggccctcgatggcgacggcaagacccagccgctcaccgaatggtccacctacggcgagtgggaggccgatccgttcggcgccaagatcgtggccgccgtggccgccgccggcgaggccggcgagctgacgaagctgcccgacaacgccatgatgcgcatgttcctcaaccccatgccgatcaactcgctgcccaccctgctgggcgaaggcggcaagaagatcgcccagttcatggttgacgagtacgccaagctcgcgaagtaagggctgaagcgaggcaatcgcacggcgtaatacagctggcttccctctcctgaggggagccagctttgtttaggctcaacagttgtttggagatactacaacacgccgattgttgtatgtgcaactgttgtatataggtctctttatcatgaattgttgcgtatacaacaatgtggggtgaaggtacaaacgcacacggcccccgcatggtacggaggacaatggatcagcatattctcagcatcgaaatgcgcgcggtaaccaaagccgtcgaccgctatttgggcgagagcatgccgcaaaccgccagggaaaccaccggcggcaacgcgcatatcatcatgttcttggcgcgtaaccgcggccgtgagatataccagcacaccatcgaacagaaattctgcatcacccggtccaccgcctcgcgtgtgctggccctgatggagaagaagggcctgatcgcccgtgaatcggtggagcatgacgcgcgctgcaagcgcatcgtcctgaccgacaaggcggacgcgatcgtcgccgatctcaaggcgaacggcgatcgggtcgaacggttgctggtcggcggcttctccgatggagagaaggccgctctgcgcgactacgtcgcacgcatgcgtgcgaacatcgagcgcgcacaacgcgaatttgaacatcaaacactccctcagtcacctgtggtgatggctcccgatcaagacggagcagaggttgctaacacgaaggaggagaacgaatgagcgataccgcagaggcaatcgcgcaggcgcgcaaagccgtcgaaccggacaagcccaaacatgtactgcgcacgttgggccagtcgattcgtgaatacaagaaagccagcatcctggctccggtgttcgtgacggtcgaaggcatcctggagatcctgatcccgaccatcatggcttcgctgatcgatgagggtatcaccggtggcagcatgccggccaccgtcaagttcggcgtgattctgctggtgtgctcgatggtttcgctgggtgccggcttcctgtccggaaagtacgcggccgtggccggcgcgggcttcgccaagaacctgcgcaaggaccagttcgagaaggtgcagggcttcagcttcaccaatattgaccggttctccaccggttcgatcgtgacccgactgaccaccgacgtgacgaacctgcagaacgcctacatgatgatcattcgtctgggcgtgcgtgccccgattatggtggtcgtatcctggctgttctcgttccgtatctccccgtcgatttccatggtgttcctggcctgcatcccgattctggccatcggcctgtgcggtctggccgtgctcgtgcatccggtgttcgagcgcgtgtttcacacctacgatgcgttgaacaacgtggtcgacgagaacctgcagggcatccgcgtggtcaagtcctataaccgcgaatccttcgaggtctccaagttcggccgcatctcccagcgcatcttcaaggacttcaccaaggctgagcgcatcatgagcttcaacagcccgctgatgatgatctgcatctacggttcgatgatcctcatcgcatggatgggcgcgcagcagatcgtcgcctccggcaacaaccccgccgtgggcctgaccaccggcgacctgaccgcactggtcacctacgccatgcagatccttatggccatgatgatgctgtccatgatcttcgtcatggtgattatttctcaggcttctgccgagcgtatctgccaggtgctgcaggaggaaagcacggtgcagaacccggcacagccggtgactgacatggccgacggctccatcgaattcgaccatgtcaccttccgctactccgacagttccgaaaagcccgtgcttgacgacatcaacctgaagatccgctccggcatgaccgtcggcattgtcggcggtactggttcggcaaagtcgtctctggtacagctcgtgccgcgactgtacgacgtgagctccggttcgctgaaggtcggcggcgtggatgtacgcgactacgatctcgaggcgctgcgcgatcaggtggccatggtgttgcagaagaacgtgctgttctccggcactattgccgaaaacctcaggtggggcaacccgaacgccaccgatgaagagattcgccatgccgcgcagctcgcgcaggccgatggattcgttcaggaattccccgataagtacgacacgtacatcgagcagggcggtaccaatgtgtccggcggacagcgccagcgcctgtgcatcgcccgtgcgctgctgaagaagccgaagattctgattctcgacgattcgaccagcgccgtcgataccaagacggacaagctgatccgttccgcgttccacaacgagattccggacaccacgaagatcatcatcgcccagcgcgtggcctccgtgcaggaatccgacatgattctggtgatggattccggccgcatcatggcgtccggcacacacgacgaactgctcgtcacctgcgatgaataccgttccatctacgaatcccagaccaagaaccaggcccagcccgaagaactggctgctgccgaacaggctgctgagtcatctaccgctgagccgtccgaaaccgtgacggtgacagtgcccatgcccacggccgataccagcgcagctgataccaatgcagccgataccaaggaaggagaagcacgatgagcaacgaccagagtttcaagaaccgcaagcccgccatgggcaaagccgagcctggcaccatcaagcgcatcttcagctacatcttccaatacaagtggcgcgtcatcgccatcgtggtgtgcatcttggtcggtgccgccgcgcaggccggttccgcgctgttcctccagtcgttgattgatacgtatattctgccgatggtgggggagtcgaaccccgactgggccccgctgctgcgggccatcagcctgatggcgggcctgtatgtggccggcatcgtggcgtcctggctgtggcagtggctgatcgtcaccgtcgagcagggcacgctcaagaagattcgtgacgacatgttcgcccaccagcagaagctgccgatccgctacttcgacagccacgagcacggcgacatcatgagccactacaccaacgacaccgatacgctgcgccaggccatctcgcagtcgttcccgcagatgttctcctcgattatctccgcggtcgcggcgctgctgtccatgctgtggctgtccattccgttcaccgcgttcgtaatcgtgttcaccgttctgctctacttcatcgtgcgcaagatcgtgagccgctccggccgctactttgtcaagcagcagcagtggatcggcgacgtgaacgccttcgtggaggaatccgtcaacggccagaaggtcatcaaggtcttcaaccatgaagacgccacccagaataccttcgacgagaagaacgaggaactcttcgaggcgtccgccgaagcgaacacctggggcaacgtcaccatgccggtcgtcggcaacatgggctacctgctctacatcctgcttgccatcgtcggcgccgccgtctcgctggccggcgtcaacgacatcggtctgaccggcgtcaagccgctcaccctcggcacgctcgtctccctgctgaccctatcccgctcgttcatcaacccgatcggccaggtctcccagcagctgaccatggtgatgatggcgctcgccggtgcctcccgtatcttcaagctgatggacgaacccatcgaggaagacaagggcaccgtgacgctcgtgaacgtggaacttggcgaggatggccgcaccatgaccgaagtcgaccacgagaccggccactgggcatggaagcgcgaggtcggcgacgacggtacgaggtctctgaaggccgcagaaaagctcaagggctcggcccgcgaggtggcgatgaaggccaaggagcaggcgatcacctcgcccgacggccgactgaccctgctgcgcggcgacgtgcgcttcaccaacgtgactttcggctacaacccggacaagccggtgctgcacgacatcacctggttcgccaagcccggccagaagatcgcgctcgtcggcgccaccggtgccggcaagaccaccgtgaccaacctcatcaaccggttctacgacatccagcacggccagatcctgtacgacggcatctccgtggccggcatcaagaagcctgacctgcgcaggtctttgggcatcgtgctgcaggacgtgaacctgttcaccggcaccgtgatggacaacatccgttacggccgcctgaacgccaccgatgaggaatgcatcgaggccgcgcgtctggtcaatgcggacagcttcatccgtatgctgcccgagggatacaacacggtgctggaaggcgacggttccggcctgtcccagggccagcgccagctgatctccatcgctcgcgcggcggtggccgatccgcccgcgctgatccttgacgaggccacgtcctccatcgatacccgtaccgaggaggtcgtgcaggccggcatggataacctgatgaagggccgtacggtcttcgtcatcgcccaccgcctgtccaccgtgcgcaattccgatgtgatcatggtgctcgaccacggcaacatcatcgagcgtggttcgcatgacgagctgatcgcgcaaaagggcgagtactaccagctgtacaccggcgcggtggagttggagtagtgctttttggctcccctcagagaggggagctgtcagcgaagctgactgaggggagccgcagactagatgcggttccccttaattgtctgcggtggaaactgccttaagacagatacccgtgccgctactgttcgctgtgatggacgtaggcgtccagcgagagccggtcgataagcgagggtatgacgcctttgcgggtgattgagtatccggcggcataggtggcgatttcgaccgcctgccgtacggtgtatccgtacatcagatacgaggcgagcgcgctgatgaacgcgtcgccggctccggtgctgtctacgggggtgaagtcagcggccggatagtggcactcgacattctggccgcgcaggtagcagccgtgttctccttgggtgacgatgacgcagccagcgccgcgttcgagaagatgcgcggccttatcctccattgtttttccctcagtttcgatgatcgccagttcgtgctcgttcggcacgagaatgtcggcattggcgacgatggagtcgggcagatagtcgcatgacgagggcttgataatggttttggcatggtgccgtcgggcggtgatcgcggtgactttggctgattccaacggtatttcggtctgtatcaggcagtatccggcattgtcgaacaggcgttcgttggaggtgatgtcatccggggtgagcgacgcgttggctccggagagaatcgcgatgaccgattcgccgttgggggcgaggaatatgaacgatgagccggtgtcctctccggcgcagcgtcgcacaccggccgtattgaccccatgctgttccatcgccttgaagatgtaatcggacccattgtcgacgccgacattgccgataagggtaacgcggtgcccgagcttggctgcgccgatcgcctgattgacccctttgcccccggggtagcgcgccgccgatttggtggataccgtacccccgatatgaggtagccgcggcactgacagatagtggtcaatattgatgctgccgacgaccaacacatgtttgatggcggaagtgggcggggctgcgatggtgctggtgttgtcgagatgaaaatcctgtacgaacgagggatgctgctctttgtcgtgctctatctgcgcaatgagcttctcgcagaggtaggcgccgaagtcggagttgcggatggtgtaggtagatatttccgtgttgccgggataggccagcgcttcggcggtgtcgtttttgatggagacaagtgaagcatcctctggaagccggtaatgcagggggctgatcatctgcgtgaactcgagtgctcgccggtaatgcgaggagacaaatccggtgatgtcccggcttccgattttgccgggcagcgagtcgttgaggtcgtagtagaccagatcgtcgctataaggcagctgatgatcgaacaggcaggagcgaaagccttcgagaaaatcctgcgtgcggcgtcccttggtcattaggcaggcgatgtgttggtgccctcgttcgatgagttcgctggtcagtttgtaggccgcttctttataaggcagtagcagtgactggtcgccgccgttgggtcctatggtcagcagtggggtgctttcggggaattgcgaggcataggcgaggctgtccggagtggccggttcccagatgacgccgtcgacgttgcggccgcatatcgctgcgatgtttttgagctcgcgttccggatcggaatagctgttgtaggcatcggttgcgtatccggcgttctgggcggcctggatgatgccgtccagcgtgctatcgaaggagatgggggagcgtagcagcactccgatggtgtagctacgcgtgcgctgtgaggcggaggcatatggcttgtaatgatattccttgacgatcgtcaggaccttcttgcgggtttcctcgctgatgctggaatccttgccgttgacgattttggagaccgtcgaggtggagacgcccgcgatgcgtgcgatgtccctgatgttcatgtctcccctcctgcctgttttcctctgtatcagtgtacaagggcgtagcgttctgttccttgctacgtcgccattgtgggccgttcggtccaggttgcttgaccctcgacccgccgtgttgacactgacgttggcgtcctataatcttatctcaagaaaacattttaggaaaatgatttcctaagattccgcaagacaaacaatgcagattgcacactgcggaaaaccgaggggtggaaaataaaggagggccagcatgacaaggaagctgtcgttctgggaagggatcaaggcacaattctccacaaagtgcctggtgctgattccgatcgcggttggaatcaatctcattggcggaactctgtgctccgcactcaagctgccgctgttcctcgacatgatcggcaccatcgtcgtcgcatgcctgtctggaccatgggtcgcggccctgaccggcctgctgaccaatcttttcctggcactggtagccaacccggtctatcttccctatgcggcggtgtcggtattgtgcggtttggtcgtcggctatatggtcaaggccggactgttccgcaagaagtggggcgtcgtggtcatctggctggtgtgcacgttcgtcaatgcgatctccgcatcgctgatcaccacattcgtatacggcggtgccaccggcgtcaacggtacatcggtgctgacggcaacgctggtcgtggccatgaaagacattctcgcctcggtgatttcctcgtcgctgatcgagaacctcctcgacaagggcatcactgtcgccatcgcgtgggtgatcgtgcagaagattccccgtcgctttctcagccagtatgcggccgactccatgggcggctcggacaatgatgcgctgagtgatgatgacgaagaagaagacgagtgagacatgtcgtcgcatatgccggtcatcaatgacaccgtaattgggaagctgaatccgatcaccaagatagcggccgtgttcgccttgggtctgtccgcattggcatggcctgacttcacgcttggtctgatactcgtggtgttactgcttgtggtctcgttcttggctcatatacagcgtgatttcgccaagataatgttcggtttcggcatccccgtcactgtgatgctcatgttcatccaagggctgtacagtcccaagaaccgtaccgcattactggattttggcttcgcgcaactggggctcgaaggcgtgctgtatgcggccaaagtggtggtgagcttgctggtgtttcttggcagcttctacatcatgaacaaaaccacctatgtcggtgctatggtatccgcgctcacttcggtggggctcagcgccaaggtcggatacctggtgctcgccagcctgaatgtcgtgccgcagatgcaacgacgtatggcggtgattcaggaggcgcaatccgctcgcggactcgatgcatcgggcggggtcatcgcccgcatcaaggcgtatatcccgttgcttggtccggttgtcatgtcatcgctgaccgacgcccaggagcggggtatgaccctggagacccgcggcttcggcattactggagtgaagcagaccagttatgtcaaggtcagctggaatgccgccgacaaggtactcaattggatcttcgtcctgtttctgatcgccgtggtcgccgtttccgtatgcatccgcatcggtgtgattccgtcgccggtctcgtggggaggcaagtgaatgagtccgatagtagaggtcaaggatttctccttcaagtaccgcgacaccaagcgtcgggccgtcaaacacgtggacttccaggtcgaggaaggcagcttcttcaccatcatcggcgcgaatggggcaggcaaatccacgttatgcaatgcgctcgtcggcctgatcccgcactatttcgtgggggcgagggctggacacatcctaattgacgggaccgatgtcgccgattcgaccatcgccgaactgtcgaagaccatcggcctggtgtttcagaacccgttcaaccagctgtcctacaccgccgggaccgtcgccgaagagctggcctacggattaggcaaccacggtgtgcccagagcgcagatgatcgaccgcgtcgaagctgtggcgaaattgatgcgcatcgaccacatcctagacaagaacccgctggaactgtcgggtggacaggtgcagcgtgtggctttcggatccactttcatcatggaaccgcgcattctggtgcttgacgagtgcaccacgcagctcgacccgatgggcagcgaggaaattttcgacatcgtcaaacagctcaatgcggacggcgtcaccgtcatcatggtcgaccatgacatggagcgagtggcacgatacgcggataccgtcatggtgctcgagcgaggcgaagtcgtggcccttggctctccgatggaggtgttctccgatccggcgatcgaagagcatggcgtggaagtgcccgattacgtgaagatcacccgtgcgctcggtggcccgattgccattaccgaggagccggccatccgcatggccaaggaggcgctctcatgaaaatcgagttgcaggcactggagcacgtctatcccggaggggacaaggcccttgacggagtggacttgacgcttgacggcaacgagccggtggcgatcatagggcagaacggtgcagggaagaccacgctggtcaagcatttcaacggcattttgcgccccaccggaggcaaagtgctgattgatggcattgacgtcaatgagcgcagcaccgccgaatggtctcgcagcgtgggctatgtctttcagaatcccgacgatcagctgtttctggaaagcgtccgcaaggaattcgaattcggtccgcgccagatcggcatgagcgatcaggacattgcgcatcgcgtggacagcatcgccgagctggtaggccttaccaaaaagctcgacgtgcacccattcgacctgacgcccaccgagaagaaattctgcacaatcggtgccgtcatcatgatggacccatccgtggtgatcttcgacgagccaacgtgcggccaggatgcgtcgggcaacgcccgccttgcacgcatcatcgaacgtctgaaagcacaaggcagactctgcatcacgatttcgcacgacatgaaattcgtcaccgcgaacttctcccgtgtcatcgtgatgtaccacggccgcgtgctgctcgatggccaggcccgcgaggtgtttgcccagaccgacacacttcggcgttccttcgtgacgccgccgcccgtcacccgagtagctcagggtgcaggcctcaaggagacggtattctccgtccccgcgttcatcaacgccattgctcaggaaaggaaccatcgtggctgatgtcattgctcaaatctatggaataaggaatgtcgaggacgctcgcatggtaatcgacatgggcggcgaacatatcggcgtctcctacggcaaaatcaagcggacgcccggtcagctcgattgcgaacgggccagggaaatcttcgaaggcgtgcaaccacaagccgtgcgcataggcctgaccgtcgccgaagacatcgacgaaatcagcgagaacctgcgcgaagccatgcccgacgtgctgcacctgtccggcgacatcgaaggcatcagtccggccgaagtggcggaacttaagagccggttccccgaactgaagatcatgcaggccatcccggtgctagccggagtgcctctcgacgaacagaaggtcatgcagtatgtgaaggactatgagccggtttccgatttcttcctcatcgacaccaaagcacctgctgccggagacatcggagcgactggcctgacccatgaccgggccatcgaccgggccatcatcgaggccaccgacgtgccgtgcatcatcgccggcggtctggacgcctccaatgtggccgaggcgatctatgccacgcacccgtatggcgtcgactcgttctccctgaccaattacgacgatgatcgcgccgatacggatcggtgcaaggacccggccaaggtcgaggcttttatcaaggcggccaaagatgcctaaggtcgttgtcgtcggcgatgccaatgtggatgtcattgtgccctatccgcgttttctcaacgaggagcgcacgcaggtcgaatatccgcagatcggcatccagggaggaggaacctcggcgaacacggccgtggcgttggcgaagctcggcctggatgtatcgttcgtgggcaccgtgggagatgatcagtacgggcgtttcgtcatgcaggacttcaaggatgcgggcgtggacgtgaccgggctggttgcggattcgaccctgagcacggtcggcgtattcgctttcgtggacgaccgcggagagaggtacctgtggggatggcctcgcgaacggcaatcgttcaaggtgctcgacgaaaaccttgtgccgatgcacatgattcgtgaggcggattgggtccactcctcgggcatgtgcctgacctacgacaccagcgccagggagacgatcatccgcatcttcgaacaggcccacgatgccggagtccctacatctttcgacctgaacctgcgtgtggacgacggcgtgctcgaccccgatttcgcggctgcactcgaacgcattattccgaatgtcgattatctgctgggatcagggccggacgagttcgcctatttaggcgacgacgacatgatgggcaacgccacggcctatgcggtggacggccggaccgtcatcgtccgggacggcgcccgaggatcgatcggtcttacgcaagacggcctgacggaaagcccggcgttccgggtgaacgtcgaagacaccatcggagcgggggacgtctataacgccggtttcatcgctgccagactcgccggagcctccctcgccgaatcattgcgagagggcaatgccgtctccgcatacaaagtggcccgtcgcggggcacgttcctcgccggacgctgcacagctgcacgagttcctcgccgggcaaaccggctgaacgccatgcccgaatatcgaccaatccaaagaacacaaccaacggaggtatccctatggaaaacaagaagaaggtcatccttgactgcgatcccggacacgatgacgcgttcggcatcatgctcgccgtgcagcacctcgacgtgctgggtatcacgaccattggcggcaactgcacactggagaacgtgacccgcaatgccatcaaggtgcttgaggtccttggcgcggcggaccgcatcggcgtatatccggggcacagctgcccgatggtcgcaccgctggtcaccgcaccgcagttccacggcgagactggtctggacggtcccgtgctgccggagccgacgcacgccgcacagaacaagcatgcggtcgacttcatcgtcgacactgtaatgagcacggatgacgtgacgctgatcgccaccggtccgctgaccaacatcgcctccgccatcaaccgtgagccgcgcatcgtggaacgggtcaaggagctgtgcatcatgggcgggtccgtcacctacggcaactggacccctgccgccgaattcaacatcttcgtcgaccccgaggcggcatcgcgcgtgttcaactccggtatgcacgtcaagatgactggcatcaacctgacccgtcaatgcgagctgaccgccaagcacgtagccaagttccgtgagatcggtaccaaggccgcgaacctggccgccgatctgaccgatttcttcatcggcgcatgcgaggaggagtccgagctgacgggcgccaccatgcacgacgcatgcgcggtggcatgggttatcgacccgtcgctgatcactgcggtcccgatgcatatcgatatcgagctgcacggcgcacttacccgcggtatgaccgtgtgcgactaccgtcatctgcgcggtaccgtgcctgccgtggatcttgaacgcacgccgacgatgggctatcgcggcgaagagccgaatgcggaagccgcgctggaactcgacttccccggattcgtcgacctactgaacagcaccctcgaaaactacgactgagtcttgcccctgaacaaccccctccaccgccggccggcgactccaaccccttctggccggccggcggtatctcgcctccaatcatcgaccaccgccatgcgaatgaacgaaaggagaaatccaatggagtaccgatgcctgttatgggatttcgatggcacccttgccgacactggcagcgacgtgtggaattccctgacgtacgccgcgcgtcgtgcgggcggggcgatcgatgacctgtacatgcgcgatgacgccaatctggccgatccgatggatgagatcatgcggcacgtgatcccctatcccggggaggcgtatctggagacatttgatgaggatgtacgcgtacactaccgcacgctcaatgatttttcgcgcaccagactctatccgggcattcagagcatgctgaatgagctgaagggacatagcgtacgcaatatcatcgtcaccaacaagccggagggcgcattgaggcgcatactcggcagcaaaggctgggcgaacctgttcgacgattggatctgccccgattccatacccggccgtgaggcgacgaaggtcgaaatgatagccgaaatcgttcgacggcatggcatcgcgccgagacaatgcctctatgtgggagacaccttcagcgacatcgaagctgcccggaccaacggcatctcctgcatagcggtcacatacggggatggcgacgaaatcgcgttgctcagcagaaaccccgcatatgtggcgcgcgacatcgcggaactcaacgacatcatgacggacaccgtcatacacgcaaggagcatgatatgagggatttcaccatatgcatcggaaccaccttcgttttcgggcgcgacgccgaaaccaaagtgggagacgaactgggcgcaaagggcgtttcccgcgtgctcatccatcatgatggcggagcatatctggaaaccagcggcttgctagatgccgtgcgccgcagccttggacgggccggcatttcctatacggagcttggcggcgtgaagccgaatccccgactgacgctggtgcgtgaaggcatcgccatcgccaaagcccgcaatgtcgacgccgttgtggccatcggcggaggcagcgtcatcgattcggccaaggcaatcgcgctgggagccgccggagagcgtgacgtatgggattatttcaccggcaaagtgccggtagagcgcacccttcccgtcgcggtggtactgacgtgcccggcatcgggcagcgaatccagccaggtcgccgtcatcaacaatgagcatgagcattccaagctcacgctgagcgaaccagtactccggccggcattcgcgttcatgaaccccgaactcagcgtcacggtgccggcgttccccactgcctgcggcattgtggacatgttctcccacatctgcgaacggtatttcagcgccgacaacgagatcggcgtaatcgaccgtatggccgaaggcgcattgcgcaccttggtcgatgtcggcccgaaatcgttggccgaccttgccgattacgacttgcgagcgcaaatcatgtggatttccaccatcgcgcagaacaacaccctcggcgtgggtcgtgaacaggactggtccacccacctgattgccaacgagctgagcgcgctatacgacacccctcacggggccaccctgtcaatcatcatgggatcttggatgcgcgtggccagcgagaaggccccgttccgtttcgcgcgatacgccactgaggtattcgacatcaggcccggctcgatgaacgaaaccgaactggcccggcgtggcatcgccgcaacggaatcgttcttccgctcgctaggcatgcctgtttccttcaaggacttcgatctgccgggcgacggcatcgaacgcatgttggacaacatcgatttctacgggccggacgccaccatcgggtccattgcccgccttgatcgcgacgattgccgtcgcatctacgaactggctgtcaccggtcccgtcatgggaaaggagtcctgatgcgcatactgaatttcggctcgctgaacatcgactatgtgtacggggtggatcattttgcggccaaaggccagaccatcacctcgcatgcgctcgacgtgttccccggaggcaagggactgaatcaatcgatcgcattggctcgtgccggcgccgatgtgcaccatgccggccaggtaggacgggacggcatgttcctgcgcgacctgctcgaatcctgcgcggtgggcgtgacctcggtggtagtgcgcgatgatgtgcgcagcggcaacgccatcatccaaaacgatgccagcggcgacaactgcattgtgctgtaccccggcgcgaaccgtgccatcgaccgtgatttcgtcgatcaggtgcttgacgggtatgggaagggcgattggctgctgctgcagaacgaaatcagcgaactgccctatatcgtgtcccgcgccaaggcccgcggcatgttcatcgtgctcaatccctcgccggctgactcgcggctcgacgaagtcgatcttgatgccatcggctgttttgtactcaatgagggcgaggcggcgatgctcacaggggccgaagaagacggggagacactgatccgtgcgatgcgtgcgcgtttctcccaggcggatatagccctcaccctcggcgagtgcggttcgatgtatttgcgtggggaccacgtcgtcacgcagtccgcttatctcgtcgacacggtcgacaccacggcggccggcgacaccttcactggttatctccttgccgacctgatgtccggcgaacccatcgcccatgcacttgatttcgccgcgaaggcctcggccctcgcggtatccagaaaaggcgcggcgccgtcgattcccatgcgagaggaggtagctgtttttactccttgcgctcgcgcataaggcattccaccaaactcaaaccaatagaaaggaatcaccatggcagaaaccgctgtcaaggagaaggcgaacggtatcccggtgcctgaggagggcaccgaagagtttgcccgtatgaacaagatggcaaagatcgccattccgatcgtactgatcatcttcaccatgggcgtgctgcagcagcaggctttcggcatgatctatgtgaacatcggcgaccagctcggccaggccaacctcgccccgttgatcacctcgattccgggcatcgtgctcggcatcgtgtgcgtgatctacggttctctcggtgacttcgtgtccctgaagaagatgatgattctcggcacgatcgtgttcgtgctcggttcgatcctcggctgcttcggcgacctgagcatctggatcgtcatcgccgcccgtaccgtgcagtccgcaggctggcaggtctccggctccatcttcctggtgctcgtctccaagtacatcgagaagaagaagcgagtcatctggtacggcgtgttcgtcgccgtgttccgtatcgccgcggctctgggcgtcttccttgccggctacatgacccttgtcgattggcgcatcctctttggtatcggcatcatcgcggtgttcttcatcccgatcctggccaagaacctgcctgacgagcatgccaagggcgcgcgcgtcgacgtgatcggcttcacgctcattggcctgttcgccggctcggtgaccatgttcttcaccgacatgaccatcttctggggtatcgcggtgctggtcaccggcgtggccttcgtggtctacatcaacaaggccgcggatccgttcatcaccccggagatgctcaccaacccggccttcgcgatgaccatgatcgtcatctttgtcggctacttcttcagctacaccctgaacgccggctgcaacgccatcggcctgaacgtgtacggcatcgactcctcccaggtctccaacctgctggtgtggtcgatcatcctcgccgccatcatgggcttcgccgctggcccgatcatccagaagatcggccgcaaggcctccatcattctggcgctcgcctgcatgggcggtggcctgatcgccgttgcgttcctgattccgatgggccagatctgggctcttgccgtggcgccgtgcatctactacttcggcacctcgttcttctaccagccgattgtggataccgcaacgctgaccgtggaggccgaggaatccggacgtgcattgggcttcaacgatctgatgcaggccatcaccggttcggtcggtgtcgcgatcttcggccagctcatggccaatggcgcgatgagcggcggctcactgttcggcaccgaatccggtccggcctcgacctatgccaacgtcttcatggtcggcggcatcatcgtcctgggtgcgatggttatcttcatctgctcgatgaagatgatctacagccgctcccgcgtcgccgaagacgagagctgacatcaggtcatatcgtctgctgatgtgacattgatatcgcaaagcccgtgaccggtgtattccggttgcgggctttgcgcgttacgctaagtagtaaagtaatttactgaagtactacgtaatgtttgcattgaggggatgatgtcatggtcacgatgaaggaaatcgcgcagaaatcaggcttctcgcaggccacggtatcccggctgctcaatggggacccgacattgtccgtcaaagaggagacgcgacgtcgcatcatcgaggtcagcgagcagcttggctacgctaccggatcacgccgtatcgcattgccacgccgtgtggccgtactcgacaacgccacccgcgaggaagaactggcggacgcctatttcgatgaactgcggtccgtgctcggcgacaatgccagagcccagcacatggaactcacgtcgttttcccatatcgacgatctgattgccaacgccggtgatttcgacggcttcatttccatcggaccgtccgtactctcttcggataaactgttgaaactccatctggtattgccctatggcgtattcatcgacatcaatcctgcgcccagcctgttcgattcggtacaaccggatttaagccaaaccattttggacgcattggatgtgttggtgtcctcgggcaaacgacgcatcggctatatcggcggtactggcttcacgatgggtttgcacgaatacccggaagacagccgattaaccgcattccgcaattggaccgagcgtttggggctggatgcggaaggcctgatttacgcgcaaggcgcgttcactgtggacaccgggcgcactctaggggagaaagcggctaacgatcatcgagatgacatgccggatgcgttcatcgtggctgcggacacgattgcagtcggcgtactgcaggcgtttattgctgcgggagtgctggtgcctcgcgataccagtgtgatcagtatcaataaccaggccatcgcccagtacacttcgccgacattgaccagttacgatatcgatcagaatgagctggccgatactgcgattacgatgcttgccgaggccatctccagtcggcgcacgctgcaccaccacaccttcatctccaccaccctagtagtgcgtgacagtttcgtaccagcacgataaagaagttccctctgtgcgataaagaagctccctctgtggagggagcttctttatcgctgttagaacagttccagattcacgtcgagcgtgtaggcgcgatcggcgggcagctggtactgctcatggacgggcgcgccccatgaatcgtcgccgcccacgcccatttgcgcggccaacaagcgcaggaacgtgtggcggaccggcggcaactcgttctggtgggtcgcctcttccagcatgagcgagctgtacggcaacaggctcgccgcgaaatgttcgctgccggcctggctgatacgcatgccgtgtccttgggcgtcaagcacttcggcccaacgcacgtcttcatggttgccggtctcctgcggcaccagatacggtgcattgtcttcggccgcggtgcgctcgaaaatgccgagcttgccaccgtgcagacggtcgcgataggtctcctcggggccaaggccgtagaagcgcaggttctcgtactgcttgggaagcgtccattccaatccgaatgccggcagcgtcggcgcatcggtggcaccggcatatcgggcggtcagatgtacacgtccgctggcggcatccacctcatagcgcacggcaacttgggtttcgcccggctcggccagcgtatatgtgtattcggcgatgacaccagtctcggtttgcgagaactgctgattcgccatacgtgcataacggccggcaccgaaccagcgcacgcggtcgaagccgctgccattgccgcgatcgttgtcggtcagcgggcggaagcaggtgatcgccggacggcgcaacatcatttcgcgaccgtcacgcttgaatgacaccatgccgccctgcgtgcgtgaaagcaacgcttcggtacgtccgtcaccgctgaccacgccgatgttccagcggccaaccgttactgtaccggtatcggaagtatcggaatcagccgtggagggaaccgcgccgcacgtggtcgaatcggttccggcggaagccggcgcgactgactgaacggtgtattggccgaacgccagttcatagccggctggtgaccacggtgttgccgttgccagcgactgatcgacctcataggtgatttcgccagcggcgtccaccgacgggaagtcaatcgggaaggtgcgggtctcgccggcgggcacatcaaagcggtagtcggcctgccagatggcattgccgtccgccagcagtttcgccgtgaacgcgaaatcaatggtggagacgaacagattgcggttttcgatggtcacatcgtggtcgcttacggtcagtaccacgggagcgtacagacgcttgacctcttgcagcttcggtgagggagagtggtcggcgaagaccaggccgtcgccggcgaactcatagtcgcagggacgatcgtcccagtcgccaccgtaggtcagacgttcggtgccgtcgtccagctgctgccacagggcctgatcgatgaagtcccagataaagccgccctgataatgcgggtaacgctccagctcggtgtacagatgcatgccgccgaccgaattgcccatggcgtgcatatattcgcaggagatatagggcttcttcggatcattggtcagatattcctcgatttccgcgggcttggcatacatgcgggtctcgatgtcggtcacgtcgtcaaaggggcggtcatgcaccacgccttcgtaatgcacgggtcgcgtggagtcggcggcgtgagcgaagcggtacatcgcgcggaacacctcgcctgcgtacgattcgttacccagagaccagatcagtacgctcggatgattgcggtcgcgcccgatcatgctggcgatacggtccacgcaagggccttcccagatgggattgctgcccggaatggcggtttcaggggtctccacatcaccgggaatggtccagctgccgtgggtctcaaggttcgtctcgtcgatcaggtacaggccgtattcatcgcacagttcgtagaatcgcgtctgattcgggtagtgggaggtgcgaatagcgttgatattgttgcgcttgcaggtgatgatgtcggtgagcatctcctgctcggtgatggcacggcccaaacgcgcgtcgaactcgtggcggttggcgccgcggaagatgatgcgcttgccgttgagtcgcataatgccgtcaacgatttcgaaatggcggaagccgagacgttgcggcaccacttcgatgatgctgttgtctgctgagcgcacggtgagcgtcagcgtgtacaggtagggcttttcggcgctccatggacgaatgttggtcagattcgcgcggaattgcacggcggtgctgtcgatcgcggtgtctgcggtgccgcagcagggtacgccggaggtgtcgacgatgtcggacatggcataggaatcctgccagaccggcgtgccgttggcatccatgagtgcggcgctgagctgcttggcgtcggcgatgttgcggatcacggcatgggcgtcgatggtgccggcatgggtggccgcctcgaaatcggcggtgatgtgcaggtcttcgatgtgcacagtgggttgcgcggtgagttcaacggagcggaataagccgtgcatgcgccagaagtcctgatcttccagccaacttgcggtggcgtattcatagcaggccacggccagtgtattggttccggaaatcagtgcctcggtgacgtcgaattcgctgggtgtgtaggagtcctcggcgtagccgacgaaggaaccgttgagccagacgtagatggcggtggaggcgccgtggaaggtcagcgtgatgcggtgcttgttttcgatggcggcggagacgggggcgcttgtctcgaaagcgcggcggtaaatggctacgtgaccatcagtggggatgttgggggctttgggatcgctgtggccatcccaggggtactgcacgttgacgtacttatggttcagcaagcccttggtttccagtgttgagggaacggcgatgcggctgaaaccggtgtcgtcataatcggttgcggtgaaatccggagattcagcgttgccggaatcgttcatggggaagccgaaaaccggggcggtcgtcacggcgacattccacaagccgtcaaggttttgcttgaggctcatcgtttcgttcggctgcggtacgtgatcgtagaagcgatggtcggaatgggctggttcgcggttgacggcgaatacggtcggatcggtgagccaatcagatgatgcgatggtggtggtggggatgggatgctgcataaccgctttccttgagttgataaccacgttgtcgattcagagggtaaaactctttactgattatggtaaaacctgatggtgcagatcgcaagttgctggaggtattttctgtggcggtgtgtcgcgctgtcgataattcatatggtgatagaagtgtgtattcgttggaattctgcgatttttgcgagtgctgcgacgttggttttgaggttggttctattgacaataattagtgaaaaaatttattaaatcttggtaatgatgtacgctatccaacgaggtcggagaagacctcaccgagaatgactctaaggagaagatgtcaatgtccgtttcgcagtcaccggagagcgaatcccaatcaccgaatccgaccggagatgaatccggccagataaatcgtcctaccaaagcagagactctgaggcgccgtgccgcctatgctttcggtaatctaggccagtcggcgttctataacgcgctgagcacctatttcgtcgtttacgtgaccagcgtgctgttcgtcaatgtcgagaaagccttggccaccaaactcatcgcactgatcacaagccttatcgtgataatccgtatcgcagagatcttccttgacccgttactgggtaacttggtggacaacaccaacacccgcttcggccggttccgcccgtggcagttcatcggcggcttggtctccgccgtgctgctcgtcatggtctacaccggtctgttcgggctggtcaacgtgaaccagacctggttcatcgtgctgttcgtcgtggtgttcatcgtcctcgacgtgttctattcgatgcgtgacatctcctactggggcatgattcccgccatctcctccgactcgcacgaacgcagcgtatatactgcgctcggtacgttcaccggttcgattggctataacggcatcaccatcgtcgtggtgccgatcgtgaccactttcagtttcatgttcactggttctcgcgccgaaagtcagtcgggctggacggcattcggcatcatcaccgcattgctcggcatcctgaccgcatggaccgtggcgttcggcaccaaggaaaacgaaagcgtcctacgttccagggcagatcagagcggcaacccgctgcaggcattcgccgctatcgtaaaaaatgaccagctgctgtgggtggcgttgagctacctgctgtatgcagtggcgaatgtggccaccaacggcgtgatgttctatctgttcaagttcgtgcttaacctgccggatgccttcgccatcaccggcgtgatccccgtgatcgcgggcttggtcatggcgccgctctacccggccctgaaccgccgcataccgcgccgatacctgttctgcggcggcatgatacttatggtaatcggctatgtgctgttcattctcgattcggccagcctgcccgtggtgatcgtggcgttgattctgttctacctgcctggcacgttcatccagatgaccgcgattctctccctgaccgattccatcgaatacggccagctcaagaccggcaagcgcaacgaggccgtaaccctctccgtgcgtccgatgctcgacaagatcgcgggcgcgctgtccaacggcatcgtcggcttcgtggccgtggccgccggtatggttggctccgccaccgccgccgacatgaccgccgccaacgtgcgcaccttcgagaccttcgcgttctacatcccgcttgccttcatcgtgctgagtcttctcgtcttcatgttcacggtgaagatcgacgaaaagatgcacgagcgcattgtcatcgagctggaagagaagctcggtgtggacagcctcgacgattagttgtgaaggtagattggctcggcttctctatgacgaatgccgccaacgggcacaaacctcgttggcggcattcgtctttccaggacaccgcaatcgcggatgcatgccgtttacgcgttgaatacgtattggtcaaggcggcgcatggcttccttgatgcggcttaagggcaacgcaaggttgacacggatgctgtagggagcctggaacatgctgccgtcctgccaatcgacgcccacatcccagccgcgcttctccaattccgccaaagtcaaaccatgagccttacaccactgctcgcagtcgagcagcagcatgtaggtaccctccggcttggccaaactcaccccttggaaatgcttggtgatgtagtcataggcgtagtcgacattgccggtgagcacctctttgagttcgtcgagccactcatgcccctcaggcttgtaggcgccgataagcgcatgcatggaaagcacgttcatctcgttatagtgggacttcgagctcttggccacgatccggtcgcgcagcatggggttatagataatgtggtagctgcccacgagcccggcgaggttgaaggtcttgctgggcgcgtagaacgctgcggttctattgcgtgcgtcctcgctgatcgactgggtggggatgtgctggtgattccccagagtcaaatcggaccaaatctcgtcggaaatgaccacgcaatcgttggccttgtacacttccatggccttctcgatttcccaacgctcccacacgcgcccgcaaggattgtgagggctgcagaacacggccacatggatgtgatgctccttgagcttcttatccatatcctcgtaatccatgcgccatacgccgtgctcgtccaacttgagcgggctgtggacgatgcgatagccgttgttctcgatgcacatggtgaacccgatgtaggtcgggctgtgcaggagcacgctgtcgccaggagcggcgaacgcggtcagcgtactgatcacgccacccaagaccccgttctcatagccgatcgcctcgctggtcaatccggtaaccccattgcgcgtggattgccagtcgataatggagttgtaatagtcgtcggtgggggagaagtacccgtagacggggtgttgcgcgcgttcgataatggcctgcggaaccgtgggcacggtcgggaaattcatgtccgccacccacatcggaatcacgtcaaatccgtccctcggtgggtcgggagcgaaacctaggtcggttcccaacccatcgaccgcaatcgcatccttgccatgcctgtccataatcgacgtgaaatcgtacgtcattcctcaacaatcctttctccggcccatacgggagccgcccctgaaccagatgtgcaatatcgccggtaaaggagcctagcgtgtttgctgacaatggtgcacgcgatgaatacaaaaatgagaaaaaatgatcattcctgatgaacattctcgttgatttgaccgcgtggcgtgttacgatatgcaccgttgtgaggcagtgatccgttatcagcggggagtcttcggaagaacggcggcaatcgcccagtagaaccgacgggatcggcccgagacagccgaacacaagcggtcgcgcaggctcgcggctccgagtgcaacagttcggagcggcgcaaccggtgcgataagcgaggtggtaccgcggtgcggagcgcataccagcgcccgtcatcgtcctcgtaggcaggaacggcaaacatggctgttccgggcggaacacagtcagttccggctgcgaggcgattgacgcaatcggccccacggttcggtacgtgacattcgtgaacccagccggcacacgtcggcgcccggcaatcgccatcaatgacgctcctgtaggaccagtgcacagtactaacaggagatttacggtgagcgaaaacgtatatcccaaggcgaacgagggcggcgagaccgcgcacgtcgcgccgaaccccagcttccccgacatggaggagaccgttctcgactactgggacaaggacgacaccttccagaagtctgttgaacgcaacccttccggcgaccacagccagaacgaattcgtgttcttcgatggcccgccttttgcgaacggtctgccgcactacggccacctgctgaccggctacgccaaggacgtgatcccgcgctaccagaccatgaagggccgcaaggtcaaccgcgtgttcggctgggacacccacggcctgcccgctgagcttgaggcgcagaaggaactcggcatcgactcggtcgaccagatcgagaagatgggtatcgacaagttcaacgacgcctgccgcgcttccgtgctgaagtacaccaacgaatggcagaactacgtgcatcgtcaggcccgttgggtggacttcgagcacggctacaagaccctgaacatcccgtacatggaatccgtgatgtgggccttcaagcagctctacgacaagggtttggcctaccagggctaccgtgtgctgccgtactgcccgaaggaccgcacaccgctgagcgcgcacgagctgcgcatggacgccgacgtgtaccaggaccgccaggacaccaccgtgtccgtggccgtgaagatgcgcgatgaggacgacgcctacgccgtcttctggaccaccaccccgtggaccgtgcccaccaacttcgccatcgtggtcggcgccgacatcgactacgtcgaagttcgtccgaccgaaggcaagttcgctggcaagaagttctacctcggcaaggacctgctgccgcactacgagaaggaactcggcgagaactacgaggtcgtgcgcgaactcaagggctccgagctggaaggccgccgctactacccggtcttcccgtacttcgcgggcgacgaggccgaatccgaaggccatgtgcccggcccgaacggctacacgatcttcaccgccgactacgtcgacaccgtcgaaggtaccggtctggttcaccaggccccctacggtgaagacgatatgaacacgctgaacgccaagggcatcaagagcaccgacgtgctcgacgatggctgccgcttcaccgcgcagtgccccgactacgagggtgatttcgtgttcgacgccaacctgccgatcctgcgcaacctgcgcgccggcgacggcccactcgccgagattccggaagagcgccgcgcgatcctcttccaggagaagagctacgtgcactcctacccgcactgctggcgttgcgccaccccgctgatctacaagccggtctcctcctggttcgtgtccgtgaccaagatcaagccgcgtctgctggaattgaaccagcagattaactggatcccgggcaacgtcaaggacggccagttcggcaagtggctcgccaacgcgcgcgactggtccatctcccgcaaccgcttctggggttccccgattccggtgtgggtgagtgacgatccgaagtacccgcgtgtggacgtttacggttctctcgaagagctcaaggccgacttcggtgactacccgcgcgacaaggacggcaacatcaacatgcaccgtccgtggatcgacaacctggtccgcgtcaacccggacgacccgaccggcaagtcgcacatgcaccgtatttccgatgtactcgactgctggttcgagtccggttccatgtcgttcgcgcagttccactacccgttcgagaacaaggagaagttcgagcagcacttcccggccgactacatcgtggaatacatcggccagacccgcggctggttctacctgctgcacgtcatggcgaccgccctgttcgaccgcccggcgttcaagaacgtgatctgccacggcatcgtgctcggctccgacggccagaagatgtctaagcacttgcgcaactacccggacgtgaacggcgtgtttgacaagtacggttccgacgccatgcgctggttccttatgtcttcgccgattctgcgcggcggcaacctgatcgtcaccgccgatggcatccgcgacaccgtgcgccaggtcatgttgccggtgtggagctcctactacttcttcaccttgtacgccaacgcggccaacggcggggccggattcgacgcccgccagctgcgcgcggacgaggtcgccggtctgccggagatggaccgctacctgctggcccgtacccgtcgtctggtgctggccgccgagaagtcgctgaacgagttcgcaatctccgacgcctgcgatgcggtctccgacttcatcgacgtgctcaccaactggtatatccgcaacacccgtgaccgtttctggaatgaggacgcttccgcgttcaacacgctgtacaccgtgcttgaggcgttcatgcgcgtgcttgcgccgctggccccgatggaagccgagtccgtgtggcgtggtctgaccggcggtgagtccgtgcacctggccgattggccgttcgtggtggacgagaagaccggtgaagacaccgaactcggccgtgtgctggtcgacgatccggctctggtggacgcgatggagaaggtgcgtgaggtcgtctccggcaccctgtccctgcgcaaggccgccaagatccgcgtgcgccagccgctttccaagctcaccgtggtggccgggaacgtggaggccgtcaaggcgtacgacgagttgctgaagtctgaattaaatattaagaacattgagttctcgactctggaagacgccgccgcccacggtctgaagatcgtgcacgagctgcgtgtgaacgcccgtgttgcgggtccgcgcctcggcaagcaggtgcagttcgccatcaaggcctccaagtccggcgactggcatgtcgatgctgcgtccggtgcgccggtggtctccacgccgtccggcgaccttgcgctggtcgaaggcgagtacgagcttatcaaccgtgtggaggaggagaacgccaccgaggccgccgcttcggtctccgcctcgctgccgaccggtggtttcgtgatcctcgacaccgcgctggatgccgatctgctggccgagggctacgcccgcgatgccatccgcgccgtgcaggatgcccgcaaggccgccgatttggacatcgccgatcgtatctccttggtgctgacagttccggccgccgatgtggccaaggtcgagcagttcaaggatctgatcgcccgtgagacgctggccacctccttcgaggtgaaggaaggcgccgagctgggtgtggaggtcgccaaggcgtgatgccgtggcggactgaccgcgcctgatgcgtggtgcacgggcgcgtgaaatgcacgaagtggtcctgccgtttagcggcgggaccactttttgttccgtggtatgccataaagtttacgtcaggtatttgttcaactgttcaatgcggtcggcatgcagattttgaatacgattacgggcgtgctcccagccggacgcttattgtccaccggcttgatggactagacgtgttccgccatgcggcgacgcgaaaatcttaaatggaagccggaaaatagccatggacaaccatgttgattacacccgaacgataggctggttgatagactaaccgaaaagtggtttgcttgagaatccatatgtttgtggggtaagcaatggctgtttccaaagtcgaatctcgtacggtctcggagtgttctctgaacaacatcacgtccatggatccactgaacgaggaatggtacgaaaatctgatcgtcgaacatctaacggagaaactcggatatgagcacctgtacgggcccgatgttcgccgcaccgacgactcgtatcgcgacgtattccttcctgatattctcccggatgcgttgcgacgaatcaacagaaatctgccggaagcagccgtcgaggaggccatccggaagattcagaatgtcgagatcggcagcttggagcagcgcaacgagatattcaatgactacctgcaatcaggagtcgaagtgcacttctttgacggcaaggaagagcgtgatgacatcgtccggctgcttgatttcgacgatcccgagaacaacgatttccatgtcgtgaaccagtggacgttcgtggagtattccgagaaacgtcccgatgtcatcattttcgtgaacggcatgccgttggtgttgttcgagctgaagtccccgtcgagagaggagacggacgcttcacacgcgtacctgcaattgcgccagtacatgaagcagataccgagcatgttcgtgcccaacgtgttctgcgtgatgagcgatatgacccagaccagggtcggcacgatcacatccgacgaggaccgttacgtggcttggaagtcggcggacggcgactattccggaacgaaagccgcggcatggagcaccatgattgacggcatgctcccgaaggaacggctgctcgacatcatccaaaacttcgtatgcttcaacgattcctccgagaaggtcgtgaagatcatcgccgcataccaccagtatttcgcggtgcggaaagccatcgtcagagcggaagaggccgtcaatggggatggcaggatcggcgtgttctggcacacccagggaagcggaaaatcgctttcgatggtgttcttcgcacatctgctgcagcgttatcttgaaagcccgaccatcgtggtcatcaccgaccgcaacgatctcgacgaccagcttttcggacaattcagccgctgcgccaggttcctgcgccagaaggcggtccaggccgagagccgcaggaatcttcaggaactgcttgagggtcgtgaggcgaacggcatcatcttcacgaccatgcagaagttctcggacggcgacgagccgttgtgcgaccggagcaacgttgtggtgatggtggacgaggctcaccgcggccagtacggcctgaccgaacggatcaacgcggacggtcatgtgtcggtcggcgcggcccgtgtcgtgcgcaaggcactgccgaacgcgtcctatatcggtttcaccggaacgccgatctccacggatgaccgcaacacccgcgagatcttcggcgactacattgacgtgtacgacatgacccagtccgtcgaggacgagtccaccaagccggtctactacgaaagccgtgtggtctcgctccatcttgacgagaacgcgctgggccgcatcgacgcggtctacaaggagttcgcggaccaggccgacgaggcgagcgtggagaagtccaagcatgacctcggcggcctcgatgccatcttcgacactcctgaaaccatcgacgcattgtgccgcgacatcgtggaccattacgagaacaaccgcgccgacgtcctggccggcaaggccctgatcgtggcgtacagccggccgattgcgatgaagatctactacaggatcatggagctgcgccccgaatggaaagacaaggtcggcgtggtgatgaccatgtcgaaccaggatccggaggaatggttcgacgtgtgcggcggcaccacgcacaagaaggagatggaacgcaggttcaaggacgattccgattccctcaagatcgccatcgtcgtggacatgtggctcaccggcttcgacgtgcccagcctgtccaccatgtacgtgttcaagccgatgaagggccataacctcatgcaggccatcgcccgcgtcaaccgcgtgtgcaagggcaaggagggcggtctggtcgtggattacatcggcatcgcaggcgcgctcaagcgggcgatgaaggactataccagccgtgaccagcacaattacggcgacatgaacatcgccgagaccgcctatccgaaattcctcgaaaagctcgacgtgtgccgtgatctcatgtacggcttcaactaccgcaaactcatcttccagaacagcagggaggcgcttgccgacgccatcgcggagggaaccgactggctgctcgatctggaacggcacgaagacacggaatcgttcctcaagcaatgccagctcatgaaccaggcgctgagcctgtgcaaaagcatggtaagcgaagaggacgcgcatgaggcggcttacctatccgtattgcgcgtgcaggtccttcgcctgaccggacgtggctccggcgggggcagcggcatgacgtacacggagttcaacaagcaggtgagcgagatcctccagcagagcgtgcatgcggacggcgtgctcaacctgttcgagaaggacagcgtggagatctccctgttcgatgaggcgttcctccaggaggtcgccggcatgaaggagaagaacatcgcgatcgagagcctgaaacgcctcatcaaggagaaagtgcgggcgtacgggcgcaccagcgtggtcaaatcccagaagttcagcgagatgctccagaacacgttgaacgcgtatctcaacggcatgctcactaacgcgcaggtcatcgaagagctcgtcaacatggccaaggagatcatgaaggaccgcgacgacgcgcagaagctcggcttgagcgacgaggagatggcgttctacgacgcaatcacccagccgcaggcggtcaaggacttctacgacaacgaccagcttgtctcgatagcccgcgagctgaccgatgcgatgcggagcaacgccacgatcgactggcagaagaaggaaagcgccagggccggcatgcggcgtgccatcaaacgtttgctgcgcaaatacaagtatccgcccgaaggcgtcgaggacgccatgaagaccgtcatggaacagtgcgagctgtgggccgacaccaagatcagcgaataggatgagcaggaggataatacaagacatggcaaagaagaaggacaataccgccgagatcggcttcgaggaacagatctggagcgccgccgacaagctgcgcggcaacatcgacgcttccgaatacaagaacgtcgtgctcggcctcatcttcctgaagtacatctccgacaagttcgaccagaaataccaggaactcgttgaggagggagagggcttcgaggaggaccgcgacgaatacgcgagcgagaacatcttcttcgttcccgagaacgcccgctggaagaccatcgcagcggccgcgcacacgcccgagatcggcaaggccatcgacgaggccatgcgccagatcgaagccgagaacaacaagctcaagggcatcctgccgaagaacttcgcacgccaggagctcgacaagcgacgtctgggcgaggtcgtggacctgttcgccaacgtgaagatggccgaaaagggcgatagccgcgacatcctcggacgcacctacgaatactgcctggccaagttcgccgaagcggagggcaagaacgccggcgagttctacacacccgcgtgcgtcgtgaagacgctggtcgaagtcatcgaaccctaccacgggcgagtgtacgatccgtgctgcggcagcggcggcatgttcgtacagtccgcggacttcgtcaaacgccatcagggcaacatcaacgacatctccgtgtacggccaggagtccaatccgaccacgtggaaaatggcgaccatgaacctcgcgatccgcggcatcgacgcggatctgggcgatcataatgccgacacattcttcgaggacctgcacaagaccgagaaattcgatttcatcctcgctaacccgcccttcaacctgaaggactggggagggaagaaactcgagaacgacgtacgctggcagtacggcaccccaccggagggcaacgccaacttcgcatgggtccagcacatgatccaccacctcaaccgtttaggccgcatgggcatggttctggcgaacggcgcgttgtccagtcagacgaacaacgagggcgagatccgcgccaagatcgtggatgccgatctggtcgaaggcatcatcgcaatgccggacaagcttttctacagcaccggtatacctgtgagcctgtggatcatcaccaagaacaagaagcagtccggcaagacgttgttcatcgacgcgcgcgatatgggaaccatggtgtcccgcaggctccgcgagttcaccgatgaggacatcgccaaggtatcgactgcgttcgacgcgttccgtgacggcactctggaaacggagaagggcttctccgccatcgccacgacggaagatatcaaggcgcaagattacatcctgactccaggccgttacgtcggtgtcgccgaagtggaagaagacgatgagccattcgaggagaagatgacccgtctgaccggcgagatcgccaaatgcttcgaggaatccaaccgtctgcaagagcagatcaagaagaatctggaggccatcggctatggcatgtgagcagctgacgcgtctaggtgatgttatcgagcttgaagatgtcaagagagagccgatatcttctagggacagaaaggacagaaaaggttcctatccttattacggagctcaagaggtattgtcgattatctagatgattacacctatgagggagattacctactggttgctgaagatggggaaaatcttaggagtcgcaagaatcctattgcgaatgcggcttctggaaaattcagagtgaataatcatgcgcatgttattgctgagtccgaaaagtgtaatctcgtttttctgagacatcttcttaatatgactgatatttctgcctacgtaacaggatctacgcagccaaagctgagccagagtaatctttgtgccatgaaattgcctcttccttcgatggcggaacaaaatgctattgcaaatgttcttagtttgtttgataggaaaatcgagcttaacaaccagctaaatgattatttgttagctgcgtgaggtcaaccttcgaaacgtcgatttcgccggacatgagcttgggaaggagcgtatcgcgcagtgcttggagctttactgtctctgaatcgttatcagatctttgctttattgcggaatctaataggatcaaatctttcgtactgcatgaactggcaaccttgaactccatcatttgttttttatcaccacggggcatctttgttcccttcgcaccttgcatgacgtagtcaaagaatgagtcttgccgtaggcatgcatgcagatacggcgcgttgctgggatcattcgctctaaaaacgatgacgtcacccgaacatgtaccttcaaacggggcgtaccatatctttttaaaatagggacgaatattagaaatcagagtgtcgccggctttataccgtgtaatcttgcccgttgttgggagcgaagacgccagttgccgtcctcccttgttctgcattagtgactcagtcgaaacgtaagtctcctgattcgcgttgtcataatcgacgtggtcagcaacctgatagcagatatctcgaagacgtgaatttctgtcattacagtatctactggcaatcgtttcacacaagttggctaaataatcatttagccgattattaagggcaattttgtcgacaatggaatcaagcacttctacgattgcatcttgtgttgccttgtcaggtatcttgacagggcagagattcacgtgatttcgattgacgcctggcacagcactagctgttgtgtatccttgccacgggattgtctgcaaaagataatagacaaatcgaggattgttgccgttgaactcggtggaatacaaggctgtgttgagaggccaacatggaccacccgaaaagaaaacttctccgatagtgccgtatcgccctgtgattacacagggcccctctactgctgcagtactattagatccggtaattcccgatgatgaataaaccggcacatccccttgcaaacgctggcttttcggcaaatcaaatcctctttttaagtcggtaatctcaccaagggtcgtctctcgccagctcattccaaataccttctgtgtgaagctttcacgttgttctggttgaccatgacgtagtgcatggtcgtgtctattctcgcatgcccgagcagtttttgcacctgttcgatcggcatgcccttgtcgatggcgtgcgtggccagagtacgacggaacttatgtggatggactcgattgatgccggcgtctttgccgagccgcctgaggcggctttcgatgccgccgatgctgatacggtcgccatcgccattcaaagcgacgaatagcgccggattgctgtcgttacgcgattgcaggtatgcggtgagatggagcttcgttctggcgtcgaaatagacgggacgctgcttgtttcccttgcctgtaaccaagcattcccgctcctgaagatttacgtcggctatgttcaaaccgaccaattcgcccactcgcatgcctgtggatgcgagaatgtccacgatggcaagatcccgcaaggtgccgcatcggtcccgcagagtttccaggttttcgtcgctcaggacttccttagctattacggcggtcttcacacggtggatgcgtcttacgggacttttgacgatataatcctcgtcttcaagccacgcgaagaagcttgacatgatacgccgaatgttgtcgatagtgactttgcccgcatgacgttcgttctcgtatctgttgaggtacccgcgcaagtcatcgctgcttatccgcgtgtagggcttagcaagggccttagtcatgtgctggagcgtgctttcatagtaagcgatggttttcggcgagcagccttcgacctcttttgccgtgaggaatagcgtcagcagattctgcggcgctgatgtttcctgagctggcagcagcgtgactctgagtacttcggccagatgtttgagctgtgacggatcaagcatgttctgcatctgcgacagaacactattaatgatggtttccataggggttccttccaataacagttaggaacattgtgcccacgcgctggcaaatgattatttgttagctgcgtgaggtcaaccttcgaaacgtcgatttcgccggacatgagtttgggaagaagataactccttaggttatttaatttccgtgtttcgttttcattactcctaattagtgcatctatcggtgccgcaaatgactcgaattgcatcacttcgttatgagatggaagcgcaacttctaagcttttgagagccttaccgttgattgagccgaatacagtaccctctccgttgtaagcctcaagttgaggcttaaggaatcgcattaagtacagagcaaatgacggggtttcgctatggatagctgccagaccacgtccgatacagcaattttcaaaggcaacgttgaggtccccgacaggcgcacgaacgctcattaggacgtcaccctcgcaggctaaacgttttggctcagtggtatagagacgacgctttgggaaacgccatccaaattcaccccttccttgatagaagattatgccagcaccttcttcgttatacgaacttcctgctggtgattgccccatcgttatttcggcaacatcagagagcgtagcgttgaaattaagaccaccaaacaactcttgaaacttaccgtctacaagctgctctaaataatcatttagccggacggatgcattggagcaatgtgatcagagtaagagctattcacgctgtgcacagtcagcaaagccagattcctgcttacgaatctgtgcctaaagtgtcccattctccatgtcgcaccgccttgacgctcggcggaatcgcgccgctgttgagctggctgtcggtgagtcagttcacggcacagtcgttcgcgatgctcgttgtattctgtcaagttgtcttgtgcggtgtgagctctgagctctcatgaagcactgggtcgtttgcgccgcagattatggttttgggggacggtgtgtgttcttcttgttgtttgataactcaagagtgagtgatttgctggcatgtcgcttcagcggttgcgtatcggggaagatacggatggattgtaccgtgcaatcgatgccgtgggacgggcggagtattcgtattttgggacatggagtccattcttgcgtcgcaccccgcacggggtgcgacgcaagaatgcgccaacgtctactgcgcgccgatcgcggccttgagctcctcgaccttgtcggtcttctcccacgggaactcaacgtccgtgcggccgaagtgaccatacgcggcggtcttcagataaatcggacgtttcagatccagctcgtcgataatcgcagcggggcgcaggtcgaagaccttgcgcacggcggcggcaatctggcctcgcgtcacaccctgctcggtgccgaaagtctccacattaatggacaccgggtcggcaacaccaatggcataggcgacctgaatctcgaccttgtgtgccaagccggcagcaacgatgttcttcgcaacccaacgagtcgcatacgcggcggaacggtcgaccttggacgggtccttgccggagaacgcgccaccgccgtggtgggcggcgccaccgtaggtgtcgacgatgatcttgcggccggtcagaccggcgtcggccgccgggccgcccaggatgaacgaaccggtcgggttgaccagctggcggtagttgtcatgcggcaccttggaacccagcacctcatcaagcaccgggtcaatcacgtgcttcttcagctcaacagcaagccaatcctgcgtaacctcaggatcatgctgggtggagatcagcacggtgtccagacgaacgggcttatcgttatcgtcatactcaatggttacctgggtcttgccgtccgggcgcaggtgcggcacttcaccggacttgcggacctcggtcagacggaaggcgaggcgatgtgccaaatagatcggaagcggcatcagcgtcggggtctcgtcggtggcgtagccgaacatcacgccctgatcgccggcaccctgtgcttcgtaacgctcttcgcggctggcggcggtctcctgatcgccagtcagacgggcaacgccctggttgatttcggcgctttgctcggtgatggccaccacaacgccgcaggaatcggcgtcaaggccgacttcggaggaggtgtagccgatgttgcgcagggtttcgcggaccttggactgcacgtcgcagtaccccttggacgtgacttcgccgaagatcaggaacacgccagtggcggcggaggtctccacggccacatggctggacgaatcctgggccagcaaatcatcaagaatggcgtcggagatttgatcgcagaccttgtcagggtggccttcggtcacggattcggcggaaataagccgatgttcttctgtcatatcatccctttcttcaggacttatcgccccgcgggatgcgaggcacaatgatacggtgtcaatttttacttgtcactgtggaagcgggcataaataaaggctcgtgccaaccagcgcggtggcgcgagccttgcgtcttattcgctcccgatgttgagttatagccgattgcgataactcaggcaagcgtgtcgctcaaaatcagttgtgagagaactctcacaccatcattcggcgacgaactgtccaaacaatccaaacgaattgtcggaatcgatcagttgccctcgttggcgtcgtcctcgcccaaggtctcctcaagcaggccctcgtcgatttcgcggaaggcgatggacaggggcttctcgttgttctggtattcgaccagcgggccgatgttctgcagcaggccctcgttgagctgcgtgaagtaggagttgatctggcgtgcgcgcttggcggcgaaaatggccagcgcgtacttggaatcggcgtgcttcattaggtcgtcgatcggcgggttcgcaagaccgtcgggtgtcgggtcagtaccaaaagccattgttcttatctccagacattggaaaatctatctcaaccgaagcaagtgtagccgtttggggggacttctgccggacctccgccagacttccagtggaggaatgtattccaaaaatatgtgtgagaaacgttacgcttttgcaaattccattattcgactcttgacaagtggcgtgtccctcacaagggcttgaatagaaccatgactgaaatgcgatctgcaaaaattatgtcagggcgcgtctttgcaggcgcccgagccctctaccgtgctgcgggcgtcaacggagacgacatgggcaagaagcccatcatcgccatcgccaactcgttcgatgagttcctgcccggccacgtccacctcaacaaggtcggccgcatcgtttccgaggccatccgggaagccggcggcatcccgcgcgagttcaacacgatggccgtggacgacggcatcgccatgggtcacaccggcatgctctactccctgccctcccgcgacatcatcgccgacaccgtcgaataccagtgcaacgcacactgtgccgacgcactcatctgcatcccgaactgcgacaaggtcgtgccgggcatgctgatggccgccctgcgcctcaacatcccgaccgtgttcgtctccggtggcccgatggaggccggcaccacggtgctcgccgacggcaccgtcaagagcaccgaccttatcgacgtgatgtacgccaccgccgacgacagcgtctccgatgaggaactgctcaactatgagaagaccgtctgcccgacctgcggctcctgcgccggcatgttcaccgccaactcgatgaactgcctgaccgaggccatcggcctggccctgcccggcaacggcaccatcctcgcctcccactcctaccgcaaggacctgttcgagcgtgccgccaagcaggtcgtcaagatcgcccaccagtactacgacgattccgacgattccgtgctgccgcgctccatcgccaccaaggaagccttcgagaacgccatgaccatggatgtggccatgggcggttccaccaacaccgtgctgcacatcctcgccatggcccagtccgccgacgtggacttcaccctggacgacatcgagcgtatttcccacaccgtgccgtgcatctgcaaggcctcgccgtccggcaagtgggagatttccgacgtgcaccgcgccggcggcatcaccggcatcctcggcgagctcgaccgcgccggcaagctgcacaccaacgtgcactccatcgactatccgacgctggaagccaagctggccgattgggacatcatgcgcgcgacctgcaccgaggaagcccagcagatgtacaaggccgctcctggccacatcatctccccggagccgtggacgcacaccaccctgttcgactcgctcgaccgcgaccgcaccaacggcgccatccacgacatcaaccacccggagatccacgaaggcggcctcgccgtgctgcgcggcaacctggcccccgacggctgcgtggtcaagaccgccggtgttccgccggagatctggaagttccgtggaccggctctggtggtcgactcccaggagcaggccatcgaggtcattctgaacgacaccctgaagcctggcatggcgcttgtgattcgttacgagggtccgaagggcggcccgggtatgcaggaaatgctgtacccgacctccttcgtcaagggcaagggcatcggcaaacaggtcgccatgctcaccgacggtcgctactccggcggttcctccggtctggccatcggccacatggcgcctgaggctgccaacaagggcccggtggcgctcatcaagaacggcgacatcatcgatatcgatatcgaagcccgttccgtgaacgtcgaactgactgacgagcagctggacgagcgtcgtcgcgagcttgaggctggcgacggctacgtggctcaccgcaaccgccacgtctcccaggcgctgaaggcgtacgccgccttcgcccgctcggccgacaagggtgcgacgcgtgacccggagctgatcaacaagctctccggtctcgactgatcgccgattgcatagctgaaaagcccggtatcttcctcgcgaagatgccgggctttttgctgtgcttccgggcgggagcgatattgcttgttatcgcacgcaggcggcgggggagaggcgtgcgcctcgggcccagtcggcggcgcgcatggccttcttgccttgcgccttgacttgggtgagttccagcggcgtgctgccggtaccaacccacacgttcttcttgcccaccttcagctcgccgggctgaagctcggccggagtgttgggattggactggtcggccggttgtgcggcgagaatatgcagggtgaggggtctggcggccggctcgtcattatcggcgattggcccttccgcaaacagttcggtccatgccccgggatgtggcgtgcaggcgcgaatctgacggtcgatggcctcggcctcgtccgtccaactgatgcgggcgtccttcaccgtgatcttgtgcgcgtattccaggctctcggccggctgcgcggtgaatgtggcggtgccttcacctacggcggccagcgcatccacatacatgggcgcgccttcctcggccagacggtcaagcagttcgccggaagtctcacggccggtcagttcgatggtcagggaagcgacgatcgggccatcatccaaaccctcgcccaccttgaacacgtcggcgccggtggtcgggtcgcccgcccaaatcgcacgctgggcgggagcggcgccacgccacttcggcaggttggagaaatgcaggttgtaccagcccatgggcaccgcatcaagcacgttcttgggcaggatattgccataggcgatgacagcggcgatatccgcatgcaggtcgttcaacgcctccatgaattcgggggagcggggtttgagatcgatgacgggcaacccgagctccagagccgtcgccttgaccgggctgggcgtgagcttgcggccgcgaccggtaggcgcatcggggcgggtaatgacgccgaccacatcaaaacgtggatcggtggcaaaggccttgagcgagggcaccgccacgtcgggggtgccggcgaacacgagtttgagcatggtcctccttgaaatgtcgatgctcactgcacggccggaatgttcacgccattggcgatgagcagttcacgcagcttgaccggatcctggaaacgtacgccacggatgccggccgcattcgaaccgacgatgttcatggccttgtcgtcgatgaacaacgcgccatcggccttgatgccgaactggttcaacgcggcctcgtagatttccttgtgcggcttgcgcagcttgacaaaaccggagacgagcttgccatcaagctgctgcaaaatatcgcactgttcctcggccacgtggaacagactggattcccagttgctcaggccccacacgccaataccggcggccttcaggtcattgaccagcacgcgcgcgcccggcacgatgccggtcagggagtcgcggaagttcttgatgtagtagtcgaggatgtccgcccacttatcgcccctgtcacggcgcatgatggcgatggcctcgtcggtgctggtgccgccgtccatcaggtcgttgacatcgtagaagccggagatgtcgttgtcgaggaattcgtcgatggtcttctggctgtagcgggggatgagcacggccgctggatcccagtaaatcagcacgttgccgaaatcgaagatcacgtcggtgatcggcttgccggcgttcgcagcggcctcgccatccgcgaccagcacgtcgtaatccatatccggctctccaggccaacccttcatagtgtcctccttctagcgatgttcattctgtaatcatcgtttcacgtgttgaagacgattagatcagatctttgggatctactcggaagcgaagctcgccgggttcgcgggacgccacatgacgagcggtttcccggtgcagtcgggccgccagctcggctcgccgactctgcggcacacggattactgccttcacccggtcggccgtggcttcgagctccctggcatcaactgtgtccggttgcgcgatcggcaccgggcccaacatgccgggcagctcgccgcaggccgtccaatcgccgcccagcgcgccgatacgctgcatcagcgtcatcaccgcatcacggcgtccccatacgcaggcggcggccacggccggcggcataccggtctccacacgctcctcaagatccttggctgcaagaatcctcgaatcccagagcatcagcgattgggcgatggccgggtcggtttcgccgagaatcaacgcctggccgccacgggaacgcggcgcgcacaacgacaccgcacgcatccacgcggtcaatgtatccaagcgagcatccacgcccaacgcatacaagctggtccaagcgtcgagcacggccacggcacgatactcatggccagccgatccctgctcggcactgaccggacgcacgcgcggttcgaaaccgggagtggcgatgacaatcatcggctgacaagccacatcgcgcaccaggccctgcgtcttgctggacaaaactactggcacgccgcggaacaacccggccagttcagccgcagtgcctgcagcacccacgcgcaccacacgcatacgttcatgcccacagcccgggcacttccaattgatggcagcagccccacaccagcggcatcgcggtgtggaatcccggcggtcggccggtagttgcaacggtccagaacacttggcacaacgcgcctgacgatggcatttcgcacaactcagagtctcactgacgctgtcttgcggaatggacagcagcacggggccgctctccaaagccttagatagcacgcggacggccgtatgcggcacgcgcgccccgatggacgggtcagcgagacgcgcaagctcatcgcgattgagccaacgcacccaaggcgtcgcatccttcagcggcgaggcgagcggatgaatcgcggtggaatagccgctcaccggagtttccaccgtacctggaccggtgttttcccactgactttgcggagtgcgcgcattggccatggccacgaacacgccgccatgggacttggcgcgcaaccgcatcacgccgcgagcctgtggatacggcatcataccgtccatgttctgataggcggcatcctccagaatggcgaacagtgccgggccttcaaccggcgcatacatcaccgcgcgggtgccgatcaccaccttcacctggcccaacgccacagccagatacgtgcggtaccggtcggccgcaggcatggtctccgcattgagcacggcgacatcgcccatccatccgccggttggagccggggcaaatggtttgagtccataattgcgtagcatatgcatcaggtcttcgacctcgcgcatggtgggcaattcaactacggcagccttaccggcactcaacgcagtggccaccatccatgccatgtttcgttgccactcctgtgcaccgggcaacgaatcaaacacaaaagattggaaacgttgaccggtaagcgcgtcatgaagcacattgacatcggcgtaattggcggtcagacgacgatacccctgcgcagctccctccgaaacggtgctagcaacggcaaaggtagagccagcaagtttggtcccatcgggattggtgccacgcccggcaaaaccgccttgcgtattatccggcaatgagccgccgaccggccgacggaacgacgcggccaaccgctgctcggtctccaccttggccacgcgcggtggcacggcgaaacgcagaatattggcccgtgtgccgccataggctttggcaaccagaccgatatcctcgcgcatcgaagcgggaaccagtacatcggggcttagcactcgctcgatatagcgaatcgaagagcgcggcgtatcactggtatcggtgcgtgcccaaatcacaccgctgaccctctgaccgccaaaccgcacgcgcaccagcacacccggttgtgcggcctcgctgtctttttcatcaatgaagtaatcgaatgtctgaccgaggtggagcgcctgcacatccagcacgacttgcgctatgggatgctgctcggccggcgtatgctccgcaggcgcacgtttacgacgcttgcggggagccagccccgcaagcgtcaactgttctgcgcctgaagtagtcatggctcaactataagtgccggagccgaggtcggtaaaattttaccggcgcaggtaatcgagtacgtgggttaggtcgcggtcgttgatggctttgtcggcggcgagctgggtctttggcttggcacagaacgcgagacccaaaccggcggcctgaatcatcggaatatcgttggcgccatcgcccacagccacggtctggctcatcggaatacccaaacggtccgcccacgcttgcaaggcgtgcagcttcacggtcttgcatacgatctcaccaagcactttgccggtcagatgaccgtcctcaacctcaagccggttggcaatccaatagtcgatatggctctcggccgccaacatgtcaaccacttcatggaagcctccggacaccacgccgatcttccaaccgtgttcatgcagcgtgtcgataagctccagtgcacccttggtgaaatgcagcttgtcatgcaccgtgtcgaacacggagatcggcaggccctccaacagggccactcgtgcgcgcagcgcatcgcagaactccagttcgccgcgcatggcgcgtgcggtcactccggcaatctcctcaccgcagccagccaccacgcccaactcgtcgataacctcttcgtcaatgagcgtggagtccacatccataaccagcaggccgggcttgctcagcgtcggcacagaaaccgcagaatcagccgggctcccaacttcgctctcggcggacttgtcaacaaaatgcacatcttcttgcgtcatgcttctgattctgggaaaaccttgggacaatgccctctatgagtttttccatggcagccgccactattcttgcaaccgaccccacacccatctgcaccaccaccgaacccggcctgatcggcaccatcaccgactggctgatcatgctgatggaaaccatcggcggtatcggcgtggccttggccatcgccctcgaatccatcttcccgcccatcccgtccgaagtcatccttccgctctccggcttcaccgccgcacgcggcaccctgagtctgccgggcgcaatcatctgggccaccatcggctccgtactgggtgcctggaccttgtacggcatctcccgctgggtgggcctgcatcgcatcaatctcgcggcagacaaaatccccggcgtcagccgcaaagacgtgagcaaagccaacgactggttcaccaaatacggcacatggtcggtgctcatcggccgcgtgattcccgtggtacgctcgctgatttcgattcccgccggattcaaccgcatgaacttcctgcacttcaccggctggaccctgctcggctcggccgtgtggaacaccatcctcgtttccgccggttacctactcggcgaccagtggtgctcgattcaaggcgcgctcggcgtgttcgaggacgtggtcatcgcggccgtgattgtggtcatcgtatggttcgtggtgcgaaaagtgcgtactgttatacgtaacaggaaatccgccgacggcaacgaatagggtctgccgactgccataagttgccgaaaatcccggatagaagggaagcgaagaacccgcatgagcgacaccgaagatctcgccgcgctgaacgatcgcctgatggccaagaaccatgcgctcgccgaagcgctgagccgcgccggcaaggaactgaccaaggcgaagtcacagctcgcccagctcgctcagccgccgctcaccttcgccaccatggtcaaggtcgattccacccgcaccgatgaagacggcatccagcacgcgtcggccgaagtcatttccggcacccgccgcatggtggtgcctgtggcctccaacgtcaacgccgcccgcctgaccgccggggccaccgtgatgctcaacgagaagctcgtgctggtcgagcagcgcgatgctgacaccgtgggccagattcgcagtgtcaagcaggtacttgacgacggtcgactgatcgttaccgacgcctccggcaatcccgtgctcatccgccgttccggcgcgctcgcgtatgcgggcatcaatcagggcgaccgtattatcgtcgatccgtccgtccgcctcgccatcgaagcgctgcccgccgagggcgacaaggatctggtgctggaggagaccccggatgtcacgttcgccgacatcggcggcctggatagtgagatcggtcgtatcagggacgccgtccaactgccgttccagcatcgtgcgctgtttgagcgctacgatttgaagccgccaaagggcgtgctgctgtacggtccgcccggcaacggcaagacgatgattgccaaggccgtggcgaacgccctatgcgagggtggttacgattcgaatggcgacggcgcaatcagtccggccgaaacccatgtcaagggcgtgttcctgtccgtcaagggcccggaactgctcaacaaatacgtcggtgaatccgaacgactgattcgcctgatcttccagcgcgcccgtgaacgcgccgcggacggcaatccggtggtcgtgttcatcgatgagatggattcgctgctacgcacccgcggctccggcgtctcctccgatgtggagaccacgattgtgccccagttcctctccgaactcgacggcgtggaatcactcgacaatgtgatggtaatcggtgcctccaaccgcgtggacatgatcgatccggctgtgttgcgaccggggcgtctcgacgtcaagattcgcgtcggccggcccaaaaccaatcaggccatcgccatcgtggaccattacctcaccgacgacctgcctctggaagatggcgtcgacgcgcacgccttgtccgccgtgctggtgcatgacatctacggaacctccgaacgccgccatctatgcgacgtgcaggaggagaacggccagtggcatgcgttgttcctggccgacgtggtctccggcgcgatgctcaagaacatcgtggaccgggccaagacccgagcggtcaaggaatccatcgaaaccggcttggacgtggcactcaccgtgccgctgctcgctgccgccgtggaagacgaataccgcgagacccgcgattccatggccgacgtggaccccgaacaatggtcgcgcatcaacggcatggacccgatccgccgcatccgcaccgccgaatagctcaagctcaaggagcactacatgaccgttaaacgagtgatgggcaccgaaaccgaatacgcggtatccctgaacaccccggaccgctacaatccggtgcaactgtccttcgacgtggtgaacggcgccgcggacagccacagcaaatccatccgctgggactaccggcaggaggacccggtcaacgacgcgcgcggcacccgtctcgaacgcgccgccgcccgcccggacatgctcaccgacgccccgcagctcaacatcaccaacgtgatcgcccccaacggcggccgcgtctatgtggaccacgcccaccccgaatactcggcgccggaaaccaccgacccgttcgaagcggtccgatacgaccacgccggagacctcatcatgcaggccgccaccgaacgcgcccgcaaacagactggcactcccattgccctgcatcgcaacaatgtggatggcaagggctcctgctggggcacgcacgagaactatatgatggcccgcgcggtgccattcgacttggtcacacgcctgatgaccctccacttcgtcacccgccagatctacgccggctccggccgcgtagggattggcgagaacagcgagatcccgggctaccagctcagccagcgcgccgactacatccacgccaaagtcggcctgcaaaccaccttcgaacgcccgatcatcaatacgcgcgacgaatcccactccaccgatgcataccgccgtctgcacgtcatcgtcggcgacgccaatcgcatggaggtgccgcaggcactgaaactcggcaccacgagcatgctgctgtggctgctcgaacatgcggacgaggccggattcgacctgaacgccttcctcgacgaactcgaactgtctgacccagtcgaggccatacacaccgtttcccgcgacctgacgctgggggcaatcttgccgctggccaacggcggcgaaaccaacgcatggcttatccagctcaaactgcgccaagccgtctaccaggttgccgcactggtcgaaggtaccgacaccgccggcgaacccgcctggccggacaaatccaccacatccattatggcgatgtggcagcaggcgctcatcgactgcgcctccatccgccatgccgccgacgatgacgaacgtctggccatgaccggcgaggccagccgcatcgaatggctgctcaaatggcagctgctcgaaaaactgcgccgcaaaatcaccacaacgtccgcacccggcgtggccaacggatggaatgatccgcgactgaaggtcatcgacctgaaatgggcggcgctcgaccccgcggacagcatcttcaccaaactcgaaccccgcaccgaacgggtggtgagcgccgccgacatcgcacgcgccaccaccgaaccgccggaagacacccgcgcctggctcagggcaaaactcgtggcgcaattcggcgatgaggtggccgccgccagctggtcccgactcactgttcgcgacccgcgcgccgcagacgagggcgaggcggtcgaattctacggcaatgccggccatatggccgctaccgaccatcacctgttctccctcgacatctccgatccgctcgccttcaccaaggcgcactgcgaaaccgaactcaattcggccgaacacgccatcgatctgctgaagtcgctggccatcaacgccgaacgatagacttggtagctatggaagaaacacgcgaagagaccccacaggacctgcgcaaccttgcgctcaaagtcgccggcctgctcgaagaagccggccagcatgccctccacgaccaactcaatccgcgtaacctcgcccagccgagcaccgagaacgcggaccgtggcccccgctacaagcttgaagtggacaacaagatcatgcgcttcatgagcgccagaatcgccgacatcgcccacttcgacggcttctggaccacccgccccgccgaaagccgccctggccagcgttactggtacatcggcaagatcgacggtgtgatcaactacgtacgtcgcatgagcgaatggacggtgaccgccgccctgttcgaattcggcccggacaacgagcccaagccgatcatcggcatcgtgcacgccccggccctcggcctgacctacctggccgccaggggagcgggtgccgtgcgcatccacaaaaccgcggtcggcgagaagcgcgacaaggtcgtgccgtcgatgacctcctcgctggatggttctgtgctgagctacggcatgtccttcatccccagcgaatcgcagcgtgcgctcgacgtggcctcctcgctcgccggacgcccggccgacatcaagcgcgtgggccccgtctcgctcgacctgtgcaaagtggccgacggcacctatgacgcctacttcgagccgatgctgcacgtgtgggatatcgcgggcatcgccgccggcaccgtagtggtctgggaggcacagggcacgctgagccgttgggacggcgaacgcatccactggcgtcacgataacgatgtagtggcctccaatggactcatcatccgcgaactgcagcattacctgcagcagtatccgtggctcgactccatcaaccagcgataattttttgactcctccggctcccctcgggtgaggggagccgtcggccgaaggctgactgaggggagtttgacagcccaaaaagaagacaacatgccacaacaattcgaacaacctcaagcacagcaggccgcgacccaggaagacgacgccctcgccaccacgcaggccgccgcccaaaccgagtccaccgaccaagccgacgtgttggacgacatcctcgacgacatcgaatccgccttggaaaccaacgccgaggaatacgtcaacagcttcgtgcaaaaaggcggcgagtgatgccccaactgcgtgacagcggcacccgctccctgcacgccacggaacccgtaccatccgccgagatggacgggttctgccgtattttcggcgtcgaaaccgaatacggcgtggcggtcaccggtgccgaacgccccgtggacgccggccaggtggcgatgaccatgttccagcccatcgtctcccgttcccgctccaccaacacgtatctggccaatggctcacgtctgtatctggacgtcggatcccaccccgaatacgccaccgccgaagcgcgcgacccgcgcgaggccctggcccaggacctcgccggcgaacacgtgatgcgcaacctagccctgaaggcccagcgcaagctgcgcgaatcctacggcgcacacgccacgatccatgtgttcaaaaacaacgtcgactccgccggccacgccttcggctgccacgaaaactacctggtccgccgcttcgtgccgttggagaccatcgaacaccagctgctgccgttcctcatcacccgccagctgtacaccggtgccggccgcatgaccccggacggcttccagatcacccagcgcgcggacttcctggacgaggccgtctcctcggccaccacccgctcccgcccgatggtcaacacgcgcgacgaaccgcacgccgaccccgactccttccgccggctgcatgtgatcatcggcgactcgaaccgttcgcaatggtccacatggatgaagcttgccgtcacgcaccttgtgctgtgcgcgatcgaagacgccttccgccatggcgttccgtccggattcgagcagtatgcctttgctgatccggctgccgccaatcgcacggtcagtcgattccttgacaatccgcgcgccgaactgacgctcgaatcaggcgaatccgtgtccgcactgggtctgcagcgccggtattatgcggcggtcaaggccttcatcgaaacccatggcgatgcgctggcaagttcgctgccggccaccacgatcgacacgattatgggggagtggagccgcgttctggacgcgctggagcgtggtgcatacgatgcgctcgccgaccgcgtggactgggccgccaagaagcgtctgttcgacgcgctcaaacgccgtcgcccggacgtcaccttcgcccagatggaacagcttgagctcgactaccacgacatcgccaacggtcgcctgtacggttcgctcgtagcccgcaaccagatgcgtgagctgctgacaggagacaacgtggaatacgccgtgcacaatccgccgaccgacacccgtgccgccctgcgtggccggttcgtggacgcggccctgaacgtcggagcccagttctccgccgactggacccacctgaccctgaccgcccccgaacgccgggaagccatactcctcgatcccttcgaggccgagcccaccctgggattcgagcagcttatggaagcgctgaactagtccggaataatacggttggacaacacgtcacagcaccacaacaaaaagaccccgaccatctcggtcggggtctttgtcgtcagtaatgctcgaagtaatcgctacgagcagaaggtcactcggtgacggccttcttcagcagggagccagcggagatacgaacgccgtaggaagccggaatgtcaatctgctcgccagtgcgcgggttgcggccggtgcgagcggcgcgcttgacgcgctcagcggagaacaggccggtgagcttcaggccttcgccggacttcatggcctcgacgaacacatcctggaaggcgttaacagcagcctcggcctgagccttggtcaggttggacttctgggcgatcttcgaaacgaggtcagacttgttgtatgccataaagcatccttcttgggtcaggggacaagcacttttgcttagtccatgttgtcatcaatgatactagcgcatgtttctgcgaaaacccgcgttttataagggttttcacatctatttccccgaagggggtatgaaaatagacgaatcagacaagattatgcttgtcaagccacttcatggccgccgcgcccagcggaatgcgcagccagtagaacaccacgcggtgcagcaaagtggcggaaagcgccacgccctgcggcactccgaccgccacgaacgcgaatgtcagcgccgcttccacaccgcccagaccgcctggagtgggcactgcggaacccaatgcataggccagcaggaagacgaacgtcgtttcgatcggattcgatgaatggccgaacgcttgcagggccgcccagaaagcgagcccagtggtcgcgttctggaacagcgcgcccaggcagctgactgtgagctgtcggggctgggaaagcacgtccagcagctggttgatatacgtcttggccagcggcataagacgacgggtcacccagtggcgcaacggtggaatcatcatcgcaatggacagcaccacgaccacaacgcccagcacgataaccaacgtgtttgtcgggattgcgccggagaacatgttgcggccggtgaacaggccgatgatgaccagcatggagaagtacacggcgtaatacaccacgagcgcggcgctcataattgcggtcgcctgggtgttgcgatagccggatttgcgcaggaactgcaggttgacgaacgaggggcccacgccggctggcatggatacggtggcgaagccgcctgccacctggctcatgaagacgcccgtgttatctcgtctgttgcgatccatgagagcgccgagcgaaatcgacgagccgatccagccgcaggcaccgaacgcgagcgtcaccaccgccatcaacgggttggcgttggtcagcgcggtgatgatttcctcgggcttcagctgggtgaagaccacgaccacagccacgatgaccagcagcatggtgatcatcgaacgccaggagaagcgggccagcgtcaccggctcggcggattcggcggtctcctcatcgattatggtgttgatgtggtctcgcagttccttgagcagctgcttgtcccacgtgcccaatgcgcgtgtgggggaggggaccgcgactttctgaatgaacggggccaacgtggtcaacgtcgtgtctccccaagcttcgcgggcggccgcgactgccggtttcacgccgatcagtgcggcgaacaacgcgagtagctgaaccttgtcaagtgcggtattggccgggccggaagcgctgtcgccattcagccagccggcgataaccgcagtgccatcttcgagccgggcgagcgtatcaggcgtgatgcgtcggtgcgtatatccacggcgattcgccacggacagatatcgcatatacgctacggcgtccgcctgggtaagcgtgttcaggttggcgggcaactcgatggtgtgcgcatccagcaccagaatcgcggactcgtccgtatcggcgatgccgtagggggcgggcgcgggcagtttgatattgtgcaggccgagcagcatggcaaagtgatgctgaacggcgtcgcgcacggaacgatcgcgtcgaatggacacgctggtaaaacgcacccaatcccagagttgcttcagatagccgacggtatgggtttgcgcgtcgatgacggaaacgataaaacgacggttattcgcggtcttcacatcgtagatgcgcgaaccttccgccaaatcgtcatccaacgtggcagacaatgagccatggctgattccgggctcctgatgccggatgagtgaggtggtttccaatccgatgcttgagagcactgcgacgagatctttgccccacacgcctttattctgcgtgccgaccacgaatcggataagcatgcccaccgtgcgaccggcggccatcgaaaccagcatgccggtaaccgaatgccacgaaagcaccaccatcaccgcggcgatggcatacaggatattccaactccatttgaccgtggagcgggtacggcgtggcccggcggcggtcaggaaggacgccatgccggcgtagatgtcgggcaacagcccggagccgtatgaggtggcggctgagaccagtgccattggcagggtgaaatcgttcagactgctgattgccgtcgatatgacccacacaatgccgtatccggcaaacatggccagcgcggacaccgcagcttgcagccattcgcgggccaagagcaactgagcgagcacgataactacgatgaccgtggtggccagctgcgtcagtacggtggaggggaaagcagccagccagttgatggcttgggcggcggtatgcgcgtcggattcgacgccgcgcgtcatgccgcccagatacacggcgaacaccatgaccacggcggccatcaatagcgacagaccggctcgggtcaggtcgccgaagtcgcgcgtgcggcgcggagcgatgtcgtcgatgtatggtccggaatcgttgctgtcgtcggttgccgggctgtccggtccgctgacagcaaaactggccgaccggccgtcaccagaggcgatcggccggtcggtagtggaggaggtcgccttgttcgggcgatcttccgtagtggactgatcctgttcagtagtcatgaaatggtcacctgacgcctgtccttgttcggttcagtttgcggttcggtttgtgactcagcgcagtagtgtggtggatgcgaaggattcgagggactcgagggactcgagagactcgcatcgcgcctatctcagcggccgaaagcgacgagctggctggccacaccggtgtaggtggcgggggtcagagccttcaagcgagcggcggtttccgggtcgaaggactgctggtcgatgaactgctcgacctgttccttgttgatggtgtggccgcgcataagctccttgaccttctcgtacggcttatccatgcccggcaggcccttgagctcgcaggcgcgcatggcggtctggatcggctcgccaagcacctcccagttctcatccagctcacgctcgatgacgtgggtgttcgggtggatggactcaaggccacccatgaggttggtcagggcgagcaaggagtagccgagcgcggaaccgatgttgcgctgggtggtcgaatcggtcagatcgcgctgccaacgggattccaccagcgtggcggagagggtgtcgagcagcgagcagctgatctcgaagttggcttcggcgttctcgaaacgaatcgggttgaccttgtgcggcatggtggaggaaccagtggcacccttgaccggcacctgggcgaacacgccgcgggagatgtacatccacacgtccacgcacaggttgtgcatgatgcggttggcgtgggagacggtggagtacagctcggcctgccagtcgtggctttcgatctgcgtggtcagcgggttccaggtcaggcccatgcggttcgtgacgaactcgcgggagacagcgatccagtcgacatccgggcatgcggccaagtgggcaccgaacgtgccggtcgcgccgttgatcttgcccaggtactcctggttttcgatgtgcttgagctgacggttcagacggtagacgtagacggcgagctccttgccgagtgtggtcggcgtggccggctggccgtgggtgagagagagcagcggcatatccttgaattcctcggccttgccggcgaggtggtcgatgatgcgcttgaactccggggtccacacgttttccatcgcgttcttgacgcaacgggcgatggagaggttgttgatgtcttcggacgtgcaggcgaagtgcacgagggtcttcagctcgtcgttgatgttggtcagctcggccggagccttgtcgatctgatcatcgatgtagtactccacggccttcacatcgtggtgggtgatggcctcatgagcggcgtgctgcttgatgccttcggcgccgaagtcctcgggaatggcgcgcaggaaggcctgctcttcggcagtgaacggcttgacgccgtcaacgatcggctggttgccgttgccctcaaagccgttggccagaagaatcatccattcgacttcgacacgcatgcgttcgcggttcagggcaggttcgctcatgtattcgacgagcggggcggtggccttgtgataacggccgtcgagtggggtcaatgcgattgcgggggaaatatcggtaagcttcataacctccaagggtacttccagccgtgaaccgagcggctatactgtggtgcggcgttcccgcccgagccgcacaggtcaaggaacgcccgtggttcgattactgtgtgcggcctttaaggctaggagatcaccgtgcctgcaaccaccattcatactcttccgaaacgtccgattgccgtatcgtcactgaaatggcagccgttggatatcgcggtcggtgccacgctgggtgcggcctgcggcgtgatcttctggggattcaacttcgcgtacatgccgatctcttcggtattcggcgcgattctgcccggtttcgccagcatcgtgcacgccgtctggtacttctccggtacgctggcggtgctgattctgcgcaaacccggagcggcgctgtacgtgaaccttatcggcacgctggtcgaaacggtgattggtagccagttcgatttgggcttcgtgattatctcggcgctgttgcaaggtgttttcgctgagattccgttcgccttgacccgttaccgcatgttcaatctgccgatttccattgcatccggtgcgttggtcgccttggaatacggcacatatctgatgctgtttcgctacgtgggtgtgtcattcgtcagcccgcgtggcattgtgcacatgatttccgaggtcaccggcggcgtgcttatcagcggcgtgatggcctggtgtctgatgctggccatcgccaaaaccggtgtgctcgaccgcctcgcatccggccgcgcactcatcgagcgacgcgcctgacactctttgcgcgccactttcccgggaatgttgcgctgatagagggggtttcgggcatgctagcgcaacaatcccgggaaagtggcgctagccgcgtctctgcggtgattgcattgtggggtagccgattgatgctaagcattgacaagttgatgtgcccgttgccgtgagaccccgagtatatcgcctatttgctgtagggcgagacccatgccatgtagttcttgtgctgcggcgcgagtttcccgcgctgcgttcaatctgcattccgcttcttccttgcgcagtcgccgagcttcatcaagatgctcctgcacggattgcggcagctttgtctctacggtgagtgcgaaatcagcatcttgtgtcatgacggtgataaggtcgcgtgccatactttcaatctctgctgttgttcttgcctgcgtgaaaccgataccgggaatctcaagaatccagtatttttcgccaggacgaacgatgacctgatatgttttcactgctgataccagcctttcccgagtttggcttctgcttctttgcaaataatgtccgcgaggttgttgtcgatttcgttatgacgtgggatggggaatcataagtccatcgagttggaatatctcatgactccctccttgcctgatactttcaaacgtgacattcttgcgttctgccgcttgcttcatcagtttgatgagccatctcctactcgtcattatattgttaactcctttcttgacaactctgtcaagtgtggtatttacttttaaccgccgaacgtgctgaactcggtggttcgctcgctaggggcaatggtcgcggactgggtcatgcggccttggtagtagcgggtttccttgagctctccgttgataacttcctggaaatgggcttcgtggcgttgcacggcgggggagccgaggtcggtggcgttctgataggcggcctgatggtatttgatccagtgcgacaactccctgccgttggtcgaaccagccacgggtgcggcgtcatatggggtcagaccggtgatgggcgttgcgccgggagtgcatgagccgtccgaatgcactgtggatggtgttgccgcgggcgcgggcgatacatgcccttgtacggtgagccagttatcggtgaccgggttggcggcaccatccagtgcggcgaccagttcatcttcgatttccacgctggtgacccacgtgcgttgcggaatcggatgattggccaccggcgatccggctgtcaccacatgctcgatggtatattcctccgcccaatccgaggcaagcgtggcggcaacgataccaccctgggaatggccgatcagcgccacgggctcatccttgccgatgcctgcctgacgcatcgcctcggcaaccatgcgagcgctgtccgctttcctgcggcgctcctgatcggcgctcatcagttccacgttctgcgcccagccaaatggtgagtcaggctgtccatcggtacccgggatggtgaccagccaggagttggttccatcagatcgttcatagcgttgaatggcgatggtcccatattcgagtccgctgttcagctcgattttgccgagccgctcttcggcgagcctgcgcagattctccattgactcggccaccgatccgcttgcgcggacaacgtcggcattcgcctgcacctcgcgcacgtccagatgattgccttggacgacgtctttcgccgggccggagaaattggcgattttccccgcagccttgttgacctcatcggtgtgcgcaatgctcttgccgataggtacgccgccaatgattccgcccgcgccgctaagcactccttcctggaacggataggtgaacgtggacatccatgccgggttcggtttgccgtcaatagtccagccggccagaaagccgcccgccgccacagcggcaacacccgccgcggcatatcccggtttggcctgtgtgccggcctgcaataattcggtaaacatgcgccgagccgtcatctccgcctgagaatacagagagtgtgcgcgaatcagcagatcggccgcgccacgcagatcatcgctcaaccgctgacatgccgttgcatggtcataacaccgattgcccagcgcggcatatggtgcagtgacatggccgggaacaacggcgctcggatcgcccgactgcaaggtgacgcacatcggcgcactatgccgatgtgactgcaactgtaatgcggccgattcccaagccgtggctatggccgcaaatcctgccgcctcgtcatcgagagccttggctatggcggcatattcttcaagagtggctggcgcatatcccactccgccgtaaacggacgattccacttgccagtaatcgtgctcgctcatgacgacccccaagccaatcggtgggtggtctccatgtcttgcgcgagactggccgaatactgtgcggtgcgactgagccgcgatcggaatagatcggcggctttaccggtccacacgatgttgctggagcggttcacggccaccgccgtctggtccgattgcgccagtgtggccgcacgctggacggacacgaggtcgcgactacgctgtaccgccgcatggcaagggcaagtgccgtaatcgaacggcgtcaccgtattgccggcaaagccgccggtgggatcgatgggtgctgggttgctggtgtaggtattcatatatccagctaaaaggacaagactcatgcttgtccagccggaacgaccaatgtggttctagcttgccgattttgggtgaagttatccccaagtgttgtgcatagtcgtaacgattatccacaaatagcctgtttggacataccttggatcagccatggcctatcgaaaattggataaatgccaaagccgacagccgaaaccgggaaacagccgcgataaagccatgacccgtgagggtgtgagaaaaaagaacaactgtgaacgactacttaccacggcttggtagccccggtacccttgttctgcgtcgctttctgctcggattgggtggtgttcgactgggtatcggtggattgctgattggccttcatcagctcctcgacctgcttcttctgttcgtcggtcaacgcgccgccctttttggcattggatgaagaattctcggattgctgtgccgactgggcttgcccggaatcggaacctctgttctgcgcctcggcctgtttcaaggtgatctttgtcagctcggaagaaatcgaagcattggtgtcgatggcgtccttgacttgcggcaacagaagcgtgcgcattcgcccggcctcggcgaattgcgcatcggtctgctgctgttgcgccttgagcgtggtgatatccgcggactcgtcctgagccgctttgatattggcgttcaatgatgcggtggcctgattgaacgtaatcgaagcggacaggtttactgccgccacgccggcaaccagcaacagcaatacggcgccacaagccaggacgatacgtgcccaaagcgggcacttcgcccgcatccgagtattcgccgagccatcgttctcgtggatttcgttactgtttctcacagcagtctccttgaggttgcgatccatgcaccgacttccatggcaagcaatatcgccaacgcaatggccagcggccataccaccggcgtggtgcgtgtgcgctccttgaccgtggtggtcatgcgccactgcttcgatgacttggccgaaaccgaatccgccaaagtctgtgaagcgttcacggccacatacgtgccactgatctcgtcggcaatgtctttaaggttcttctcatccatcttggagatgccgggttcgccggtatccgggtcgaccacccagtggtccgtggtgttggaatcgccggcactgacgccatcggcgatgacgggaatcttgccgccctcggtcgagccgacgcccacggtaaacccatcattgagatactggcgcagtgacgagaacgtacgacgcgtcacattcgaggtctgttcgccgtcagtgatgaggtacagcacaatcgcatcatccgggtgcgcttcacgaatcgacttcgcggtcagcagcaattgatcgatcggagcatccagactggagcccgccgacacggatgtggcttccaccgccaacgtgttggcccaattatcgatggccggcgcatccggggtcagcggcacatcaagcgttcccgaagcaccgaaccgtaacgccgcgaaactggcgtccggataagcggcggtcacatcatgcacggcctgacgtgcggcaccgatgcgggtaatggtcttctcggacccgtatgtggcatcggccaccgccatcgacccggtggtatccaccgccacgatgacgtcggtggcattgatggcctgtgaggtggtagacgataccacgctgggagtcagtaccatcaccgcgacgatgagcagcattagcgtacgtcgtatgcaagcccacgcggtctcgtcactggaagcacggcgacgaacaaacaatacgatttcgagaatggccagtacggcgagcccggccgccagcagtccgccggcgacccagcccaaggcgggggagaaggtgaatccgttcatcgcctcaacctccatgcacatacgatccagataatgagtatcacggccagagcaagcgtccacagaccgggagcgtccaccattgaggatttcgccttgttctccacatccgtatctctacgtgactgaatatcccgtaccagctcatctatcgacgtgccattcgattgggtgaggaagatgcctccatgcgactcgatcgcggacttcatatccgttgtggtttggtccgattcactggctttcggcccggaatacaggccgtccacggtgattttggtctgctgggtcaagtccaacgcttcggtcagcgaataggtgggcttgcccgacacgacgttgtcggtggccagcacgatggatgccgcacgctgacggtcggcatccgcatgattggcttcgccataagcgaaaccggggagcatcgccgcgcaagacaccacgccgtcgccaatcaaggaggtggcgtccttgcggttctgcgtgccttcgagccaattggcgatgtcctgatattcggcatcggacatcttatcgatgtcatcctgcgactcgacgccttttagcgccttgctggcggaggtcaactgtttggtgaccagttcgtagtcgtcggtcagcgggaacaccgtgcgtgaggtcgagttgaagatactcaaaccgatacgttccccctcgaaatgcttgaccagttccaaataggtatcgatgacctcgcgatcataggggagcgtggaccccgacacatccagacacaggacgatatctcggctggaagcgcgttcgtcaccggcgtccacttggctggggcgagccaccagcacaatggccagcgccagcgcaagcaccagcacgctgatggcgagacggcccaaagcgcgccattgacggaacaggcgggaagcgtgctcggtattgagatcgtcatccatcgagaatacaggggtgtcgtcggcggcgttacggcgggcgaacacgacaatcagcacgataatcgccagcgtcgccaagacgccggccagagcggcccaaggccaatgccatgccagcatcatgaacgccacctttccaccagattcgccacccactcggcggcctgctgcacgctggtcgtctgggcgattcggttgcgggcatcatcggcaaattccggtggatacaacgcgccaatggtctgcttcaatgcgtccaatccttggcgattcgcgggcgtgcgattcaggtacgccaaatcggtcagcgtactggaactaagctccttgcctgatgcggcaccggcgaaatcacgggcgatgacggccaattcgacgaaagcctcatgccggggcagtgctccggattcatgacgggccaccacatcgtcgatgcgggaacgccactcggccttggagctggcattgctatgagcgccacgcgcacggtcgctgttccgaggtttgcgtgcggggcgagacagcatgatgatcaacgcgatcagacctaccgccagcaacaggcatgcgacgatggccaccaccaggggagtggtcaaggccaacgactccacgggcctgagatcgccgggatcagtggcgagcgggatgatggggaacatgctgtgcatcatagatcaccagccaaagtcagtccgaccagttcgggtgcagtacccagtctattgcgtgtggtgcgggccaatgcccgggacaccagggcgacgaaacgatcgaacatggattcgctggatgcggatcgaatgatatgggaaccggcacgggtgagctcctgttccaaagccgcggccatatacgcgcgatgagtatcgatctcggccgctgccttggcgttgcgcaggaatgccggcacacgccgtgcactcaagccgtcggtgggagcgtggcgggatgagacggccttgaacggattcatcgtcgccacatcgatcagcaccatcggatgggtgcgggtaatacgacggatcgtggtgatatgccgctcctccatcgcatgctcatcggtggccaatacgatcaatgcctcgcgatccttgatacggcgcgcatattccagcagcgcgtcgatattacggtgatgattccaatcacggtcaagcgccttgtccagcgtgcgttcgaactgcgcgaacccaccgttgaacggcacgcgggtgatactggactcatcgccgaacaccagcgaaatatcgtccgaccggcgcaacgacagtgcggcgaacatacgcagcgcattggcggcaacctgccatgcgcgttctccggaagggcatacgccagtcatctccaggcccacgtccatcagcaaccagacccgtgacgtcgacaggcgctcgcgctcgaccaccatggggcggccttggcgggcgctggtcttccaatcgataagacgggattcgtcgcctggctcataggcatgcacatccatcgcatcgccgctgccgccgcgacgcccggatgcgtgttcgccctccagcgcgcccaaagccttccttacggtaggcaggctcagctgagtgccaagggcctcgatcttcttgcgaacggaatcggaactcacggaacaggaaccgtttcgacgatcttgtcgacgatctgatcgctgaccacgccatcggccagtgcctcgaacgtcagcataatacggtggcgcagcacctcatgagcgaacgccttgaggtcctcgggtaccacatagtcgcgcccggacagcaacgccttcgcctggccgatacgggtcaaggcgatggtggcgcgcggcgaggcgcccaaacgcaccaaggacgacagtcccttgatggggcgggagccggcacctcgtgacgtggcggtgatatcgaccgcataacgcatgatcgcgtcggaaacatgcacgcggcgtgccgccttgcgcaaaaaatcaacgtcggacacggaaatgcgtccgccggtgatggtgtcgggaccgatcatatcggagccgcggcgggtgagcatggccagcatccgagcctcttcgtcgggcgaaggataggtcatgacggccttcatcatgaaacgatccatctgggcttcgggcaggttgaacgtgccctcctcctcgatcggattctcggtggcgatcaccatgaacggcttgggcaaggcgatacgctgcccgccgatggtcgtggcaccctcggccatggcctcaagcatggcggactgggttttggcattcgaacggttgatctcgtccagcagtacgaaattggcgtgaatcggaccgatctgcgtggtgaacttctgcgacgcaaaatcgaagacctgcgtgcccaccagatcagatggcatgagatcaggagtgcactgcacgcgcttgaacgagccggatacgcaggtggcgagcgtctgggcggccgtggtcttggccaagcccggcacggattcgataagaatatgcccgccggccaccaaggtcacgataagcgattcgcgtagattatcctgacccaccagtgtctgggcgaacctcgcccgaatggcgtcggccaggatacgtgcgcgtttggcgtcatcggcacccagcggagccgacacgccgggcgcgggaacggcgaccggtcgtgcggcggtggtcggcgaaggtatgttcggttgcgtggggaacaaagtcatgccccccactgtaactactcacaatgactgttggcctgcctaaagagtccaatccaccgggtcggcacccatggtgactagggcttgattggctctggagaatggtttggagccgaagaatccgcgggaagcggacagcggactcggatgaggcgatttgataatgaaggcattggtcagcaatggctcgaggctttgcgcattacgcccccagagaatcgccaccagcggctggggcttgccgtcggcgtccgtgcgcgcgttcaacgcacgaatcgcggcctcggtgacttcctcccagcctttgccctgatgcgaatttggccgcccgacgccgacagtcagacatctgttgagcaacatcaccccacgttccgtccacggtgtcagatcgccgttggtgggcatgggcaccccaaggtcgtcaaccaattccttataaatattgaccaggcttttcggcagcgggtgaacatttggcgccacgcagaagctcaaacccaccgggtgacccggggtcgggtaggggtcctggccgacaatcagcaccttgatggaatcgaacgggatggtgaacgcgcgcagaatattgtggcttgccggcagccacgggcgcccggcggcgttttccgcacgaagaaaatcgcccatatggtggatggtgggctccacgtcggccaaggcatgggcccaccctggctctaccagttcgctcaatggtttgatcatgactcaccactgtagtcaaacgtgcatatccggtgcatggggcgtggtgtggtggactgatgagttgtttgccgattacactcatgggtagttttgataggaagaaagggcgattatggcacgcgacacgatgacctacgaatcctatgaaccggattccttcgacaatcctccgaagggaccggtgggagttcaccgtggcgctcgttcggtaatggcccgcctctgcccgttcatcgtcgttattctggtggccgcgctgtgcggtgtcggggcctgggcatggatttccggagaatacaagaatgtagtgggaggatcgtcccagacggcgaccacgtccaagtccgattcgtccagcaaggctgagaccaagaacagcaccaaggatgattcctcgtccacttcgaccgattcgtccaaggactcgacttcggattcggcaaagtccgataccgacagtgacacgacatcctcgaatgagaatcaaaactccgatcagcagtctcagcagtccgaagccatcgcgactgtgaataaggccacgcaggtgcgtgtggtcaacgccacaggaatccaaggatatgcgggtcagcaggccgatgtgctgcagaccgccggttacaccagtgtcgaggcgaccaatccgagcggcacattgccggcttcttccgtggtgtggtatcagaatgagaccgataaggccaccgctgaggatgtggcgaccacgcttggcatttcggctgtggagcaggtgcaaggactcgccgttcccattacggtggtgttgctcaactagcgttgttgatgcgcccctgatatcggcgagaaatacatcgaaaactgtgagcgttctcacgcctatggaataattcgtaccgaaaatgtgccactgcggttgagattgttccctcgtcactgtacaatcatcatctagtcgcgaggtagggggagcgcgatgcggttctttctacgttccctataggttttgtgtcgcgacgcccaagggaacaaaggaaagaccagatatggcacaaggcaccgtgaagttcttccttgccaagaaggggttcgggtttatccagccggacgacggcggcgaggacgttttcgtgcactacgcggaaatcaaggacgacggcagcaccaataagttcaagatgctgtacgaaggcgatcgcgtggagtatacgcccgcttcgtccggcaaaggcacgcaggcaaaggatgttgtcaagctgtcttcgggtgaagcccgctccgagtgagcaacacgcacgcaaggatgtgctttgaaggccctgaccgtttcgacggttggggctttttcatgcccaaagcgcaatcgccgccgatggtgttggcactcggcgggcgcgagtgctaatgtctgggttagcactcggaggtcgagagtgataatcggcagctgacggctggtcgtcacgactcgacgcttgcgagtgataaccggtatacctagccatttggaggaatacgcaaccatggcaaagatcatctcttatgatgaggaagcccgtcagggcatgctggagggccttgacaagctcgccaacaccgtcaaggtcactctgggcccgaagggccgcaacgtcgtgctcgacaagacctacggcgctccgaccatcaccaacgatggcgtgtccatcgccaaggaaatcgaccttgaagacccgtacgagcgcatcggcgccgagctggtcaaggaagtcgccaagaagaccgacgacgtcgccggtgacggcaccaccactgcaaccgtgctcgctcagtccctggttcacgagggtctgaagaacgtggtcgccggctccaacccgatcgccctgcgtcgcggcatcgagaaggccaccgaggtcatcgtcaaggaactcgtcgctgccgccaaggacgtcgagaccaaggaccagatcgctgctaccgccaccatctccgccgctgaccctgaggtcggcgagaagatcgctgaggctctggacaaggtcggccaggacggcgttgtgaccgttgaagacaacaaccgcttcggcctggacctcgacttcaccgagggcatgcgtttcgacaagggctacatcgccccgtacttcgtcaccaacgctgacgaccagaccgcagtgctcgaagacccgtacattttgctgacctccggcaaggtctcctcccagcaggacatcgtgcacgtggccgagctggtcatgaagaccggcaagccgctgctgatcatcgctgaggacgtcgacggcgaagcactgccgaccttgatcctgaacaacatccgtggcaccttcaagtcctgcgccgtcaaggccccgggctttggcgaccgtcgcaaggccatgctgcaggatatggccatcctgaccggtgctcaggttgtctccgacgaactgggcctgaagctcgagtccgtcgacacctccgtgctcggccacgccaagaaggtcatcgtctccaaggacgagaccaccatcgttcagggcgctggctccaaggaagacatcgacgctcgcgtggcccagatccgcgctgagatcgagaacaccgactctgattacgaccgtgagaagctgcaggagcgtctggccaagctggctggcggcgtggctgtcatcaaggtcggcgctgccaccgaggtcgaggccaaggagcgcaagcaccgcatcgaagatgccgtgcgtaacgccaaggccgccatcgaggaaggcctgctgcctggcggtggcgtggccctcgttcaggctgctgccaaggccgagaagaccgaggccgtcacctccctgaccggcgaagaggctaccggtgccgccatcgtgttccgcgccatcgaggccccgatcaagcagatcgccgagaacgccggcgtgtccggtgacgtggtcatcaacaccgtccgctccctgcctgatggcgaaggcttcaacgccgccaccgacacctacgaagacctgctggccgccggtgtgaccgacccggtcaaggtgacccgctccgctctgcagaacgccgcctccatcgctggtctgttcctgaccaccgaggccgtcgttgccaacaagccggagccgaagtctgctgccccggccgccggtgccgacatgggctactgatccgcaaacgatcgctagctgattgagctgaaaggggactccttcgggagtccccttttttgtattccagccccctcagggaggagagccaagaaactagctggcaaacaggcgcgaagcttggatttcggcgtcagcgtacacggtggaggcttgcgtcagcgagcgttggatggactcgagtgaggcctccatctgctgttgggccgcacgccactgttcggctaccgcggtgaactgggtggccgccgaacctcgccatgcgtcctgcaaggcattgagattggtgtacatgccgcccacggcctgcctgatttgcgagatcgaagtggccactgcggccgaggatgattggattcgctcggaatctacctgatattggggcatcgttgctccttttctagagggttaatggtatgtatggcggccgattgccaataccggccgttaaggtggaggatatgtcaacaacgaatcgggaagacggaaaaacaactattgtggtcctagcttcggagccgtcctattcggccttcgggaatatggtccgaaaatggcttgtttgcgccatttgcgcccttgctgcagtagcgatgaacgcaatgtggataaccgcaaatgcctatggggataactcgagcgacagctctgacagctccagcagcagcaccgacagcggcgtgaccatcaccgagaacatcacggatacggaaaatctcctgggctcccatgcggccgaagtcacggatgccatcgccaaaaccgagaaggaaaccggtgtacacgtgcatctgctgtatctttccagtttcaatagtcaacagaaaccgggagactgggcggcaaccgtgatggagtccatgaatcccaagccgaacacagtgatgcttgccgtggcctcgaatgacggcaacctggtggtcgtcgtgtccaagaactccgataagtggcttctcgataacaaaaccgtcgataagctatccgaagccgcacagcagccgttactggaaaacccgccgagctggtctggcgcggcaacggcaatgatggatcaaatcgtgaaatccaaaaaagcctccacctcatcgtccacggtgatcgtaggcataatcatcatgggtgtggtattggtggcgctggtcatcatcatcgtggtcatggtggtgattcatcggcgcaaggagatcaagaaggattccaaggccgaactccaagatgacattcaggaaacgcccagaagagcgcgacactctaggaagcatgagtaagcctattgaagcatcgattgttgttgtcgacgacgagccgtccatccgagaactgctggtcgcttccctgcacttcgccggattcgaggtaaacaccgccgcttccggttctgaagccattgaggttatcgaaaaagtgcagcctgacctcatcgtgttggacgtcatgctgcctgacatcgatggattcaccgtcacccgtcgcatccgccaggaaggcattaacgcccctgtgctgtttctcaccgctcgtgacgacacccaagacaagatcatgggcctgaccgtcggcggtgacgattacgtcaccaagccgttcagcctcgaggaagtcgtggctcgcatccgcgccattctgcgccgtacccgcgaacaggtggaagacgatccgattattcgcgtcgccgacttggaaatcaacgaggactcccacgacgtgacccgtgcagggcagccggttgacctgagccctaccgaatacaagctgctgcgctacctgatggacaacgagggccgagtactgtccaaggcacagattctcgaccatgtctggcaatacgactggggcggcgacgcagccatcgtcgaatcgtacatctcctacctgcgcaagaaagtcgacggcatcgaggtcgacgacggcgaaggcggcaagcgcaaggtgactccgctgatcgaaaccaagcgcggcatcggatacatgattcgcgaaccgaagaactaatcgcctccatccataacgtatcgcaatctcatgagtatccccgataagcagtcaggcggcgtaccgccgagcagcacgccgaacgccgccccgaacacgaatcccatgcctgcaatgtcgccgttcgccgcccatttccaagagcagcgcgagcgtaagaaaaacatgctgatgcggcatatcgaccgtatctcgttgagcagcaagctggtggcctgcaccatcgccgtgctgctcatcggcgtgtcggtgatttccttctccatccgcgcgttggtgaacaactacatgctgcagaaaaccgacacccagttaagctcgcaaagccaactggtggtcaacaatatcgatctgctgtcaaaaaatgactcatcggggccgaactcgtactttctgcagattcaatacaccgacggaaccaaagacaaagaaggcaatcctctggtcgtgaccccgctgatgccgcagatgcaggacggtatagtatcggtgccgattctgcctacctatggcgataccaatggcatcacgctcggtcaggcattcactacgcaggcggtggccaagcagatcatcacggtgcagtccgacagtgcggacagccagaacgatccggccaacggaaactccaattcctctgacaccatcaccaaggtactggccaaccccactgccaatgccaaccatgccgccatcgtcacggcgagggcaccatggcgtattctgccggtgaccttccagcaaaacggcaaggaccgtgccgtggtgtacatcggcttgtcgctggccgaccaaatcgacaccgtcaacacactcacccgatactgcattgtggtcggcatcgccgtggtgctgctcggcggctccctgtccacgctgatcatccagcacacgatgacgccgctgaagcgcatcgagaagaccgccgcgaaaattgcagccggcgacctgagccaacgtattccttccgcgccggaaaacaccgaggtcggctctctggccgcctcgctgaattccatgctcacccgaatagaatccagtttccatgagcaggaggagaccaccgacaagatgaaacggttcgtctccgacgccagccatgagctgcgcaccccgttggccgccatccatggctatgcggagctgtataagatgcagcgcgatatgcctggtgccttggagcgtgcggacgagtccatcgaacatatcgaacggtccagccagcgcatgactgttcttgttgaggatctgctgtctttggcccgtctcgatgaggggcgcggcatcgatatgaccggcacggtgaaactctcgtcgctggtcaccgacgccgtcgacgatttgcatgcgctcgacccggaccgtgccgttcgccgcatgcagattttcctcgaaccggcgcgcgatttgaaccatcccgccgaattcagccttgccgaaggcgattggcctgaggtcgtactgcccggtgatgcctctcgactgcgccaggtggtgaccaacatcgtgggcaacatccaccgctacacgcctgccgattcgcccgctgaagccgcgctcggtgtgatgccggccgccatcgatccaagacagctcgcccgcatgcccgccagcgacgcgtcaatgcggcggttcatcgacgctgccgaagtaggtgcctcgatgcagaccggctatcgatacgccgtattgcgtttcgtggaccatggccccggcgtgccgtctgaatcgcgctcgaagattttcgaacgcttctacaccgcggacccatcccgtgcccgcgaaaagggcggtactggtttgggcatggccatcgcgcaatccgtggtcaaagcacatcacggctttatctgcgccaccggcaccgatgggggaggcctgaccttcaccgtggtgctgccgattgagcagatcgccgctcctgagcccaagcagtccaccggcaaaaccaaggacgccaaacagaagacttcttggttcagctctgagcgtaagactcaggcgactcagcccaaagcgtgaggtcaagccctgtgaggtaaactgtaccttcggtttactatttccattgaggattaaggaaggttcgcaatgcccaccggtcgagttcgttggtttgacgcagccaagggttatggcttcatcaccagtgaggaaggcaaggacgtgttcctgccggctcaggccctacccactggcgccaccacgttgcgcaagggggccaaggtggagtattccgtggtggacggccgtcgtgggccgcaggccatggatgttcgcctgatcgcctccgctcccagcttggtcaaggccacccgcccgaaggcggatgacatggccgccatctgcgaggacctcatcaagatgcttgatgcggccggcaatacgttgcgccgtcaccgttacccatctgctgccgacagcaaaaagctggccacgttgctgcgtgcggtggcggatcaattcgatgtacaggactgatctgatctatgactgataccaccgaaaccatcgtgacaccggaccctcacgccatcgcgcgcgccgtgctgctcgaagtggccgacgagagcgatcaggtgggggatttcgttacctcatatgatcttgaggatcacgtcactgacttccgcttcgccgcgaatatccgtggctacgaaggatggcaatggtcggtgacgctgtatcacgacgaggagatcgactcctggaccgtcaacgaatcctccttgatccccactgagggcgcgttgatgccgcccaagtggattccttggaaggatcgccttgagcccacggatctggctcccaccgattcgatcggtaccgatccggatgacgagcgcatcgaggaaggcgaagtcgaggaatcctcgctgcaggatgtcaacgacgccgtcgagaccttccgactgacccgccgtcacgtgctgacctcgctgggccgcgcgcaggctgccaagcgctggtatgaaggtccgcgaggccccaaagcgttgagcaccaaaaccgccgaaggcaacctgtgctccacctgtggtttcttcgtgccgctcgcgggcgaactcgaccgtatgttcggcgtgtgcgccaacaagtggagtccggatgacggccgcgtggtttccttggaccacggctgcggtgagcattccgaaattgaacctcccgagccaagccagctgtgggtgcagtccaagcctgctttcgacgatctgcatatcgacgtggtggccaaccgtccgcgcaagcaggagccggctgcccaggacgaggccgaaggcgaaaccgacaagacaggcgagcctgccggtgatgatatcgaagcacagaagactgttgacgggaacgccgtcgatactgagcccgctgaggaggcggcaggcgacgggacctcgcaatcccagtctgccggtgatgagtccgttgcacagaacgcatccgattccgttgtggatgttgatgcagctgattccagcgacgagtccaagtctgatgctgacgacgaggccaccgaagaggatatcctcaacaacaccgttgccgatgatgatgaggatgatgagatggacgacgaagaggataacgttcgtcatacagacgatgtgactcctgaactcgaaaccgtcatcgatctcatcgagcagctgcgccagaacagggcggacgaagaataaactccgaattccgcgaaaagtagatggtggtggggttgcaggaataaagaactcctccctgcaagcccatcaccgaggcgtgcgttagcactccatgccgatttcggtgaatcagtgcaccacggtcaccgtgcactcggcgaagttcacgatctggcgggacaccgatcccaggaagtgtgcgtccagcccggacaggccacgcgagccgaccaccagatggctggcgtaccgcgaggccgcgatcagacctttggatgcgggaatatggaaggcgtttgtgctgaccttgacgccatcgggaatccgggccttggccatcagctcagagagaatctcctcggcgcggcgctgaccgaccttcaccggtgccacggcgttctcatagcccggaataacgcccaaatccttgagctgccagcagaacatcacatgcagcggcgcgtcgtgcagtcgtgcttcttccagtgcgaaatcgaacgcacggcgggaagtctcggaaccatccacaccaaccaccaccgggcggcgagcctcctcaaccaccggctgaggctgcgtgtagtgaacgggcttgtctcccggagtcagggcgttggcaatggcctcggtcacggtctcatcctcgctgccggcgatgcgcaccacggtcaccggcacttcggcggcctcggccagcgaagcggacagggaccccatgaaccagcgggccatacggctcagcgagcggcggccgaccacgatctgctgcgaatcatggccgatctgcagcagggccgaagtaccggaggccttcaccgaggtgagcttcagattcgccggatcgaagtcgatgcctgcagcggccttgtcgacccacacacgcagctcgttggcaatatcgtggcggaccttggcccaggcctcgtcgctgtccggttcggaccccatatcccaggaatgcgtccagccaaacacggcgttgacgctctgaccggttaacgaggcctcctcaagcgcccacttcagcgcggcaaaggattcatcggaaccatccacaccgacaacgatgtcgggcttggttgcagcttcactcatttcgagcctccttgtaatcgactacgggtgaatctagaaccagcatatcgttttcttctcctctcacggcgcaattcgtggaatctcatgaataaacgtcatcgtgaatcggtagagtaggacggaatgtcaattgaggaaggacaagcatgttcgaacggtttaccgaccgtgcacggcgcgtgatcgtgttggcgcaggaagaggcgagggcccttcagcacaactacatcggcaccgaacacctgctgctcggcctgatccgtgaaggtgagggtgtagccgccaaggcactcgcctcgaagggcgtggagctggatgccacccgcaagcaggttgaagaaatgatcggcaagggcaacgcggctccgaacgggcacatcccctttactccgcacgccaagcaggtgttggagttttcgctgcgtgaagccctgcagctgggccacagctacatcggcaccgagcacatcctgctcggcctgattcgcgaaggcgaaggcgtgggcacccaggtgctcatcaagatggacgtcgatctgggcgagttgcgtagcgcgaccatcgatatgattcgcggcaactccggcaccggcaccggtgacggcaagggtgatttggccaacgcaggtggcgtgacggacaagcagaacaagtccggttccgccatcctcgatcagttcggccgcaacctgaccgccgaagccgctgaaggcaagctggacccggtcatcggccgtaccaacgagattgagcgtgttatggtcgtgctctcccgccgcaccaagaacaacccggtgctgatcggcgagcccggcgtgggcaagaccgctgtggtcgaaggcttggcccagaagatccaagccggcgacgtgccggaaaccctgaagggcaagcaggtctactcgctggacctcggttccatggtggccggctcccgctaccgtggtgatttcgaggagcgcctgaagaaggtgctgaaggaaatcaagactcgtggcgacatcgtgctgttcatcgacgagatccacaccatcgtgggcgccggctccgccgacggcgcgctgggtgcctctgacatgttgaagccgatgctggctcgtggcgagctccagaccatcggtgccaccaccaccgacgagtaccgcaagtacatcgagaaggacgcggctctggaacgccgtttccagccgattcaggtgcacgagccgaccatcgccgagaccatcgagatcctgaagggcctgcgttcccgttacgagaaccaccaccacgtgaccatcaccgatggcgcgctgcagtctgccgcagagctgtccagccggtacatccaggaccgtaacctgcctgacaaggccatcgacctgatcgatgaggccggtgcacgcctgcgcatcaagcgcctgaccgccccgcctgagctcaaggaactcgacgagaagatcgccaagatcgccgccgacaaggacgaggccatcaagggccaggacttcgagaaggccgccgaactgcgcgacaagcaggagaagctggaagccgatcgcaagcagaaggaagactcctggcgcgaaggcgagtccgacgtcaagatggtcgtggacgaggacgtgatcgccgaggtcatcagctccaccaccggtatcccggtgttcaagctgactcaggccgagtccaagaaactgctcaacatggaagccgaactgcacaagcgcatcatcggccaggacgaggcggtttccgccctgtcccgctctatccgccgtactcgcgtgggtctgaaggacccgaagcgcccgtccggttcgttcatcttcgccggccccaccggcgtcggcaagaccgagctggccaagacgctcgccgaattcctgttcgacgatgaggacgcgctgattcgcgtggatatgtccgagttctccgagaagtacgcggcttcgcgactcttcggtgcgcctccgggatacgtcggctacgaggaaggcggcgagctcaccgaaaaggtgcgccgcaagccgttctccgtggtgctgttcgacgagatcgaaaaggctcatccggacatcttcaacacgttgctgcaggtgctcgatgacggccacctgaccgacggtcagggccgcaaggtggactttaagaacaccatcatcatcctgaccaccaacctcggtacgcgagacatcgccaaggccgccaacacgggcttcaacctaggtgccaacaacgagtccagctaccagcgcatgaaggaccaggtcagctccgaattgaagcagcagttccgcccggagttcctgaaccgtctggacgacatcatcgtcttcaagcagctcaccgagccgcaggtgcgccagatcgtggatctggacgtcaagcagctcaacgaccgcctgttcgaccgtcatatgtcgctcgaactcaccgacgccgccaaggacctgctcgcgcagaagggcttcgacccgctgctcggtgcccgtccgctgcgccgcgtgattcagcgcgacatcgaggacgccatctccgagaagatcctgatgggcgatctcgaagacggtcagcgcgtgattgtggatgcggaaggcgagggtatcctcggcgaattcaccttcaagggtgaggagttcgaggagccggccgccgccgataagcccgccgaagacggtgccgccactgatggcgagactccagccgacgccactccggccactgagccggccgaatccgctcccgccgattccggtgacgctccgcaggagtagtccgtttcgatagcgtagctagcgcataccagcaaagctccccttgacaggggagctgtcagcgaagctgactgaggggtagacctgcgcacacatgatgtgcacgtttgtggtctacccctcagttgcctctggcgacagctcccctgtcaaggggagctactgtttgtgtcggattattacagcagggcgagtccggtgtcgatggtctcctcgcgggtaaacagcgtgcggccggcgcgcaccgaacgcaataccgagcagcgctcatacacggcgttgaacacgctatcggcgtccagcacaatgaagtttgctggcttgcccgtttccaagccgtacatatcgcgcaggcccaacgtagtggcaccgttgacggtcaggaacttcaacgcatcgtcgatttcttcaaagctcatcatctgtgccaaatgcagcacataatcaagaatgagcatcatattgccattgcccaacgggtaccacgggtcctgcattgaatcctggcccaatgacacattgacacccgcctcagtgagctccttgactcgcgtgatgccacggcgcttggggaaggtatcctgacggccctgcaaatacaggttctcggtgggggcgcaggcgaagttgatatgcgccgccttaagcagcttggtcaggtggaagaagtaggcgttgtccgccgatcccagcgaacaggtgtggctggcggtgaccttcgggccaatgccagccttatatgccagcgccgaaagcagctccacgtaacgggaattcggatcatccgtctcatcgcaatgcacgtcgatgagcttgtcgtatttcgaagccaactcaactaccgtgtgcatggaatgctcgccaaactcacggcactgttcgaaatgggggatgccgcccacgcagtcggcacccatcttgagtccttcctccaccagctcggcacccgattcgccatgcgggccctcgtaggagtacatgccctcctgcgggaagctgacgatctggagagtgaccgtatccttcaattcctccttaagctccagcagcgcctttaacgaggtcaggttcgggtcggtcacatcggcatgggatcgaatgagctgcacgccatgcagcatttctttcttaatgccgattttcgcgcgctgcttgatctcgtcgaccgtcaagtcggacttggtctcactccatcgctggatgccctcaaacaaggttccgctttcattcaccgcaccgggcttgcgggccgtgaatacgtaatcaaggtgcagatgcgtatcgcagaacggtgggcagacaagtttgccgcccagatcgaccacctcaatggccgccagatcaccaccctgagcctcatattgttgcgcgagtccggggccgaatgcggtgaacacaccatccgtgacgagaatgtcctgcaatggcagggtgcttgcagccgtgcttccgggttctccggtggcgatatgtgcgttggtgaacagtgtggtagtcatcgtcgctccttcaactggtgtgttgccgaacggttacgtgaaccgactgcccgcgtaaccaactgaggttattgtcaacagcacgctttgcggtgaggttaaccggaacgaccggtgttccgcgggggaatggacagattgtatgactgtatcgattcgcagtgtgcttcataacacgcagttcaaacgagccgatcctgtggtggaggtcgaaggcaaagacctcgatacgccagtgcgatgggtgttcaccaacgagcgagaggatgtctccagcttcctttcgggcggtgagatgctgattatcgagggcaacgctctgctcgccgccgattggcacggcacgctaggacaatatgtagcaagcctggcacaggctggtgtcgccgctctggtggtcgaactggtggagggtgtggtgcggatgccggacgaactggtgtctgcgaccaggctgcatgggttgacgttgatcggtctgaaatctcgcgtaccttttgtcgacatctgtcagagcgtcaataccgctatcgtgcacgaacagatgcacttgcaattggaggtggacacaatgtccacttcattacgtgagggattgtcccgtaccggcaatatcgaggctgtggccgaaaccattgcgtcgctgttcggcgaaagcgtcgccattttcgatggtgacggtctgttggccgctcgagcgggtcgtgcgttcgatgccggcaacgaatcgagcgccgtcatcgcccttgaaagtcgctcccggccggtgggagcattggagatcacgcaacgcaccatgacttccgacgccacgatgcgtcgggccatcgccaccatcgtgtctccggtggccgccctttatattgacggcggtgcgcgcatgggcatgatgcatcatctgagtatgggtccggccgacggcgtgcacgtcaatacatttgaggcgcaggaagcgcatgcgatgctcgaagcgctgggttttgccggatcatgcatctatatgccattcgcttttcggttcagatcggtggtggaaggcatcaaccatgtatcgacgatggtcgaacggttcgaagaactgtcgggatgcgccgtctcctgcatgctggaaggtgacttgatggtcggatggtgctccaccaccgattcctcagacggtgcggccgcattcggacgccattgcatggatgcgcttgccgtactggaaggcgacggtatatacgtggtgcatggccgagtggcattggacacggtgacgctggtcgacgggttcgcggtattgcgtgacatcgccaatcatgaaccggcatacgggcgagtcgtaagtaccatgtccgcactcatcgaccgtttcgtcgcatcctctgatatggacaaggcgatgcgcatgctcgtggtgcagaccatcggattcgaggtcgccgcctccccgctgttgctggacacactgtgcgcctgcttcgacaacctcgacagcaaaaccggcgcgtgcgagcaattgggtatcagacggcaaaccctgtacaaccgactggacaaagtgacacaaatggtcggcgtcgactataacgacaaaccgaactgggtgatgctgctattcgccgccaaactcacgaaatcatggcaagaacagcatggtgaataatacggcagtgccactgggcaacctgtccacttctacgccgaactggttaatcgacgattcacgtttcagcaaatactcaagggcatagtcgaggctatcgcggcgctggtcgacctgctgcgaaacgaattcccacttgaatcccattcagtcacacgaacagcacattcttgaaaggacggtgacatcatgagttccgcaacgattactacatctgcacgactgatgaattccacccctcaaactgaagaacaggccatggtcaggaaagtcgcggtatcctccttcctcggcaacttcatcgagtggttcgactacgcctcctattcgtacttcgccaccaccatcgccctggtgttcttcccaaccgacaatcacaccgtcgccatgctgcagaccttcggcgtgttcgcgctatccttcatcctgcgtccaatcggcgcactgttctggggtagctatggagataagaaaggccgtaaagccgcactggcccactcgattatgttcatgtccggtgcgagcttcctgatcggctgcctgccgtcttactcggtgattggcgtcggcgcgccgattctgcttctactgctgcgcatggtgcagggcttctccgcctccggtgaatatgccggtgcggccacgttcctcggcgaatatgcgcccacttcaaagcgcggcatctactgctcgctgattccggcttccaccgctgtcggtctgctcgccgggtctactctggccacgctgatggccaccaacatgaactctagcgcgatggtcggttggggatggcgtgtgccgttcctgctggccggcccgctcggtctgattgtgctgtacatccgcgccaagctcgccgattcccccgtctaccagtcgatgaacgatgcgcttgagtccaagagcgccgcctccgctggcggtcaaatcgctgccaagagcggcatgttcgccccgctcgccgaactgttccacaaccatctcaagtccctgatcatcagcttcggagcctgcgtgctgaacgcggtcggcttctacaccgtgctcacctacctgccgacctatctgtctgacaccgtcggcatggacgccccccccagtccggcaccatcaccaccatctgcctggtcgcctacgtgttcatggtgttcggcatgggccacatctccgacaaattcggccgcaagaaggtgctcatcggcgcttgcgtggcgttcatcgtcctcaccgttcctgccttcctcatcctcaacaccttccagttctggcccgtgctgctggttgagctggcaatgtgcgccaccctgaccgccaacgacggtaccctgtccagctacctgaccgagacgttccccacctccgtgcgcttcaccggattcgcgttcagcttcaatctggccaacgccatcttcggtggtacggcctcgttcatcgccactggcctggttgccctggccggttcgtccatcgccccggcctggtacatggtgggcgttgcggccatcgccttggtcgcgatgatcctctcccacgaaaacaccgacaaggatctgaatcacatctgatctcctcagctccggctccttccccgagggagccgggcgtattcatcgaccatccaatccaccaccaacctaaaggagtactgcaatgggtagcaaccgccgtatggaccacatgacctggccggaattcaaggaggcgaagactcgtcccgtcatcgtgccgatcggttcgaccgaacagcacggccagcatctgcccatcggcaccgacgcggtactcgccacgcgggtcgccgaagatctggcggaacgcatcgacggcaccgtgctgcccaccctgagctacggatacaagtccaagccgctctccggtggcgggccgctgttcccgggcactatcgacatgaacggcgtgacagtgatcaaccaaatgcacgacgtgctgagcgaactcatcgccgatggcttcaccaagatcgtcgtcatgaacgcgcattttgaaaacgaggcgttcatcgtcgaggccatcgacctggtcacccgcgaaaccgggggagtggccaccatcgtggaaaccaattggtgggacccggttccgcagtcggttatcgacaaggtattcgatggattggtgttccccggctgggcattggagcatgcggccgtcaccgaaacttcgttgatgctccactatgcgccggaactggtgcacatggatcgtatggtcgaggaagccggtgccacggcgaaatcctatgtccgctaccctgtgcgccaaggtgacgttcccgctcacggcggactcgccaatccggccggctcaagcgccgaacgcggccgtctgattgccgaggcgtgcgtggatgcggtagctgagatctgcgccgaggaatttggcgagtaatctccccttgctgacgcattcgtagtgactcgggttgcaaaggcctgaccctgatagtacggggtcaggcctttcccatcccaagacgccgctaagaattcacctgagagtcgcctttctaggcatggccgttcaatcgacgattctagcgtgactggtgtgagcaggaatatgaagaaccggcggtggaccggcaagcgatcgtggatcgtttttggtgcagtagcgcttatccttacggctctggtggttccttatgcttgtgctggaaccacgggagccgttcctttttccggtgataatccatcttccggcactcgtacggtgaccattgccgacatcactgattttcacgggcatatcgaacgtggtgcggacaacgccaccgccttcaccgtggccgacagccataatcccggcaatatgattccggtatcgaccggcgatttggtgggaggctccccgtatgagtcggcggtggagaaggaccaacccacgctggatatggccaaagcgtggggattgacgatttcggcggtaggcaaccatgagttcgaccgcggtgtcgccgatttcaacaatcgcatcgctgatcccagcaacggcatcgactggctgtgcgccaacacgtctgccgccaataagtcgtctgacggactgctgagccacgtacgtgactctacgattcgaacggtgaacggcaagcgaataggtttcgtgggcacccttactgatgcgctcggctcggtagccactccgcagatcactcgtgatgccgaccttgacgaacgggcggtggacgcaatcaatcgtgtggcccgtgaactcaagcgctccggaaaggtggatgcggtggtggccttgctgcatgacgatgcctcagccgccgccgatattgggcgagatgttgatgtggtatacaccggtcacagtcacgcgatcaagcacggtacgactgcgggtggcgcgcctatttacgaggcaggcagcttcgggcggaacatggccgtgcaggatttgatcatcaccggtgccgggcgtcgcgccacggtgcgagtggccgatgtggacctcggcaatggcaccagccatacggcggttgacggcgtgctgggcgtggaagggcttaatgcgcatccggcgcaagccgcttggatgtctgccggtgctgaggagaacgatgaggtatcgcgcgctcagcatatttaccaggcggcggcaacatattcgaatcatgccggcagcgcggtgattggcaccttggcctccggcgtgaatttcgacaaacaaggttcggacaagcacgggaatacggtcggtgtgctggtggcggacgcgaaccgagagtcaatcatgaagcatgtgtatgccgggaatcgcttgccggtaatcggattttcgaataatggcagtctgcggactccacggcttgatatgaatggcgatggcaaagtcaccgtgcgcgaggtggatagtctcatggccttgcagttcaaggccgcgcatgagacgctcaccgggcgcgatgtgaagagagtgctcgccgagcaatttcgccgtgacgatgggcgactggagcggcgctggctcggcatctcctcgaacgtgacgtatcggtatgccgaatgcggtacggctggtgagagcggcaatgccgatgccggcgttgatactgattccggcgctgataccaacgctgacgctaacgagtgtgctgccgacgaacatgcggcggttcgtatcgcgaacctcgccgttgacggccgaccgattgcggacgatgacctggtgattatcgcgtccaattcatatctgcttcagggcggcgacagttaccccgccttccgtgccggaaccaattacggcgagctggatatgccatacagccagccgttgcatgaatatctggccgcacatcaagggctcacggcagttgttgcagtaccggtagggactcaggcgtaagacaccaattgctgggtgactgaggaactatggggtgaagttatgagtatagggcaggagaaaacggcataaatatgacgaagctcccctcgctgaggggagctgtcgccgtaggcgactgaggggagcttgcggtataaccgtaaactcccctcagtcagccttgctgccggcttccctctgaggggcacctggcgagacccttacttgatggcgttcagccactgctccttggtggccttctcggcttcgagcttggccttcttcttcgggtcggattcggccgcgatcttggcgtcgagctcggcgagctgggcgttgagctgctcctcgaagctggacttgcgggcgtcggcctccggatcggtctgcttccaagcggcatcctcgatggccttgatctgcttgtcaacggcgtcgagacggttctcgatgcggcgcatatcgtcacgcggcacgtaaccgatctgatcccactcttcctgaatcttggccagctcctggcgggccttcttggcctcggcgtcggtcttcaccggcaccagagcctcggccttgaccagcagagcctccttggcagccagattctccttctcggaggagttgatctgatcgcgatcggcctgacgagcgttgaagaaggtgtcggcggcttcgcggaacttggcccacagctcgtcgtcctcgttacggccagcgcggccggccttcttccaacggtccatcagatcgttgaacttgcgggaagtctcaccccaagcggtggaatccttgagctcattggcctcggcgataatcgcttccttggcttccttggcggctgtacgctcgttgtcgcgagcctgagcccacttgcggcgagcctggttgaaggtggtacgggcgacggagaagcgcttccacagcgcctcggcctccggcttgtcgatgcgcacggtggtgcgctggtggttctgccactcgtcgaacaggttacggaacttgtcggcggtggagcgccagttggtgttgtcgcccagagaagcggccagtgcttcagccttctcgacaatggcggtgcgctcggcaacggccttggcctgagcggccttgcgtgcctcggcgatctcggccttcttggcctcgccggcggccttcagttccgcgtaacgggccttgagggccgcgaggtcgcccaccaccgccggctcggaggtttcttcacccaagagcttcacggattcgtcgatttcacgggccttgatgttcggggaagccaggcgggtggccagcagatcgagcttggccttgagatccaggaaacgacgggcgtacagtgccaacgcctcttccttggagacatccgggaactggcccacctcgcgctcggcgtcgccatccttgacgaagacggtgccgttgtcatccacgcggccgaaggcctcggcggccttgacatcagcctcggaataggcggcggtggcggcggccggggcggcagcgcgcggcttggccgccggagtcttcttggcgaaggcggcgggggagggcgcgtgcggtttcggcatggaagcgggggacggagtcggcgccggcgtggccgcgctggcctcgggtgcgggtgtcgttgcctgctcttcgggcgcagcggtgtttacgggttcggtgacagtttcgtcggccatggccagctccttaaagcgtagaatgcataagcgggagtgtctcccatcccgggcgaaccaggaagttttgacgcaaccctcacctattatattgatttcgtggctaaaggtgcatcaatatcaggattcccggagtggctcccctccgaacgtgttgtggagcagcgtgttatcgatacgcttcgtaaggtttttgagctcaacggcttcatcggcattgagacgcgagcggtggaaaccggcgcttctttgctgaaaaaaggcgagaccagcaaggagatttacctgctgagccgtttgcaggaggtcggtcatgaatccgacactccgattgaagagcgtttgggcctgcatttcgatctgaccgtgccgctgagccggtatgtggtcgagcactcgggtgcgttggcgttcccgttcaagcgctggcagattcagaaggtgtggcgtggcgagcgtccgcaggaaggccgcttccgcgagttcgtacaggccgacatcgacgtgatcggcgccggcgacctgcccgaccactatgaagtggaactgccgctggtcatggtctccgcactggaagagctgcgcgcgtatggcctccccaaggccaccgtgcacgccaataaccgcaagttgtctgaggggttctaccgtggccttggcctgacggacgtcgaaggcgtgctgcgcgagatcgacaagctcgacaagatcggtgccgatgaggtggcccgactgctcaccgagacctgcggcgccaccgaagcacaggcgcgcgcctgcctcgaattggccgagctcaccgcctccgatggtgccgagcttgccgccaagttcgatgcgctgtgcgaggctcacggcatcgtcaaggattccgagtcctacacgctggctcgtcagggactcgataccctggccatgatcgtcgacgaagccgccgccatccgccccggttccgtcatcgccgacctgaagatcgcccgcggtctcgactactacaccggttccgtctacgagaccttcctcgacggtgccgcatcactcggctccatctgctccggtggccgttacgacaatctcgcctcccagggcaaccgcaagtacccgggcgtgggcctgtccatcggcctgagccgactggtcagctacatgctgcacaccgccggcgctcacgccagccgtgtcagcccggccgccgtgctggtcgctgtgtggaatgaagaggaccgcccggccgccaatcgtattgcgaaccaactgcgtgcgcgcggcatcgctactgacgtggcacccaccgcggccaagctcggcaagcagatcaagtacgcggacaaactcggcattccgtacgtgtggttcccggccaccgctgccgaaagtgcggaaggcgcagagcccgctggcgacgaggtcaagaacatcgtcacgggcgagcaggttgccgccgattgcacgtcgtgggagccggatactgtggttgcccagcaaaccgtcgaaatctgacgtattcgcgcgaaaaatcgaggagaaacaagacaatgagccagacggcttacagaacacatcatgccactgaagtgaccgaggccctggtcggccagaaggtcaccctcgccggttgggttgaccgacgccgtgatcacggtggcgtggccttcatcgaccttcgtgattcgaccggcctcgtgcaggtcgtcatttacgacgaggatatggcccgcccgctgcgcagcgaattcgtgattcagattaccggcgaagtgcgcctgcgcccggatggcaacgagaacacccatctggccaccggcaagatcgaggttgtggccgagaccatcgagatcctcgccaagtccgacgccctgccgttccaggtttccaccgctcttgagaatgagtccgagaacaagctgcctggcgaggacgtgcgtctgaagtaccgttacctcgacctgcgccgcccgtccatgcagtacaatctgaagctgcgttccgacatggctaaggccgcccgccacgcgctggaagacatggacttcaccgaggtcgagaccccgaccttcattaagtccaccccggaaggcgcccgcgacttcgtggtgccggcccgtctggtgcccggttcctggtacgccctgccgcagtccccgcagctcctcaagcagctgctcatggtctccggcgtcgagcgttactaccagctcgcccgctgctaccgtgacgaggacttccgcgccgaccgtcagcccgagttcacccagctcgatatggagatggcctacgtggaccaggaagatgtgatggccatgactgagaaggtcatcgccgccatctggaagtccgccggctatgaggtccagctgccgctgccgcgcatcacctggaaggatgcgatggacaagtacggctccgacaagccggacctgcgcttcggcaacccgctggtggagctgaccgagtacttcaagaacacgccgttccgcgtgttccaggccccgtacgtgggtgccgtggtcttcaagggcggtgccgccacgccgcgtcgtcagttcgacgcttggcaggattgggctcgtcagcgtggagccaagggccttgcctacgtggtcttcggcgaaaacggcgagctcaagggccccgtcgccaagaacctatccgatgaggagcgcaacggcctacgcgaggccgtcggtgccgaggaaggcgacgccgtgttcttcgccgccggttcccgcgagtcagcccagctgctgctgggtgccgtgcgtgtggagctcgcctcccgcgaaggcctgctggatccgaagaagttcgctttcacttgggttgtggacttcccgctgttcaagcccaccgacgatccggatgatgacgatgtggctgtcggccactccaagtggacctccatgcaccacccgttcaccatgccttccaaggattggatcgacaagttcgacaaggatcccgagcacgccatgtccgactcctacgacatcgtctgcaacggtgaggagatgggcggcggttccgtacgtatccaccgcgacgacatccaagcccgtgtgctcgatgtgctgggcatcaccaaggaagaggccgacgagaagttcggcttcctgcttgaggcattcaagtacggcgctccgcctcacgcgggtctggccctcggttgggaccgcaccgtgtccatcctggccggtgcagactccatccgcgacgtcatcgccttcccgaaggccggcggcggccgcgacccgctgaccggtgctccggccccgatttccgacgagcagcgcgccgagactggcgtcgactacgacccggacgccgacgaaaactaatctacggagcgtataccgcctttcctcagcactcgacgtacttcagtgcgccttcggcttcggacggcggtctccgcacgcgtagattaattttcgaggagtaatgctccggtgctattagccgcaaatggcccttggaataattccaagggccatttgctttttgcgggtggggcccaatgtgccaaatacctgccaaggggtgccaaatactccgcccgatggcacctccgccatgcggcaaacctcgcaccatgcggtgtcccccttggcgtttgccgattatccttccatggggcggtaacttcctcatggggcggtaaacaacccatggggcggtgaaaaccccatggggcggtaggtcaaaatggcttaattccgcggtttcacaatttcttcaaaccgccccatgggcaaattaccgccccatgaggagcgatcgcaactccgtatttgatcaatgttgtgatgctttgttgtgttttgcttgtttccgcctcctgtattcccctttgcgcgcattgatggtaaggctgccgtctattaatacccggcatgaaggttgaggacggccaggaagcggtatttgcatcgcggtggcaacctcttgtgcgaaggcacgttgtttggcggtgttccacaggtcatcggcgaacacctcgatgacggtccagcccaattgccgcagacgtcgacgtttttgctggtcccgcacatattgtttgcggaagcgacggtgatgatcgccatcatattcaatagcgactttgtattgtggataagccatgtcaacggtgtaggtgtatccgttctctgaatcggtaatgccatattgtgtttgcggtatgggcaggccgaaaagcataagcgccaagcgtgtacgagtttcctgaacggaatccgatggttttacgagcttcagcgccgcctcacaacgcgcacggccaataacgcggtgaaaggccgttagtcgttgagtgaattgttcaatggcatatccataacgtctgatgagcgcttcagccagcaccactaattcagtgaggttgagatattgggcaaactgtatccacgcatccatgggatgcatgcaggttacgccgtttgagaaagcgatactgttgaactttgcattccatatgcgatagtcgacattgtccaatgaagagcgggtccccttgctcctcaccgtcacataaaaatccttctgcggcaacgtgctgtgcctcggcaactccacgccgcataattccaatgcggtatacagcgagaaacacaacgtgcgtttcgtgcgcactttgcccagcagattccaacaggccgtgttcttggccgtggctttggcgtcaagatctttgcgcagatagttgttgatttcgccattgtgcggcacttcgctgtatccgttcatgcgccgagcgtagcgcattccacggtggcacaggggcaaaaccgaaaaatggggataacttaagcggcgcgaactggttatccaccggcatatcgtgtgccgcgcccggttatccaccgcgcttcgggagtgtcgtccaccgtataacagcactcatcgtgtgcgaacagctagccacgctcaaaatgcctagcgcatttatacgaatacgacatgggaaacggcgagaccagccccacacaatacaaagtgaccgccagccatgcgcccgactgcggcatacacggcagcaacgccaacgacaccaaggccaaacatggaatcagcagataggacaacacgtgcccgctttgccgtcgcagcaacgtctcagccaccacgcagcaggcaatcagcgcacagcagacgccgagcgatgcgcgactcagcgagaatgtatgccgatgcccaatgccgccatcacgatgtctgatgcggaaatgagacatcgactgagcaactgtgtggacatactgtgaacacgttggaaacgtcggtgtgctatcctcccactcatgtctgaaacgaacaatgaaacagcagtgcgttcgcgcgcgacaagcacaacatcgccaagcaaggccaaattgaccccgctggttcccggcaaagaggacccgaaccgtccgctagtcgaactgacccacgtcgaaaagcacttcggtgctttgcacgtcctcaaggacatcaacctgaccgtcgccaagggtgaggtgctggtggtcgtgggcccgtccggctcaggcaagtccacgatgtgccgcaccatcaatcgcctcgagaccatcgattccggcgacatccgcatcgacggcaagcccctgccacaggaaggcaaggagctcgcgaacctcagggccgaagttggcatggtgttccagtcgttcaacctgttcgccaacaaaaccattcttgaaaacgtgacgctggccctcatcaaggtgcgtcacatggacaagaaggaagccgagcaactggccatggacctgctcgcccgcgtgggcgtcgactcccaggccagcaagatgccctcccagctctccggtggccagcagcagcgtgtggccatcgcccgcgcgctcgccatgcgccccaaggtcatgctgttcgacgagcccacttccgcactcgacccggaaatggtcaacgaagtgctcgacgtgatggtcgaactcgcgcatgaaggcatgacgatgatctgcgtgacccacgagatgggtttcgcgcgcaaggccgccgaccgcatcgtcttcatgtcggacggccagattctcgaagagaacacgcccgacgagttcttcgagcatccgcagaccgaccgtgccaaggacttcctctcgaagatcctcacccactgacgaacccactgaaagacgggtacgcaatccaatgacattcaccaatacgttcaaacggaaggcttgccgcgtgatcgccgcgctcgccgccgtggcctgcacaatgtcgctggccgcctgcggcgcggacgaaaccggcaagatccgcatcggcatcaaattcgaccagcctggcctgggcttcaagaagtccggcacctacgtgggcttcgacgtggacgtggccaaatacgtcgccaagaaactcggctattccgaagaccagatcatatggaaggaagccccctccaagcagcgtgaggccatgattcagaacggcgacgtggacatgatcctcgccacctactccatcaccgacgagcgcaagaaggccgtctccttcgctggcccgtacttcgtggccggacaggatctgctcgtgcgcaaggacgacaactccatcaacggccccgaagacctgaacggcaagcgcctatgctccgtcaccggttcgacctcggccgccaccgtcaaggagaagttcgcctccgaagtccagctcatggaacagcccggttacgccgaatgcgccaccgccctgttctccggcatcgtggacgcggtaaccaccgatgacatcatcctggccggcctggcctccgcctcgcgcggcaagctcaaggtggttggcaaaccgttcacgcaggaatactacggcgtgggcatcaagaagggcgatacgcagctggccaccaaaatcaacaacgccatcgtggacatgattcaggacggctcgtgggagaacgccatcagcgataacaccaagggcaccaactacacgcccgacgtacgctacaacccgcccatcccggacgaaggagaggaggcctgatgagcggattcctggaactcttcagccagtatgacgtgctcggcgcgtttctggtcaatatcgaactgaccttgtggtccgccctgttctccctgatcctcggcgtgatccttgtggtgatgcgcatctcgccgatttcctcactcagggccgtggccggtgcgtatgtggaactgttcaagaacctgccgctgaccatcatcatggtgttcatggtgctgggtgcctacgcgcagctgaagctcagcttctccgacaccttcaccacgaacttcttctggctcgcggtcaccggcctgagcctgtacacggcggcgttcgtgtgcgaatctctgcgttcgggcatcaacaccgtgccgattggccaggccgaggccgcacgagcgctgggcttgggcttcatgcagtccgccaccgagatcattctgccgcaggccttccgaggctccgtggcaccgctcggcaacacgctgatcgccctgctcaagaactccaccgtggccgccgccgcatccgtggccaccgaaacatcctcgctgatgagcgagatgatcgaattccgtcccgacgtgatcatccaaatcttcctgatcttcgcgctcggctacgtgatcctgatcatccccatcggcatgctcaccacgtacctgtccaacaaactcgccgtaaggaggtgacggatatggccgatacttcgaattccgtgctgttcgacgcgcccggtcccaagggccggcgcaccattcgcatcgtcaactggatcgcgggcattctgttcgcggtggtgctcgtgcttatcctcatgcgcctgcacaacccgccggacggcgagaaccagctcagctgggagctgtggaagcccgccgtcgaacgagaggcgtggaccgacttctacctgcccggactgtggatgaccatcaaggccaccatcgtggccgtggtgggtgccgtggtgttcggcctggtgttcggcgtgggccgactgctgccgaacccgttggtacgtggcgtctccgccgtgatcgtcgagttctgccgtgcggttcccgtgctgctgctcatgatcttcttctggcgatggttcgcgttcgcgggcctgcccagcccgtcctattgggccgtggtgctggccttggtgctgtacaacggttcggtggtcgccgaactggtgcgctccggcgtcggcaatctgccgggcggccagcgtgaggcctcgctcgctttgggcctgaccgaaacgcagtcgctgatggagatcgaggtgccgcaggccgtctacgccatgctgccggccgccgtcacccagctggtcgtggtgttgaaggataccgccctaggctcgatcatcatgtataccgacctgctgcaggaatcgcgccgactcggctcgatgtacttcaacatcctgcagacgctggtcatggccgcggtgatttacttcatcgcctgctggctgttgtcgaggctcgccgaatggctgccctcgcgcatgcagcagcgtacggccgcacccgccgaacccgagccgctggcgccgatcgccgccggcgacccgtccaatgtcaaccagatcgctgtggccaaggaggtcgaagagctgccgctgggcggtacgccgcgcaaataccatgtgcatcaccgtggcaccaacgcctcgattcgcaactggcggcgcacccgctacgaacagggatatgacgccacccagcccgagtcacaggttgacccggaaaccggcgaattccaggagtctcaaaagcctgaggacaagccagaggcctgacagtcagctcaatcgccgctaagccggcacgaagaatttactgagtgtttgactgggctccggctacgtagccttcacggaggataggttggaacatatgaagatgttccggcacctatcctccgtttttgctattgcgaccattgcgccgctggcgttggcggccacgctagccgtgacgcctgcaatcgcacaggccgaccagctgcccaacccggattgggtggcattgctctccgactacgaaaagaactattggcaggcccccaccgatgccgaacacggtggcaaggtgctcgacgccgatacaatgaaactcgacgaagatttggccgtggccattaaccacaaagccgccgaaaatctcgataaggatggcctgaacgcccaacgcaagcgtgcgctcgtcgactccgatctgcaagccgaggaagccatgccggacgcgctcggtccggtgcttggcaaatatatgagcgaagggctcaaatccgggaaactcaacgccgtcgccgatatcttctcctttaacgtggtctccacctacgcctcaaaacgtgcggccatgcatccgcgcccctatctgaaccgtgcggaaagcagctacggcggcactaacgatctcgccggactgcccgccacgcttgacatcaagcaatcaccctcatggctcgaacacgtgcccggctactcgaacttgcagaaaaacagttcctacccctccggccacactaccggcgcctattcgtggggtatcgcgctggccggcatgattcccgaactcgcgccgcaaatcatggcccgcacttcggaggccggcaacaaccgcatcgtgctcggcgtgcattatccgcttgacatcatgggcgggcgcattggcgcatccgcccagaacgggcagtactggcataacgaattcgcttcgtccatcgtgcccgcgtcccggcagctgcgcgactatctggtgtcccgctgcgccgcggacggccacggcactaccctcgtcgtctgcatcgccaacaccaaggcctccggttcgggcggctacaccaacgattttctggacccagtggccaccgagccggtcgtggaccaagcctcggccgtgcgcgtctacaccgcacgcctgacctacaccttcccgaaagacaccgcccagtccggcgctgatttcgtggccccgcgcggggcagcggacgtgctgcgactggcctatcccgaactgcacgccgatcagcgcaacgcgattttgaaagccactgccttggattccggataccccctatggcaatcgagcgacggctggcagcgtatcaactgggccaaagccctgtgcgcccgcgtcaccttggataagcacggcgatgtggccaaggtcgagaccgccgaccaagtggcgcttaccggcccgagtgtggtcaatgcccagtacaccgacgcgggcaatcacccggcgtcggatagctcggcgggtgaaaacagtgccattgcggccggaccggatctcgccaccctccatgccgcgcaacgaccggcgttgatcagcgtagctatcggtaccgctgtaatcgcgattgtcggcggaatacggacggttcgacgcaaatccaagaaccagcttcagcagtaattcagccaaagttcagtcgcgctgctcaccgctgcggtgacactgagcagcatcgccctgatcggcgtgcccgctgcgactgcggacgagcagcagaccactgccgaacagaacacggctgccaaaccatccgtaatcatcaacgaggtctatgccggcaatacgaaagctgccggagacccggatagcaagcgttgcgattgggccgagctcaagaacaccggctccacagacgttgacgtgaagggctggggcatctacgacagcggcaagaaagccaagaagcactacaccatcggcgccagcgaagtaacgaatacggacaccgtcatcaaagccggcggatatctggtggcatacatcgaccccgacaaggcaaagcctgccaaaacctgcgatgccgctcccgatatgaaagtctcctcgatcaagagcgacaatctgatagtcacgattctggccacttcgaattgtgatgataagaacgcatccacgaaattcaatgattcggccacccgactcacgttgcaggacagcgacgataatgtcgtggccgatgccgtgttcgatttttcgggtctattccacgtataccgcgcagttgtccagcaagcgcaagggcatggaagctgaaggcaagacctggaactaggggctgcggacattttcttggagataatcacgcagccattccttggctttgacggtattgtaccgggctcatccaaccaagcgactgtttgatgcgctcgtggttgtaccagcgtatgtactcatc

SEQ ID NO: 20 - DNA, 131642 bp, Bifidobacterium longum
tatacaggcggcggcaccgatgcctatcacatcaccgggaaacgatgacgacaccggggaaaaccatcagcccacactacggaaaaacactgccgaacctgtcgaacaaacattgaagcaaaacacgtttcctgctacgcggtcattttgacgcttacgctctaatgcctccaccgcttgtcgcgggcggggtagacgatccaggcggatgcgtagcttgcgataaggcagacaatgacgcagacgatgcttgtctggaacccgaatgagtcattgataacgccccagattacgcttgcgaagccaatgccgatgtcattggcgagcaggaacagggcgtttgcggcgccccagcgctctggcggggtgttctttaccgctacgctttgattaagtggcaggcttatgccagtggcgagaccatagaagattccgggcgccaggaagacaggttccccgtacggtgcggcaagtagcataaggcagcagaggatgccgcacgcgacggctccggtcattgttttgattgcaggtacggtgtccatgaaatgctttgaaatcatgcgaatgataatcatgcttaccgcgctgatggtgtagaagagaccggcgtgggtatagccgagagtagtaccgtacagaccggcaaagaagacgccaaagccaaaagtggggcacatgatcatctgtgggatggcgccaggcaatgcgcgcggctcgaagatgttgaatgagtcacgcagggttctcttggacacctggtcgccttcaggatacttttcactgttaattgtttcggatgtagttactgtggtggagctgggtgcctgcccgtcttttgagtcgagttcgagccgggtttccattttgattcggtatgcgctggagcttggcagagtttgccatttactttcatagcgtgcgttgagggcgattacaagccctgcaaacccaaccagggcaaggccgacatagaggttcgttgagggatcggttcctactaggtaaagtgcgaaggctgggccgatgctcatggcgatagcctgtccgaggccgtggtatccaatgccttcgccgagccgttcttgcggtaagacgcttgctgcggcggtcgaggctgctgttgttgctgcgccaaagcccacgccttgcagcaaacggctgattgtgaagagggggatgccttgaacgacagcggacagtgctgttcctgctatgaggatagcgatgccggcgatgataacgagtcagcacttgccgttgtcgataacagggccgacgaacagtcgtgctaacgcggcggcaatggagaagacgagtgcaagtacgccggcaaggctcgcaccgtaaccttggcctgccaggaagacgctggttccactgttgagtccttggcccatgacgaagcaacagaaggtcagcgcgatgataagcacgaaaataagcgaccacagcttcggatggtcgtccttaccgatatttggcatgagaaccctcctatgattccaatacccgtattctacgtctgcaaaaagtgagatgtaagcgccaaaatgaccgcgtcttaacaacccgctgggcttgaggcagaatcatcgcatcgacttatcctggaaactgcctgacgaaggcgacaggatgcttgtcagcaaggcggcaaatcttaacgagagccaaatccaagagcttgcaaatcttcagcgaggcgttgcagcaatatatcagaacgaatggaccgaacctgtcctctgtcacatcgaaccgcatgaacgcggcctagagtactcgccaacacagagcaagcacagcgcgaaggacaaggtttcttctgaagagcttcgctatctcaactcttgtgtgcttaatccgttcaagctcgatgagccaagggaatacaacttctgcgactgtgtgcacaagatggacatacctgactccatgaaggcacgcttgattgagatggcagggactcctctgtcctcgaggaagccactgtttgaatggtgtgcttataggtatttcaatattggacgcatcctcgacgacgccagggatttatctgccgacagcctcaaagagaggctttgctcccatctgctttcaagctggaaattcgaagatgattcctcacccgaaagctggggaccaatccaatacctgttcattcagtcgatgtttaacgctcatctcaacgagctgagaaagaggggtaccggcatcgagacaacggaaaaggcctcagcactcgccgaagtatcagcggtcttatctcaaacaaggccggtgatctaaatggcgtttgaaaatatagagcaattaatgccggatacggccgaaacgagattggccttcgaggaggcgcaacgcaccgttgctgattgtgcagatgccgcatggcgggatatttcttccggcgatgtcctaaccgcgagcatttcaacagttcaagaagccgcagatgacgcctggaaagcatgcgagccaacactcaacgctgcaggcgaaactgtccgcgatggcgcaaggaacggagcttatcttggcggcaggttcgtacttggagttgccgacgttggagaaaacgcatatgtcggtgttcaatcgaatattgaactactggccgaagacgaagaagcagcggtgaaaaccgcgcaaacacacgctgttgacgatgcagccaacgcctggggcgacttcatggaagccgatgagcagatacgggaaatcggagactatgtcgaaactggaggcgaaatcgccactgaagttgcgcttggtgccgtagccgtcaccgcttctgcccctgcagcactcgctgctggggctgtactcgttcttgacgaaatgggaaagagcttggaagccggcgctgaagacggtgagatatctcaggaggatatcgtcggagaagtcgttgcgggaactgttacggcagcaacgcttcttgccggacgaggtctaaataactttcttgcctcaaaggcagcagaatcgggcgcaagctcacgaattctggatgatgccggaaaggcaatttacgaaggcgaccgactgcttcccaataacgagtttgcgatcgacggcgtgaagtgtgcaaccgacgatctcgggcagctttaccgcgttggcgacgacctcgttccgaacatgagctatgagatcaatgggtataaatacgttaccgatgcaatgggtagggtcgaatcggccgaaggcttcttacaactaaagacccacgaaggtcgtttgaccatcaaggacactatccagtcaatcggaaaagggtttgaagagctttttgatcaaagaggccatctgattgccgaccgattcaatggatcaaatggccttgagaatattgtcgccatgggcggcgaggttaaccaaaagcctatgcagcaatcgagcaaaaatgcgccgatgctttggctgatggcgctgaagtgttcttcaaggttgagccactttatgagggcgggtcattcaggcctagctcgtttgctatcacggacattattgacggcgaagagacggttacgtttcttcttaacactgcaaaggaaatgtaatgagtgaaaagaagatgctacaagggatagcttcaattcttgaggaaaccctccccgaagactggagcaaggtcgtgttttacgccgagtacgccgagggtgcgttctctattgagtattacgttgctggcagcggaaaagacgacttcgttaaatgctttgaccaaaaaggcgtttcgagggcatccttgatgaaaaactttatggctatcaacaagttcattgaacctgaaagggccgcgcttaagcccgaaaagagatggggatcgatgacgcttattctccattccaacggcaagttcaaagttgattacgactactccgacatgacagaaaacgcttacgcccgaaagaaggcctggaaaaagaaatatctcgcctagcaacgaacggtctgggaaatcaccgcaaagccacccgtgcatactcttcgagcgcacgcgtcgtcggcaacgtttcgaccagcgcgtttttgggagccatgcaaacccctgttcaacattcctcgggagtgattgctctctatgacgaatgggattccccatcggggaatcccattttttgttgccgacgacgtccggtataatttttccgtttacgacgtcgttcggaaagggatgccgacctctatgcgccagggattcgacaacgaaaaatacatcgagctgcaagccgccaacatcagaaagcgcatcgcgcaattcggcggcaaactctatctggaattcggaggcaagctcttcgacgactaccacgcctcgcgcgtgctgcccggctttgagccggacaccaagttccgcatgttggaaagtctggtggacgatgtggaaatcgtcatcgccatcaacgccaaccatatcgaaaaaggcaagacccgcggcgatctcggcatcccgtatgacgaagacgtgctgcgactcatcgacgtgttccgttcccgcggcttcctcgtcggctccgtagtgctcacccaatacgccaatcagcccgccgccgacgcctaccgccaccgcctcgagcaactcggcgtcacctgccgcctgcactacccgatcgccggatacccgcacgacatcgaacgcatcgtttcagacgacggatacggcaagaacgagtacatcgagaccacccggccgctcgtcgtggtcaccgcgcccggccccggctccggcaaactcgccacctgcctgagccagctctaccacgagcaccagcgcggcatcgacgccggctacgccaaatacgagacgttccccatctggaatcttccgctgaaccatcccgtgaacatcgcgtacgaggctgccaccgtcgacctcgacgatgccaatatcatcgaccccttccatctggaggcgtacggcgagaccaccgtcaactacaaccgcgacgtcgaagcattccccgtgctcaaagccatgatggagcgcatcatgggcgaaagcccctatcagagccccaccgatatgggcgtcaacatggccggatacgccattgtggacgacgatgcctgccgcgatgccgcgcgtctggaaatcgtgcgccgctacttcgccgccgccgtgcacttgaagcgcaccggcactggcgaggaacaggtggagcggctgcgctccatcatgaaccgggccggcgtgacccccgatctttctcccgcccgcgccgtggcccttgagaaggaagccgccaccggtgccccggctggtgccatggtgctgcccgatggccatgtggtcaccggcaaaaccggcgacctgttgggcgcggccagcgcgctgctgatgcacgcgctcaaggccgtcaccggtgttgacgaaaccattccggtaatcgacgatgccgccatcgaacccatctgtcggctgaaaaccgaacatctcaacagcgtgaaccgacgcttgcactcggatgagacgctgattgcattgtcaatcaccagcgccaccagtcctgtggccgctcgcgtcatcgacgggctcaaacagttgcggggctgcgacgccttcttctccgttatcatctcatccacggacgaggcgctgtatcgcaaactcggcatcaacgtgtgctgcgaaccgaagtacgaacgggtgagtctgtatcaccggtaagcgccaccgataagcgcggtatgccgtgaatcgtcaagccggtaatcatgcagcatgcggcctgacgattcgctgctgtcgcattgtctctcccctcggccatgctgggcttgttttccgtttgttggagagaacgggaaatgccatcagcactacggaaagagaaggattatccgtgaagcggttcgtgggtttagacggtattaaaggactagcgctgatagccattgtgctgtaccactgcatgcagcaacggctgccaggcggattctacggagtcgacgtgttcttcaccgtctctggattcctgattgccgtcagtttgattcgttctctggcgaaaaccggatcgctgaatctcgtgcgatatattcccaagcgtgcagtgcgtctctatccggcgctgtttctgctgattccggtcatcgtctccgtcggctggctgttcgatcacgacattctagtttccatccgcgaccaagtcatcaccgtgctgctgggctgctacaactggtacgccattgccggaggccaaagctatttcgaccaaatgaacccgcaggtgtttcgccatctgtggttcattggcgtgctcatgcagttctacgtcatcgtgccgttcatcgtctggctgatgtggaagctccgccagacgaaactgccttcactcatcccactgggactcgcggcgttcagcagtatcgccatgtgggtgatgtatgtgcccaaaggcgaccccacccgcgtctacttcggcaccgatacccacagcatgggcctgatgctgggtgtggctctcgcctggtgggtcaccgctcctcagttgggccacgctcgccagagggctgtgccgatgccccgcaccattagctcgagcgcttcggcagccgcacatcgggctccgttacctcagattcccgtggagcatcgcatctggaatgcggcggcaccggtattggcgttcctcagcctgattgccttggtcaccatggcggttatcggcaaacaggatgcattcgccttccgcggtggcatcatattgtccagcttgttgtccgtgctgctgattgccggtaccatctccgacgattcctggatgcaaagcctcatggtgttcaagccattggcctccctcggcaagtattcgtacggcatctacctgtggcactggccgttgtggattctttccagcgcccttgccccgaagatcttcaaggcagtagggccttggcctctcatcatgaccgcgttgctcaccgccattgcggtgatgatttcctggctgatggtggagaaaccggcggcaacgcactcggcggtatccgtcgtggtgccccttcgcacgaacaagaagaatcatgtggcccgggttattgccgttgacgttatcctggtgctgtcgttggtcggctgcgtgcagggcattgctcatgcacctgcgaaaaccgccatgcagatccagctggagcaacaggccgcacaactggaacgtatgcagaaaaccgaacacgtgctgctgcgccatgccgtgccggcaccgcccaagcccaagcatgagatgcccaccggcgatcagattaccgccataggcgattcggtgatgctggcctcatcacagggcctttcggaagtcttccccggcattcagaccgacgcgagcgtttcccgctccatcatggtcgcccccgaactcatcggcaacgctctgtccgccggcagtctgcggcagtgggtgttgatcggccttggcaccaattcggcaatcacccccgatcagttggaccagattcgtaatatgatcggccccgaccgcgtgctggtactggtcaatgcccacggagaccgtacgtggattccacctaccaaccaggtgcttgccgactatgcggccgcacatccggacaatgtggtgctggtggattgggatgccacagccaacgcgaacgcgcaggtgctcggctccgacggcatccacccgagcatggatagcgatatctatgcaaaggcggtcagacagaccatcgaacaatggatcgcaagcggcaggtgaacggcaggcaacgctgagttgtccaaccggtcgtgaagaacggctatgctgaagactgcatcaacgagaccacacgttgggagacatggtgagcgcaatccttgaaggaaagcccgataagaatcttattctcgttacgggaaggattcatccgaagttggctgaggatgtcgccgagcagctcggcatcgacgtccttgaaaccaccgcatacgatttcgccaacggcgagatgtacgtgcgctacactgaatcggtgcgtggcgccgatgtgttcgtgctgcaaagccactacaagcccatcaacaaggcgatcatggagcagctcatcatgatcgacgcattgaagcgcgcctcggcccgttccattactgcggtctgcccgttgctcggctactcccgtcaggacaagaagcaccgcggccgcgagcccatctcctgccgtctggtgttcgacctgctgaagaccgccggtgccgaccgcatcatgtcggtcgatctgcatgccgcgcagtcccaaggcttcttcgacggcccggtcgatcatctggtggccatgccagtgctggtcgactacatccgtgatcgtttccagggccatctcgacaacgtcgccgtcgtctcccccgacgccggccgcattcgcgtggccgagcagtgggcgcagcgtctcggcggcggtccgctcgctttcgtgcacaagacgcgcgacatcacccgcccgaaccaggcggtcgccaaccgtgtggtcggcgacgttgccggcaaggactgcgtgcttgtcgatgacctgatcgacaccgccggtaccatcgcgggcgcatgccacgtgctgcaggacgcgggagccaagtcggtgaccgtggtcgccacgcatggcgtgctctccggcccggccgtcgagcgactcaagaactgcggtgcgcgcgaggtcgtgctgaccgacaccgtgccgattcccgaggaaaagcgctgggatggcttgaccgtcctgtcgatcgccccgctgctggccagcgccatccgcgccgtattcgaggacggctcggtcgccgaactgttcgacacctaccccgagcaccacggtcaaggcttcctgttcgcctgatcacgtgcgtgtttgttcgtggaaagcacacgatgcgagacgcgacatggcgtagtctttcggtaaataccgacaatatggtataaatgaacacttgtgggccgaaagcccacgactcccccatggtgtaatggcagcacacgggtctttggaaccctttgtcttggttcgagtccaggtgggggaacggctgacggccgctcgacatccgggcggccgtctattgttttgaggtgtttccaccctcaatagacattccgatcgaagggaatacgtcagttatggcattatccgcagccatcgtcctcgcagccggcgagggtacccgcatgcgttccaacaagccgaaggtgctgcatgcttttgcaggcaagaccttcctgaacagggtcatggattcggtggccgccctgaatcccgacacgctggccgtggtcgtgcacttccaggccgagcgcgtcgccgaagccgcccgctcctatgacgagcaggtcaccattgtgaaccaggacgacattcccggtaccggccgcgccgtgcagtgcgcaatggcgcagctcaccgaggctggcaaggtcgatggcccggtgctgatcgccgcctccgacatgccgctgctcgacagcgagacgctgcaccgtctggtcgaattccacaccgcctccggcaacggcgccactgtgctcaccaccatcctcgatgacccgaccggctacggccgcatcatccgcgatcgcgaaggcaacgtgctgcgcatcgtcgagcagaaagacgccaaccgcagcgaactcgccgtgcaggaagtgaacacctcagtctacgtgttcgaggcttccgtgcttaccgaggcaatcgccggactgaagtcgaacaacgcgcagggtgagttctatctgaccgacgcgctggaaaccgccaaggccgctggcaaggtcggcgcgttcgccgctccggatccgctcaccgtcgaaggcgtgaacgaccgcgtgcagctggccgcgctgtccaagacctacaaccgccgcgtctgcgagcgctggatgcgcgacggcgtgaccattcttgacccggaaaccacctggatcgaggacgatgtccaaatcggccgcgacgccaccatcctgcccggctccttcctgcaaggccacacggtggtcggcgaggacgccatcgtcggcccgtacaccaccctgatcgacgcaaccgtggacgaaggtgccgtggtcgagcgttcccgcgtacaggaatcgcacatcggcgcacgcacgaacatcggcccgtggacctacctgcgcccgggcaacgagttcggcgaggatgccaaggccggcgcgttcgtcgaaatgaagaaggcgcacatcggcaacggcaccaaggtgccgcacctgagctacgtgggcgacgcccagcttggcgaccacaccaacatcggcggcggcaccattaccgccaactatgacggcgtgcacaagaaccgcaccaccatcggctccggctgccacgtgggtgccggcaacctgttcgtggccccggttgaagtgggcgacaacgtgaccaccggcgccggttccgtggtgcgccacgccgtgccgagcgacacgatggtctactccgagaatacgcaacacaacgtcgagggctggaagcccgcctgggagcgctgaaccatgcccgcacttcaggattccatcaacgccgtccgtgtggccgccgaggccgcggaccgtatcaaagccaccgacatcgtggccttcgacgtagccgacctgctcggcatcaccgacatcatgatgatcgccggcgcctccaacgagcgtcaggtactggccgtggccgaggaaatcgaaaaggacctgttccttaagtgctccggccgtcagccgcgctctcgcgagggcctgaccgagggccagtgggtgctgcttgactacggtgatttcgtgattcatgtcatgcacgaggaatcgcgcgaattctacgggctcgaacgactctggcgcgactgcccggccatcgatcttgaactcgcacacccggaaacggcggagcatgcggaagatgctgccgtcaccaccgcgtaacgtgcgaatcacataacgctgatattcgcgtgtcgggctgcctgttgccaaacatcattgacggcatcaggcagccctccccttttttcctgtttcctcactggaaccgaaaggatcgtcactatgaccaatcatgttcgttccgttttccttatccgtcatggacgcacctcctacaacgccgctcacaagctccaaggccaggtcgacattccgctggacgccgtgggtgaatggcaggtcaagcagaccgccgcggccttgaaaaggctgtacgtcgatcgtcggcaggaaatcaaccaccggttcattgtctgctccgatttgaagcgtgcgcacgccaccgcgcaagctttcgccgacgtattgggtggaatcgagcccgtcgatgatcgtcgcgtccgtgaacgcagcttcggtgattgggatggccatgccgtggccgaactggccgaacgctaccccgaggacttccgttcctggatggagtctcggggcggcgagctgaagtatggtgccgagcccaaggaagctgtgggcaagcgcggcgtagaggctcttgaggactggtccacgcgtgccggagacgacacggacctgttcgtgttctcgcacggcgcatggattgcgcagacattgcagaccctgttgggcatttctgcaatcgatccgaccttttctacggtggtttcattgcgtaatgcgcactgggtgcgcttggtgccgatggacaatcccgatggcactgtgcgctggcgtctgctggactacaatcacggtccggccatcgccgacaccgacgagtgggaacgcgaacgctgatcgtgtcacggctcccctgctgagccaacaggttcagtgtattcgaaaaaccgttcaagcagtaattgaataacccaatgcctgaataatggcggaaacaagccaaaaagtgtcgccaaatcccacttttgccatttggcgacacgccggcttttgccagaatcgacatctcgtcgtaatgtatacgaggtccaaacaacgggccaacaattgaaaacggggctatagcgcagctggtagcgcatctccatggcatggagagggtcgggggttcgaatccccctagctccacgacgaagccatcaaatcaggcgatatggtggtttctccgctggttcatggcgggtcttgcgactcccatgaatcggatagcttcactcggggctatagcgcagctggtagcgcatctccatggcatggagagggtcgggggttcgaatccccctagctccacaatcaaggccggtgcttcatgcaccggcctttctcgttttctggcctatcggccgacttttgcgcaacattccccggaaagcgtcgccagggggacgctcttccgattggcgcgacaccgacgtgagcgataacagtaatcgccactacaatgaggtgtggtccctatcgtgttgattatcaaaggagacaaaaacatcgtgaccgtcacccgtgtatatatcgccagccctgaaggcgccaatggccgcaacgtcgtcgcttacggcatgctcaacgcattgacttccaagtacaagaccatggtgttccgccctgctgtgtccaaccatgacgaattcaccccgatcctgctcgccgcctccaatgccggactcggcgtggccctgtccaccggcctcgatgtgcacaaggtgcgcgaggataaggacaccgcccgtggcgatatcgtcggcgcgttcaacgatgccatggacgtttcccgcgcggacgccgccctgatcgtgggcaccgacaagtcccacgtcaacgatccgaccaactatgaattcgacgcgaatgtcgccgctgatctgaaggccggcgtgttcctagccgtgtgcaccatcgaccgttggccgcacgagctcgacgagaccgtcaagctgtccatcgagggcatggaggccgctggcaacaaggtgctcggcatcttcgtgaccggatgcgagccgcgccacgctttctccgttaaggagaccctcgccaagtacggcctgccggtctggactctgccgcaggtgccgttcaccgatgaatccaccaaggatctggcgctggagaccttccgtaagaacgctcccaccgatgaagtgctcgccgcgctcgatgtggacgtcaccgcgcccatcaccccgtacgccttccagttcggcctgctcggcaaggccaagagcaacaagaagaccatcgtgctgcccgaaggcgaggaggaccgcatcatcaaggcggccgactacctgcttgagcgcgagatcgtgaacctcatcatcgtgggcaacaaggacgccattctggctcgcggcaaggaactgggcctgaactacttggagcgcgcccgcttccaggctatggacgacgagaacgtgctgaagcccatggtcgccaagctgtgcgagttgcgtgccaagaagggcatgaccgaggagcaggcccgcaagcagctggccgacgccagctacttcggcaccatgctcgtggtgctcggctacgccgacggcctggtctccggctccgtgaactccaccgccaataccgtgcgcccggccctgcaggtcatcaagaccaagcccggccagaagctggtctccggcgcattcctcatgtgcttcaaggaccatgtggccgtgttctccgactgcgccatcaacctcaacccggatgccgagcagctttccgaaatcgcgttgcagtccgccgagaccgcacgtgccttcggcatcgacccgaaggtcggtatgctctcctactccaccctcggctccggcaagggaccggacgtggacatggtcgaggaagccaccaagctgctcaaggagaaggctccggatctgccggtggtcggttccatccagttcgacgccgcctggtcccccaccgtggccgccaccaaggccaagggcaacgatgtggccggacacgtcaacgtgttcgtcttcccggacctgtgcgccggcaacatcggctacaaagccgtgcagcgctcctccggcgccttggccatcggcccggtgctgcagggtctcaacaagccggtaaacgacctgtcccgtggtgctctggtgcaggacatcatcaacaccatcgccctcaccgccatcgaagcgcagtgagcccggcttagctcccggtggctcccgccagcgggagccaccgtaatgcttattttgtagcaagcaacgagtaatctaatcaacggtaacccgtgtctcacgggaacattcaatcacaatggaggatgcccacaatggcgaaaaccgtccttgtcatcaattccggctccagctcgatcaagtaccagctggttgatctcgaatccggcgaaggcctcgcttccggcctcgtcgagaagatcggtgagccggtcgacggccactacaagcacgagtacaacggcgaaaagcacgagcttgaagagccgattcacgaccacgagcagggtctgaagcgcgtgctcggcttcttcgaggagtacggcccgaacctgtctgaggctggcattgtcgccgtcggccaccgtgtggtgcagggtggctccatcttcccgaagccggccctcgtgaccaacaagaccatcaaccaggtcaaggatctggctgtgctcgccccgctgcacaacggcccggaggccaagggcgccgaagtcatgcgctccctgctgccggacgttccgcagatcttcgtcttcgattcctccttcttcttccagctgccgaaggccgccagcacctacgcgctgaacaaggaaatcgccgatcagtaccacatccgccgctacggcgcccacggcacctcccacgagtacatctcctccgtggtgccggacgtcgtcggcaagccggctgaaggcctgaagcagatcgttttgcacatcggcaacggcgcttccgcttccgctgaggtctccggcaagccggttgagacctccatgggtctgaccccgcttgagggcctgatgatgggtggccgtaccggtgacatcgacccggctgtggtcttccacctgattcgcaacgcccacatgaacgtggacgagcttgacgccctgttcaacaagcgttccggcatgatgggcatgaccggctatggcgatttgcgtgaggttcaccgtctggtgtccgagggcaatgaggacgccaagctggctctggatgtctacgtgcaccgcatcgtcagctacatcggcaactacacctaccagatgggtggctgcgacgtgatcaccttcaccgccggcgtgggcgagaacgacgacgtggtccgcaagatggtgtgcgacaagctcgctccgttcggcgtcaagctggacgaggagaagaacgccacccgctccaaggaaccgcgcatcatctccactccggactcctccgtgatcatcgccgtgattccgacgaacgaagagctggccatcgcccgcaagtccgccgcaatcgccgaagccggcaccgacacctacggcaacaccttcgccaagtaagtaaccgccgttaggcatctcaccaatctctagttgcaacactatgggggctgattccgattggaatcagcccccattcgtatatggtcatgagaccactacccccgcgtcatactctcctcagtcgcctccggtggacagctcccctcagagaggggagttgtccgcgtagcggactgaggggagttccaccagaacacaggaccccttactgcctcagcatgccgctccacataccgacgaagtcaggcaaggtcttgcgcgtggtggacacgttgatgacctcgatatcgggaatacgcagccccagcatcgcggcgaacgtggccatacggtgatcagcataggtttccatcacagcaccgtgcaacgtctccgccggcaccggttcgatacgcaatccaacaggcaattcctcagccgctcccccaacacgacgaatctcgttgaccaatgcctccagacgattcgtttcgtggccgcgcaagtgaccaataccaaccatgtctgtcgacttatcagcaaacaccagaatcgccgccaacgagggcgcaatctccccggccgccgtcaaatcgaacgtacccagcccacgcacggtgccgtcaccggtcacttcgcaatagcgcacgccatcgattgtcgggaacgatactttggcacccatctgttccagatagcccggcaacaaaccacccggctgggtggtggtctcaggccaatgaggcacccggaccgtgccgccggcgatcaatgccgcgccgaggaatggcgccgcgttcgacaggtcgggctcaacggtcaccttgctcggcagttgcattgcgcgcggttcaaccgtccatgtgcgggcggattcgtcggcctcaaccgcaccgccggcaccggtcacatcagccacagtcatgcgaatgtgcggcaggctcggggtcttctcccccgtgtgcgcgaggtgcagaccgccaggcagtttggaactaatcagcaacaggccggagatgaactgggaagaaccggacgaatcgatgctgacctgcgcctgggcagccggcaaggttgcaggcggcgtaatagtgaacggcagacggccaacctcgccgtggtaatcaaccgttgcacccagctgttccaaaccgtcaagcaccggcttcatcggacgtgcataagcctgttcgtcgccatcaaaattcactgggccatctgcaaacagggcaaggccgggcacgaaacgcatcaccgtgccggccagtccgcagaacacattgacgttgccatggaatcggccggatacaggaggagtaaccgttacggtggtgtcggttgcggaatccacgtcgcagcggacaccgagggcttcgagtgcgcccatcataaggtccgtgtcgcgcgaacgcagcaggccaatcagagtaacgggcttgctgccgagggcggcgagaatcaggtagcggttggatagggacttgctgcccggcaccgttaccgtagcgttcaacggctgtgcggcgagcggggcaggccagagattcgtgagtcgttcagtcataaggccaaatctatcaaacaaattattcaccggtcggcagcgatgcgggattcgatctgctgatcaggtgcggaagacggctgctcaaaaccgccttcgatggcctgcgcgtgcaacaactgagcggccgcgcgatcggcctcgatggcggcgatctggcgcgagaacacgatgaaccagccgaggaacgccagaccagccaacgcctccacattggtgagggtgttgtgacccatcatcatattgacccagaatgcagcgcatacgagcgcggtcaggtcggaggccaccatcactgctttggacaggcgtggcgcaagccacggcaggagcacgaacagcagcagcatgacgaacggcaggcctttggcgcatatattgtgcaagagattgtgcggcgtgtaccgaaacacgccgatgccgatgaatgccaggccggccaccatcagcaggaaggacagaatggagatgcgcagcatgaaatgtgggatttcgtagccgcgattcggatctctgttggtgcggtcgtgccagaggcgctgtagccgttcggtggtcaccagttcggagatggcgaagtagctgacgatgatgatgcatgtgccggcaagaatcagcgtggagttgaacatacgggccgcaaacgtggttctgtcgccgagctgcgaaaagttgttgtgataccagtatgggtcgtcggtggtcatgccggcggtgaccacgccggagatgacgaagaacggcaacagactggcaatagttttggcgttcatcatctccgcctgtacaaaggtcatgtaccccaccacgccggcgaaggcggcgcagacgctggagatatagccggagaagatggcattgcccatcatgtcgttggccgcaccgatgagtgcaaaagacgacaggaaaatggtcgaggcatacaccaccgaaagggcgacgatttcgaaaatgcgacgaatcggtgcaaaccaaccatgtttgaggttcaatgaacgtgatttgcgcgcatagccaataatgaaggaaatgacgccgcatgccgccacgatgcccgaacataccatgaatcggcgttgcgtcagctgccagatggccggcgcgtattccatgtacaggttcatcgataccgcgccaacgacggcgcaaatcaagaaggagatgagtccggaggtttctgcacgctgatgacgtcccatgccgggcctcccctatctattcgatgccgcgttatctttcaacaacaaacaaaactccccccgaggacaacgctttactagcaagccagcgggatttggctgtcgccattctactgaaaatctgaaacactacaaaaaaacgattatgtacgggcttcttagcctttgcgactatcgttaccgccttgccgagtaccgttgttcatgcagaaagaaagcagtattggacacaatcgaatgagcgtgtcagtatcgttgaaaaagtaatgaatgacggttctatcggttcaacctttaagggacgaaccagccgcggtaccatggcgctgatgcatgactatgccgagctcatcaatgaattacgtccgacagcagagcaattcaccgagatcgagcaatactgggtcaaacgaattcaagcgttcttcaccagcaaaccattcaagctggagtccgacaactcgctttccgttgatgcggccgtggaacatctgctgcggcaggcagcgcagcggcgaagggagaatccgggcaccatgtacgtcggcaccgtcctgcagcatctcgtcgcggcaaagctcaccatcgttgctccggaagtggaaatcaacggcgcgtccgttgctgatgatccgagtccgcggcttccaacggtgaggccgcggaccgtctcacaaaaccgtccgcggctccgccctcctgtttcgtcgcaactgactacaccgacgggttcgggcgcttcgtcacgaaaacgccattgcgatgcaccgtatacgcgccgccgtcactgccccgttccgcccggaacaggacgatcggctcccctgcgatgtcgcgcagttcgacatccgatctgccacgtgtcagatagaagtcgaatatggcgtcgtcggattgacgcacggtgtgcagaacgtcagaggtcacgccgctggcgggcgaccgcaggttggcttccggctgccggccatcctgcggctgcgcggcaagccaacctcccacgaatcgcgtcagatcgctcacgcccagatcgcagccgaggaaatacgcctccccttcgccgtacgtgttgcgggtgatcgcggccatgccgtcaagctcccactcatccgcttcttcgccggcatacgaggcaagcacctgcacatgcggtccggcgacggtcacgtcaccgagcttgtcgatgacgcgatcgagccagtcgaaatcccaatggtcttcgatgggctggaggcgatctcagctgaagatggcaagggccacggtgttgacgccggcctggcccatcaggcggatgtcgtcatcccagatttcctccggccattggtcgggactatagtcgccaccgaaagcgatgccgcgtccgtccgcggtcagcagttttggccatgcgaagtcacgtcatgcacgcacggttatctcctttggcaggcggcgcagggccacggcccatatcggataccagctgatactagctgatagacactcctggccgatagtcgacacgccgccggttccggccccactgccggaaccgacatgggtatgttcatgaccgccgaccgcaggaacgaacaggcccgtccgccacggaccgcatcttgcggttcaggcggacgggccttatgggaagggatgggaacgggagatcagttcttaataactgcctgcgcctcatcgtcgacgatctcgccggaagcgagcttggcttcgagctcctcaacgatctgcgcatgcatcttctcatcgatcttgaccttgaaccagaacacgacgaggctgaggatgatgaaaacaagcgggacgtagaaggcgaaggtcttgaacgtggcgatgttggacgcggtcatgtcggctgccgtggcatgaccggtcatgccagccgcgagggcaacggcaccgaccgcaccgttggacatcgcgccgccgatcttgtcgagcatgggacgcaccgacaaggtgaccgcctcgttgcgcttgccgttcttcagctggccgtactcgatggagtcggtcagcgacagaatcgcggtcatctggatgaactgcgcaggcacatagaagaagatcagggcgacgatgacgaccggcaggttgctggagaacagggcgagcatcgtgtagccgatgatcatggagaccatgccgccggtgaacaggtagcgacggggaatccagcggttgagaatcgggtacagcggcgccatgatgaatccggcgatcagcggaatgatgccggtgatggagaaggcggcaggctcgtcaagcacgaacacgaagaggtagtacatcacaccggtcgtgatgacgtttgcgatggcgtacagcaggtaggacagggcgacccacagcagctggtcgttctggaacagcgccttgaacgcctcgaacgggttgccgttcttctgggccttggcacgcagcgcgctggtgctttccttggtgccaaaggcgacggtccaggcggtaatcaggccgaggagcgcgacgatgaagccgaaggaggtccatccggcctggccctggcccttggcgccggtgaacgtccaggtgaagtagctgacgatcgggatgacgatgacggtgatgccgttgtagccgatagagccggtgaaggtgccaagggcggtgtaggtggaacgttcgtgggagtcggaggacaacgccgggatcatgccccagtaggagatgtcacgcagggagtagaacacgtcaagcacgatgaacgtgatgatgaacagcacgatgaacagcgtggtgttcacgttgaccagtccgaacatgccggagaagatgagcatgatcaacacggaggagaccagtccgccgatgaactgccacgggcggaaacggccccacttggtggtggtgttatccacgaggttgcccagcagcggatcgatgaagatctcggcgatgcggataacgacgatcaggccggtgatgacggcgatcatttgggcggctagagccttgctgtagctgacgaacaggcagctggtgacgtacgtgacgaagtacgtgctcatcgcgttgtagaaggcagcctgccccaagttgccgcacgcgtaggcgatgcgctggcctaacccgcccttcctgcggacgtcaccgtccgcgacattttcgttgctcattaatcttctccttaagaacccagagcatggaatcactcattgattttgtaaagtatagcatactagttttatcaccgtaagcatacaagttttatcaccgtaagcatacaagttttatcactgaaagtaaaaagcattagtaaacaaggagataaacagcgtgtcgcaaggatgggataacatgagctgaaccgagacattgcatggacgcggcgtagcgtcgacggcaagcagtgccagtgatttggaagcggtaaacaggatttgcgttttatataaaaactgtttatccttttcggtaaaggaggccccggcctcttccataatatcattcacaacgaggtaatgacagaaagcaggagagcatgacagacgtcacacatgtcgatcgcgcatcgcaggcttggctgaccgacccgacggtgttcgaggtgaaccggactccggcccattccagccacaagtggtacgcccgcgacccccagagcggacaatggtccgatctcaagcagagccttgacggcgagtggcgggtcgaggtcgttcaggccgccgacatcaacctcgaagaggaacccgcgacggccgagtcgttcgacgactcctcgttcgagcgtatccaggttccgggccacctgcagacggccggtctgatgaaccacaagtacgtgaacgtccagtatccgtgggacggccacgagaacccgttggaaccgaacatcccggagaacaatcacgtcgcgctctaccgcaggaagttcaccgtctccgcccccgtggcaaacgccaagcaggccggcggatcggtgtcgatcgtgttccacggcatggccacggcgatctacgtgtgggtcaacggcgcgttcgtcggctatggcgaggacggcttcacgcccaatgagttcgacatcaccgaactgctgcacgacggggagaacgtcgtggccgtcgcctgctacgaatactccagcgcctcctggcttgaggatcaggacttctggcgtctgcacggcctgttccgctccgtcgaactcgccgcccgcccgcatgtgcacatcgagaacacgcagatcgaagccgattgggatcccgaggccggcaccgcctccctcgatgccgcgctgaccgtgctcaacgcggccgacgcggccacggtccgcgcgaccctgaaggacgccgacggcaacacggtgtggcagacgacgggcgacgcggaggcgcagaccgcgatctccagcgggccgctgcagggcatcgccccttggagcgccgaaagcccgacgctgtacgagcttgacgtcgacgtcatcgaccaggcgggcgacgtcatcgaatgcacgtcccagaaggtcggtttccgccgcttccgcatcgaggacggcatcctgaccatcaacggcaagcgcatcgtgttcaagggcgccgaccgccacgagttcgacgccgaacggggccgcgccatcaccgagcaggacatgatcgatgacgtggtcttctgcaagcgccacaacatcaactccatccgcacctcgcactacccgaaccaggaacgctggtacgaactgtgcgacgagtacggcatctacctgatcgacgaagccaacctcgaagcccacggcagctggtccctgcccggagacgtcctcaccgaggacaccatcgtgccgggtagcaagcgcgaatgggaaggcgcctgcgtcgaccgcgtcaacagcatgatgcgtcgcgactacaaccacccgagcgtgctgatctggtcactgggcaacgaatcctacgtgggcgacgtgttccgcgccatgtacaagcacgtgcacgacatcgacccgaaccgtccggtgcactacgagggcgtgacccacaaccgtgactacgatgacgtcaccgacatcgagacccgtatgtactcgcatgccgacgagatcgagaagtacctgaaggacgacccgaagaagccgtacctctcctgcgaatacatgcacgccatgggcaactccgtgggcaacatggacgaatacacggcgctcgaacgctacccgaagtatcagggcggcttcatctgggacttcatcgaccaggccatctacgccacccagcccgacggcaccaggagcctgcgctacggcggagacttcggcgaccgtccgtccgactacgagttctccggcgacggcctgctgttcgccgaccgcaagccttcccccaaggcccaggaagtcaagcagctgtactcgaacgtccacatcgacgtgacgaaggactcggtgtccgtcaagaacgacaacctgttcaccgccaccggcgactacgtgttcgtcctgagcgttctcgccgacggcaagccggtctggcagtccacccggcgtttcgacgtgcccgccggtgagacccgcacgttcgatgtcgcatggccggtggcggcgtaccgcgccgacgcccgcgaactggtgctgcaggtttcgcagcgtctcgccaaggcaaccgattgggccgaaagcggctacgagctcgccttcggacaggccgtggtgcccgcggacgcgatcgcgacgcccgacacgaagccggccgatgggaccatcaccgtgggccgttggaacgccggcgtgcgaggcgccggacgcgaggtcctgctttcgcgcacccagggcggcatggtctcctacaccttcgccggcaacgagttcgtgctgcgccgtcccgcaatcaccaccttccgtccgctgaccgacaacgatcgcggtgccggtcatggcttcgagcgcgtccagtggctgggcgccggccgctacgcccgctgcgtggacaacgtgctcgagcagatcgacgacagcacgctcaagggcacgtacacgtatgagctcgccaccgcgcagcgcaccaaggtgaccgtctcctacacggcccacaccgatggccgcgtgaacctgcacgtcgaataccctggagagcagggtgacctgcccaccatcccggcgttcggcatcgaatggacgctgcctgtgcagtacacgaacctgaggttcttcggcaccggcccggaggagacgtacctggaccgcaaacacgccaagctcggcgtgtggagcaccaacgctttcgcggatcatgcgccgtacctcatgccgcaggagacgggcaaccatgaggatgtgcgttgggccgagattaccgacgatcacggccacggcatgcgcgtcagccgcgccgatggtgccgcgccgttcgcggtaagcctgttgccgtactccagcttcatgcttgaggaggctcagcaccaggacgagctgccgaagccgaagcacatgttcctgcgcgtccttgccgcacagatgggcgttggcggcgatgattcctggatgtcgccggtgcacccccagtaccatatcccggcggacaagccgatcagcctcgatgtcgacctcgagctgatctgatcagaattgatccgatagtccaccgtgcaaacgatgtggcccccgacttcctcgcaggaagtcgggggccacatcgtttgcacggtccttgttagtccagcggatgcgccggatatcgatgcagatccaaacctagtcgttgtagagcatcaatgaataaagatgtcactcataagctatcaagagaatccagaaccttttttgaattcatatgctcgacacgcaatgtatccagcgtcgtttataatgattcattgtgccttaatgacgcatcgggctatagcgcagtttggtagcgcgcctgctttgggagcaggatgtcgccggttcaaatccggctagcccgaccaaaaaccccggaatctcaacgattccggggtttttccttttatccagttcaaaccgatttatccgattttatccgatgaccgcagaacctacgccgcctcgtccagttcctccgccctggcacggcccacagcatcggccacctcatccagcttctccggccacaaccgcgcatacgtgtcaagcgtgaccatagcgctcgaatgccccaactgggactgcaacgtcttcacgtcgcagccgttggcaatcgcgatgctcgcatacgtgtggcgcaggtcgtggatgcgcacgccggaatcctccatacccgcacgcctgacggccggactccaaatgcgcgacctccacgtgttgacccacagattgccgccacggaccgcacggaacacataatcatcaggatcacgcccatcgcactgacgttccaaaccagccacaagaaattcagggaacgccacccaacgcgccttcccgtttttcggggaaccgagaatcatcttcccgtccttatcctccgcccaggtgcggcggatgcgcgatcgccgacggggaaagtccatgtccttgacctgcagagcgaaggtctcgccgatgcgcggcccgacgtaggcctgccatcgaacgatgagcgtgtcctgcgggtcgttctttactctgccggcctcgatggccagatcctccacctcggaaatcgagagaaataccatgtcgtcgtcatcgtcgacgacgcgcggagtggcgacggactgcatgggattcgcggtgatatatccctgtttcagagcatggccgagcacaccgcccatgaccacgcgcacgatgttgcggatcgaccgtggcttcaacgcgcgagtgttttccgttccgcgttttctgtcggccggatagccgccctccgacagttggttcacccatttctgtatcgcttccgtcttgatgtcccctatgggggtgtcgccccattgggggttgatgtagattctaagttctcgcttgtagcggcgcagggtgccgggtttgatgtcggctttcgttgccgtccactcctcggcgacccgacggaatggcttctgcgcgagcttggggtcgtggtagcggccgcgcctgatgtcgtcctccatggcggctttgaactcctccgcgtccgacaggagccggaacgttttggacttctcggtcttcacgccctgtgcctcggcgtaccagcggcatcgccagcggtcgtactttccgtaggtgctgctgcggtgttcggcgggcaccttggccttcatggggtctttggcgttggcgagactgcgcttcatcgcagcagtcggcggattgccgttctcgtcgtttttgagccaacggtcaacgatgaacactcgtgccataggtatgctccatcttcatctcacgtgctcatagagcagcgccctgtagtcttcgatgatttggacggttatggtgagtacaatggtttgtgtggattgggagtacccggtcggcgaaggtttcggaagtgattccggagcctttcgttttactccggccattccggccagaatccgaccggccctgttgacgttggcgcgttagcagggcttttctttactgcttggcggttttgacggtgatggtggtgccgagcgcggtggtctcccagctcacgccgtcggcttcgctgtaggtgaagtccttggtggcgtcctgcgaggcgagcagggattgagccatggtttcggtgtcgccctggctggtccacttccagtcgccggccttggtcggggcctgataggtgcccttccaatagaggctcttggtgtcggtgccgatccagttgacctcgatggtgtcgccgctgatggtggcctccatgtacgagttcgggtcgttggagttggtttgcttccacgtgccggtcaggtcgtccagctggggtttgggctcttccttattggtctcggtctttgacgtgccatcggatttggccggcgcatcggaagcggcgttgctccctccgcaggcggtcagtccggcgagtaatagtgtggccgcgatcaatgcgactgacttcttcatggttctcttcttctttctcttagagggccacactgtcgtgcagccagtttttgtatgcctggattatccaaggcattacgttgagctcacgcgctatcgcgcattcatcgttgccgtataggatttcggcggtgatgtagtcggcttggcttatgagcattcgagcagcctccgcgtctgcgcgctgctccgtgtaggcgtcggccttgcatccaacgtcgtggtgcttggcgtggctgatctcgtgcgccagcacgcaccgacgctggatggacgagagcctgtcgctgagaatgatctcgttgcgttccacgtcgtatacgccctcaagcccatccggaagcggtcggtcacgtattcgactcgcccactgcagggcgatgtactccaaagcgtcctcgctcatggtatcctccagtatccatatgaacagcccagccgacactcgccgaatgtcgttggtactcaggattgggagcgcccggtcgacaaaggcttgggaacgatcctgagcccttttgtttcattctgtgcgtttctaatttgacttccttgacagtgcatggcagagtaaaaagtactcatccgcctaggtgcgtgaacgagtttcctgggtcgctacggcggcccttgtttattattttattggattatttttcccgcccttttcgcgcggtcgtatctgcgaagctgtccgttatagctgctctcgtaattgagatagtatgccgtgaccagcatgcagtatggcctttccttctccggatgcggctccagtataacgaggtatcgttcggggcgaacgagtatgtgtactcgcgttctgttgcgccaatcctcctcccatatcaacggtttctcgcattgcgtgtaggagcatgaaggacattcctcgcaatagtcgatgctgggacgggggtatctgatgcgctcgcaacggtccatatccgtcatgcgctgtcctgtttcatggtcttcctcggtagtgatatgcacgaaaccggcccatttgccatccgactcttcctcccgtcgtctcacatgcacgggcaatccacggtagtgagggtgggaaactatgaaatcgttctcgaacactgcgtacagtctgttctcgtaatgggagaaggtctcattgacgatttgagacatgagcggcggaacccagtgcggtgtcatgcgtggcctccagtccaggcaaagagattgaatttacgcgcgccaggagtcgtggattgggtgagcttcaacttggatcgattctgtatgcgccagatgatttccctttttgccccagccggtggcttgatgtctgtccgattcgccctgcacacggcaccattgatgacatccacgatttgcatcatctgcacttcatccgatcgtatcggctgtatctttttaatgcacttatgatcgaaatcataatggctgttcgcgcatatctcgttgagcttggcagccctttgcgcggaatgagtgtctttgacatccagatacacgttgtatgtgttcgatgaatcaaacaacctgttgagcatggtgaaatacatcttgtaataccaatcattatgcgattggttataatcttcatgccgcagatgggtcttgtcggcgacaagtaccctgaaccgcatatcgtcatcatcgaagaagtaatccacgagatcggtgtataggccgatttttggttcgctcgcttttgtccatttcacctcgacatgggcggagacgccatgcttcgctttgatgtctacgatcctgtccttgacctcttcttttttgtcctcgggcaggatgagcgcgcccaataccatcacattgctgttgtcccgctccaggtggcagctctcgtcgcaatacaggttgtattcggtcatggtcactcctttgcgattcgctcaatctgtatggaaattccggataactcgctcatggcatctcctcgtaggcttcctgttccgcctcgatgtcgccatgcttcgcggccatcgcatagtaatcacgagcgttcgcgtcatccgaatcggacgacaaattatattcgcccatctcagcaatgagcctccgatatgcggcatctataatgtcccgaggatcaacaccgattaactcgcacgtgttcagcaacgcttccataggcattgatggtttagcgttgagccatcgagagtaaccggacttcgaatgcccaagttttacggccacttcagcctgagaggtttcatgtctcgcaaaacttgctttaagctccagtccgacaagttgcgaaaacctgtggctgcgttcgtcctgaatattactcatgtgagtactttacatctcaaattaagcaattgcaattcacaaaacgcaataacgttgctcaaatgagacacgccgacgttgaccgtggttgtatcgagatatagcattgctcacatgagcaacgttaatgcatgggtcggccatcaagtcgaaacgaaaatacagcaaaaaggactgacgaaaaagttcgtatcagaaaaatctggtatgccatacagcagtcttaacagcaaaatcaagggctatcgaggatttgaccttgatgacatcgtggcaatcgctgaggctatcaacgaatctcccgctgcgttacttcctccccaattcactgctcctgcaatcgctagaggtgcggaatgagttttgaatcgtctttgaatctgaagctcaggctactgctcgacggcctgcgggtcggggaactccaccgcttggacaacgcgatgcttgacccgcaggcgctcgccgacgtgctcggcgcggacgacttcgcccagctggaacaggatatgaaccatgaggcccgactgctccaactcgacgccgtagcccgcttctgcctacaaatccttgactcggccctcatccgtcaaggcgaggatggtctcctgcgccccgtagccgatgaagtgcacggccttggcaagttcccttacctccgcgctctgtgcgctttccttgagccggacggcgatattcgttccggtggcgatgttattcagcgcgttcctgagcaattccctctgggatgcgaccatgatgcttctcctttgaatgcgcgccatgccctttacacggcgcttaccagcattctaggagaaaacgggggcgacagcttctccgccgcccccaccaacactccaacgctcactgctgagaacacccttccggcgctcgccgaaggaggtgcgaaatgagaaaaatgagcaagggcgatgtccgggagtggctgcccggtgagtctcttgaacgggttgacttcggcaacggcgttacgggaatggataaacgctgcccgaaggacgattccgactggggattgaaacaactcatgtggaaatgcgctgcaatcgcggcagacggcgggcctcacgtgaaagtggcattctgcgattattggatcgacggacaaaaggtaccgggacagttccaagtgagctggacgggacatacttcatccaccggcggattcgactcgacatggtcgtatctcaccggactgcagaacggctacctcatggcggatcatcactgttccggcttgtatgccactctccgaagcttcttcagcggcatgttcggctcgtcgtcccaacgccatgagaacaccactggaaccgggccgttggtcacgtactcgatggtctcggacggctcgaacgaatccggaatcttcgttcgcaaccgaagcacatatgaatcatcatcaagcgtcaccgactccacgtacaccctgcgagaaccggtgattgtcacacgtcgtatggatccgcgaacccattccgcctctccgaacggcggcttgtcgaactccgcccgttgcatggcggtctgctcgttcagactgtcggcctggtcgcgcagggcagctatctggcttttcagtaaatcgatgtcatcacgccggtcgttgtcgcgttccttggagcttctgtgctccatgacccatccggcaatcgtcacgaccagggtcagcacgaatccggcaagctcgacgccatgttccgcaatccaattcatgaaccacacactacatcaatccaacatccttgttctcgctggaggtgcgaaatgagtggccagaatctcgtcgacgttctgcagtttgtcttgattgtcataatcgcgggagtacagattatgcatttctcctatatcaggcgtctttcggacgtgctggaatcttgcctctcccatacacggccatctccgattcctccggacgatattcgaactgattgccgatctccttggacaagagatatttacgggaacagcgtggatcgtgccgatacacgggtgagggacgaaacacgacctttacccagcaagtctcccaggacgcaaaagaaggcttcatcgtgaaaacgacatgttccccggccttgatgcatcccgcctcgaatgtctcccaacactcccactccttgcctgtatccggattgacgccattgcatctgatcagcctcacgtcatacgcatcggcatcaccggtgttccacaactcgagattaagcaccatgtctttcttctcgccggcgaagtacgtgggatgcgcttctccgacgaccagccattcgaccgttctgcgatcccatacacgcagaatcaccgtcaccgcgaaagacacgactgcggagaccagcgcggtcacaagaatctgtcccaaatcaatctgtcccaaaaccatgcagaaaagcgtagtcgctttcctgggcgtctggaacatcgtccaataccttgcaaaggaaggtacgaaatgagtggatataaggcaacccctgcggtgcaagcgcaggggtgtggtcacggcccgttctcagatctgttcgaagctgatggggcatccgggcgtccagtacgcagttacgtcgttcccggaatccgcgagcttgccgctgaagacgacccctccttgcgtcctggtcgacgtggtgagcttctgggagatcgcctgcgtttcggcgtcgtcgaacggtccgatcagctcgtcgttaaaacggatattccattgcgccatgtaatcacctcccttctttgcgtgggtgccctcattgtctcgctcgaactcgccggcaaggaggtgaagtgatgggaaccgtcagcacccgcattgaagaaggggacggtttcaaagtcctgagatacgggctcggaagcatcgttctcatcatcggctatccccagtcggaaagcgacctgatcgacgcgcgagatgccatcgccaaacagttcgattacgaaatcagcatgaacgggcgacggcacggcggacatcgttccgtccgcgccgccgccatgccggagtcagtcgtcgatctcaaccagcgaccaccacagggcggcacgcggattgagatagataagagacccctcggggacaccgagagcccgacctcgaaccgaaaccacgccacccgacgcggcggcgctctccaattcatcgagaatcttcgacggatactcttctcccgctaaatcgacaaaccgtcgcttatcggcggtcgtctcaaacacgagtcgatacgtcattattcttcacctcctctcattgctggtagttaggcaatgtccagcttaggggaggtgggccaacgcataaaaaggaagaaaaccaatgagcgagaaactcaccatcgcgaaccccgaggacgggaaccgtcccctctcctatcaggctctcagccacggcatcgacgaaatccgtttgggtgacatgggcatcacggacgcggtgtggcgcgggccgcacagcgagctcgtggcgttggcccgtcgaatcctcgacgcggaggccggacgatgaacgcccgggattacggacagcacgcgagcggctaccgcaggcccgagctcgacgaattgcctcgcggcttcatggtccggttgattctctgggccgtggttttcgccttctgcatcggctgggtgatgtcgcacgccggttgcgcgcatcccatcggcaatggtttggcctcccttgtgggattcggttgcgcgccattgcggctcctgtgccttgcgctgagcgaggcgggagtcgaataacaggcttgccggggttcctgttctttccttccccggcaatcgacaaggacagtcgttaacaccatcgcgccgcgctcggagcagcgggtgtggcgcatggggccggcaggttcgcccccgctggagatcacggtgtcatgtacgtggcaaacagcgggaagccgttcgattcggcacggtccacccccccatatccaccgacatcgaaggcccctcatacgggccggaaaggagaaccatggccgacgaaacagaacccgcgatgttcgacgcgttggaaaaggcgctgatgccgttgaacagcgcacgccagctggccgagctcagcggcatcggcgaatccacgctggccgaatggcgcggaacgcacacgggacccgcctacgtgaaatccggccgccgcgtcctctacccgaaggaggccgtgctcggcttcatgcgcgccaacctgcgcgaatgcaagaaggccagcgcatgaccggccagccgaacgactacgagcatcgcgccgagggcgagtccacgttcgaatggccgttggattccgcggggatgcgcatgagcgcgggcgaactattggacagcctgctcgccaccatccagcatctcaaccgcacggacgcatggccactgaccatactgccgccacgctggacggacgtgatggtcgaccgggaacgccgccagatctcggcggtctgcctgtggaaacgaaaaccagccaaaaaccataaggagggatagatgtgcgagaaacccgaaaccgaaaccgaaaccgtgacgccgcgggtggccttcgccaccatattgcagtcgctggtggccgagtcgccgaacaagcccacgctgcccgtgatgctgtccatgcttgaccaggcgatggatcataccgggctgcgactggagctcgccgccgcgccggcggaccatgaggacgatgtggcgaaagccagccgccgcctctcgcgcagggcgtatgacatgacgagcctgctggccgacggcgcggccggcgccggcgactgggagctgttcgacctggccgacgaggcgcgttccgccgccgttgcgctgctgcgcgcgttggatggtgatgcgtgatggcgggagagaccgttcttaccatcgtcggcaacctgaccgccgaccccgagctgcgtaccacgggcggcggggcgaccgtggcgagcttcacgatcgcttcgacgccgcgcaactggaaccggcaggccaaccagttcgaggacgggcaggcattgttcatgcgctgctccgcatggggcgacatggccggccattgcatccagtccctgcacaagggcatgcgcgtgatcgccaccggccggctgaagcagcattcgtatcagacgcaggacggctcccagagaaccgtcatcgacatgaccatcgatgagataggcccctcgctgcggtacgcgaccgcgcaggtgacgcgcgtgcagtccggacgcggctactcgggcggcagcacgtatggcgacccggccaaacccgccaaccagcaacagggctggcaggacggctccccgactcccgcgcagaacctcggcgctcccgaaggcgacccgtgggcgcaggcgccggccacgacgcccggcaccgcgttcggcgtttccaacgatttcccgtcaaacgattccgaccccgaattctaaggagattcaatgtcacgaaagaaaaagaccgatggcgtgcaggacgcgctgatacccgacgagatcacgccgctcatgctgctcgccctgacagccaaggcatcacgcatgaaggacgccgcggccgcgttccgcatcgcggccagcaagatgctcgacctggccaccaaggatgaatacatcgaaaaatacaagaacattgaccccatcaccgacgccttgtacgacgcctgcgatctctcgcagcacatcttcgacgccgccaacgcggtcaacgacctcattaactatccggtcgaggcccgcgagcgcgtggtgaaggcggatatcgagcgcagtttgttggatccgtggcgtgatttgcccacttcgggtggggatgtggatccggataccggtgaaatcaaggaggactgaatcatgagcaaacgcaagcacggacgccagcaactggagcatgagcgccaacgccggcgcaggaagcgcatgccgcacctgcccgtacaccagaatctatcgatcaaggagcagtgacccgattcagtggctatcaacatcatcgatatcagcgtaaagagcctcatcccgaacccgaacaacccccgcaaagacgtgggcgatgtcaccgaactcgccgacagcatcaaggagcagggcctgcagcaggcgcttgtggtaacccccgaccatgaggagcacggcgagcgcctgtttcgtgtggtgattggtcatcgtcgtttggcggcgtgcaagctggctggcattgagcgggtgccgtgtgttgtgcgtgagttggatgcgaagaccgagcgtgagctgatgctggtggagaactgccagcgttccgatttgacgccgttggaggaggctgacgggtatcagggtttgctcgaccttggtgccggtgtgggggagcttgcggcgaagacgggccgttcggagtcgttcgtgcgtggccggttgcggatcgcgcgtatccccgccgatgtgcgttccgggtcggaggcgttcgctcagttgtcgctttcccagttgggtgatcttgcggagttcgaggcttatcccgacatgatggctgagttggcttcgatggcgggcaccaagaactgggattggaagcgtggccagctgcggtcgcgggttcgcgtcgaggcgtggcagcagagcatgagaacagcgcttgaagctctgggcctgactgtggatgtctcggcttcgacgtggacgacgccggagggctaccggttctacgacgtgtggagcggcgagcccgaccagttcgagaaatggtggaagaaatggcatgaggcccacccgtacggacagccgataatccgattctccgagcgcaccgtattgtgcttcccgcaattgtcgcctgaggagatcgccgaacgtgacgccaagagcgagcggagggaacgggagcaggcggcattccaggaggcgctggccgcccgcaaggaattcgacaggctggcgtacacgctgcgcacggactggatcaggaagcacgccaccggattcaacggcggccagttgcgcaaggccaacacccgtctgagcctgctcgcgctgaccggcaccaacctatgcgacggcctgatcgcaggggccgaatggaacaacatcgacaacgtgctcgccgcatacaacctgctcgccgccacgccgctgccatgcgacgacacgagcgataggggactgtggcgcgaaacgaacctcgcggaactgcaccgccgccagcacgtcgagggagccgcgaacagggaactcctgctcatcctgtgcgcccagatcgaagcactcatcaaacccggcacatgggccgacaaggacgacatcgatctcgcgcaaacctactaccacacgctcgcagacctcggataccccaccagcgacgaggaaaacaaggcactcaacgggtgtttcctgcccgaagacgacgaggcggagtgagccatgacatggacccagatagacgacgggctcaacttcagcccgcagaccatgcccggcacggtatcaaacgccgcgttgggcctatgggtcagactctgcgtgcacaccgcgtaccagctgcgatttcccgcattcgacggcgcattcgacctcacggtcgtgcgctcgctgaaaggcaacgcacggcaggtgacggaactggaggccgcgggaatgctcgaaccggcgctcgccgccggccggtggatggtggtcgaggccgacaccctgatgaaattcggcggcacttccggcagcgaactcaaggagaaaagagccaaggccgggcatgccggcggcgtcgcttcgggcgagtctcggcgaagcaaacgcgaagcaaatgcttcgaagcaaaacgaagcaagtgcttcaagcaaaccgcgaagcaagaccgaagcaaaccatgaagcaaaagacgaagcaaacggtgaagcaaaaccgaagcaaacgtctgaagcaaaacgaagcaattgcttcgaagcaaacgaagcaaccggtcctaacctaaccatacctagccttacctcccctgtagccccctccgcgccgaacgccgaaccggagtcggccgagccgagccaagccatggccgaatccggccacgccaggccggtgacgagcctcgccgaagccgaggccttggccgaggccgacccgttcgcgttcgcctgggaccggtacccgagccacaccggcaatcgggaacaggcccgaaacctgtggcgggccatcaccggcggcgacccgaccgtgccgcacgtcgaggccagccaactgctcggagccgtcatccgctacgcccaaaccgtgcgccaggacggcgaccggttcacgccatcgatgcgcaaatggctcgaaaaccggcaatacgtcaaatggctgtcaaacacaccggcacacaccgaatggggcggcatcacccgccaatggctcaaccagcacgccatcagccaagtcccctcaggcacgtggacggacagcgtcgaacaaacgttctgggcccacgtcaaaaccggcgaagagccggagaccgtggccgcaaggctcgtcaaggaaatcaacgaaaggagccaggcatgagcgaccagcccacatccgagaccctgcgcctcgtggaaggccgcgagtccaaccggtgcatcgtgtgcgaccgatacctgcgtgcgggaaactggcccggcatgagccaccaccacaggaaacgccgcagccagacatacggcgaccccgaacggcacagcccctcgaacgtcatcgacgtgtgcggcacggacaacagcaccggatgccacggatggatccaccaacaccccgaacaagcccgagcattgggctacctgctcaaaagctacgaccccgagccaagccaagtgcccgtgtacagctgccggcgcggctggatactgctcgacaccgacggccaatggcattcatgcccgccacccgaagacctccccacccacatcaacatcaagaaaggcaacgaatgaacgacaccacgacaaccctcgccatcggccaccggaccatccccctcgacccgccccgcccgccaagaaaacccgacatgctcctctgggtcgacaccgaaaccaccggcgtcgacccctaccagtgcgaactcctggaagtcggcatgcaagtcaccgacatgaccggcaaacacccccacgacagcctccacctgatcgttcaccccgacaacatacgcaactgggccaactaccccgaactcctgaaagcctacgaaatgcacctcgccaacggactcatgctcgccgccgccgaagcgcccaaggacacctacgactaccagcacaccgcatggaacatccacgaattcctcaacgaccaactcagccaatacacactccaccccgccggcaccaacgtggacttcgacctacgccaactcgacgtccacctcagccgccacctcaaccaccccatcgccgaaggactccaccacagaaaactcgacctcaccaccctgcgcctcaccgaccaagccatcggccgcgacccctaccagaaccacgcaggcacccaccgagtccaagactgcatccacagggacatcaacgactacaccgcctacctcgacatcatgcgagccggacaccaaggaacccaatcatgaacaccggcaaacgaatacccgcaaccctcacggcgatcctcgccatcctcgcgctcgctgcatgcggagaaacacccaaaggcggcggccagggcaccgtgaacaaccccgaccccggatacgtccgctggtacgaactgcccgacggcagcgcggccgtccgatgcttctccgactccggcggagcgtcatgcgactggggacacatcgaactcaaggacaagcaatgagcacccacaccacaacccccgccccgcagaccatcgaactcatccgccgcctcctggaagcagcccaccgacccgaaccggccaacgatccgaccatctgcgcgatctgcggcgtaccgctcaccgacaccacgtcatccatctgccccgactgccgggaactcgaaaaggactggtaagcatgcacgccaccacatgggccaacgaccccgtcaactcaccaaaccactacacacgctcgcacccgggcatggagtgcatcgaactgaccgccgacaccagcttctgcctcggcaacgccatcaaatacctctggcgctaccacagcaagggccgacccgtcaaagacctcgaaaaagcccgatggtacctctgccgcgtcatcgaccacgacgagaagatcgcatggacacgccaacaacacgccatcctcgacaccctcgccaacgatcccaccatccccgacgccgaagcgcacacatgggcgaaactccggcaaggcttccccgactcggccctcgcctgcctcgaccgcctcatcgaacacgaaaggaaccaacaatgaccaaccccaacacctacaacacggcctgcatgaccggtgtcatcgacaacgtggacttcacgctacgcgacgactccaccagcgtgaccatgctcatcccacccgacacacccgtaggcaccagaaccatcatcatcccccaaggcttcaccctcgccgaacaccggatcatccgcgaagccatcgccgacgcgctcgccgaccacggggaggaactatgagccccgaaaaaccagacgctttgctgtggatggacgcggagaccaccggattggatgcgaacatgtgttcgatactggagatcgggttgagatgcaccagcctggacgccatgcacgaatacgggcggttcgaggccgtggtgcacatcggccgagaaaccctgctgaccgtgcagccctccgccctggaactgcacctgaacaacgggcttctcgcccaatgcgaatcctgcgacccgttggccaactcacccagggtcatcgccgaacaggccctgtggttcatccaaggcatggccgccacgtacaccctgcacccggccggcacgaacatcagccgtttcgacctgcccatggtcgaacgcttctgcatgacgggattcggagaactattccactaccgcatgctggacgtcaccgcactgcgcctcgcagccaaagcctgcggccaagacccataccagcaccgcatgaagcccacgcaccgcgtccacgactgcctggacagggacatcgcggaataccggcactacctcaccctcatgacggggccggcgctcgcagaaaaggaggaccggccatgaagccacgctgcatcctgtgccgcaagcctgtgcccgacaatcacacccgatgcgtcaaacactggctcaacaaccaagaccaatggatggaggacgaccaaccggtacacgagcactgcaccccacgaaggagacccgcatgagccacacggcacgaatctggacacaagaccaactcaccgccgtcatcaaaccggacgccaacggcaaccccacactcaacaccgaactcttccgctccatcaacgtgctcaaggagacaagatgaaagaaattacattaatcaccaccgatttttacattagcgtgctcggaggcacgcgatgaagcgcggaagctggtcggtggaatccaccatcgggctcgtcttcaccatcgccctcgccgtcatcgtcgcgatggtgctggccgtcatcggcctcaccgcctatgcggcaacgaacgtggcgccggaacagaccatcgtccagaaagtcgaaaccaccggcgatgtgcgccgcctgtgcatcgaagccaagaccggcgagcgcgtcgatgccatgtcatgcgatttgattgatccgcatacgggaggtgttgcgaagtgacgagtcaggcgatacgcgacaaggtgctcgcatggcatgggcgcggctacggcgcgacggatacggctcgtcaattgggtctgccgttggaggaggtgcgcgcgatcatccgcgagggcgacggtcggctgaaaccgccatgcaaggtcgagttcatcgaaccgccgctgttcgaggaatgaactggaataccagataaaaacgaaaccctccacacgaggcggagggcatgtcagcaagcaaccagtttagccgatgtggaggggtttcgtgaactgccagaactgcaacaccataatcgaaaacgggtacgcgctgtgcacggcgtgcgagctgcgcttcgccggcacgctcctgcgactcgcgcgcgacgtcacgccgttgcacgactcgctggacgcgaccctgcatccgggcgggcacgcgcccgtcaggatccagacggccactcccccgactcctatcaggcttgacgtgctcgacctgctggacatgctcgatgcgacggcgcgcgaactgtggcgttgcttggatgtcatcgatgccttggattggcacaaggatccacgcatggaggacctcgaggccacgcttatcgactgtgcgggccatcccaggctcgccacgttcgcggatgccggcttctacatggcgaccatcaacggcatcgcccggaaaatcgacctcacgttggatccgccagagcagcgacgcgagatcggcacgtgcgagctgtgcgccacgatgctcaccgcaggcgcggcagaccagtgggttacctgtcccgtgtgcggacgggaacagcgagcgcagacggtcaaactgcgtaggctcaagacgttgtgttgggatgattccaggcgagggtcggcggctgagatagccaaggcgttcacggatgcagggataccggtgcgtaggggtacgctcaacgtgtgggtcaaccgaggcaagctgccctccagccctcagggcctcgcctattgcgacgtgtaccgactcgtgatcggcggagcggcttgacaaaattgtcactgtaaccgatgattgcagtggcagaagtgtcgaaaaacccagctcacgtggctgggttttcgcgtatctgaccgcattgcatggggcgagagtactccgccggcacgtccaaagcgccggtgatgttcgccccgccactcttttcatttgattgtgaggcgatgacgccatgacaatgccaggcatgccgaccatcagcctgcagatcacgtgcaaggggaacaccctcggcgacatcgacgccctgcccgtgcccgtgagcgtcaccccgtccggccatctcgtggtcgaccccctcgaaccggtcatgcgccgggccgtgcaggcgttcgtggacgcctggcagcggtcgtgcgacaaggccgggttatgagcggccgccggggcaacacccgtcatgccaatggctggcgacgccagcaggtcgtggcccgcgtgctggcggcctacgacacgtgccacctgtgcggccggcccgtggacaaatcattgccgccgggattgccgggctcgcccgaggtggacgagatcatcccggtcagcaagggcggctcgccctacctgttctccaactgccggctcgcgcaccgctggtgcaaccgcgtccgctccaaccacagcgtcgcgtgggcgcgcgaacacatcaaacaaacattcgaacaggggcacacggccgacctgaaggccacctcgatgccattggtgacaagcggcgactggtgacgtggggaggagacccgtccgccccggtcgaagccccctcgggcgcagggccgatatctccccggcatgtcaaaacgtaacgccttggacggccgttacgttatcccgttacgtttttttggaggtgagcgcggtgatctgcgaggaatgcggccagccgttcaccccgtccggccgtggaaagaaagcgaaatactgttcggccaaatgcaagcagcgcgcctaccgcaaggccaagcgcatgagccgcgtcaccacccctcccgccccggccggtgacgcggaacatgagcccgaggcgatggacgccctcaccgccgccgatttcgaggcgatgatgaacgacgggcccgaggactacgtgagcgtgctcaaacgcacgcaggcccggctcaaggaagccatgttcagcgccggcaccccgccgggcagcctgaccggcatcagcaagcagctgctcgccctgacccgcgaaatcgaacggctcgaaggcaaccccgcacaaggcatgacgacgcaagaagatccggaggacgacgacgatgacggagaattccgacccgaagctatctgaggtcgcacgccacatcgtcatgccctccggcatcgtcaccagcatgttccccaaggtcaacaagcgcgccaaagcatgcggcatccgctacgaccgctggcagcagggactgctgacgctcatcctcggccgaagagcagacggcacgttcgccgcctccgtcggcggcgtggtgttgagcatctgccgccagaccggcaagaccttcaccgtctccagcctcgtggtcatcctgtgcacgctcatcccgaacctgaccgtcatctggaccgcgcaccacaaccgcaccaacagcaacacgttcgaccacgtgcgcaccctggtacgcaaccccgcgctcatcggatacctcgaccactccggccgcaccgacggcgtgcgcggcggcaacggcatgcaggaaatcaccttcgccaacggcagcaagatactgttcggcgcacgagcccagggcttcgcccgaggcaacgacgccgtagacatcatcgtgttcgacgaagcacagatcctgaccgaacaggccatcagcgacatggtgcccgccaccaacaccagccccaacgcgctcgtcctctacatcggcaccccaccgcgccccgccgaccccggagaagcgttcacggaacgccgccgccaggcgctcgccggcgaggacgacatgctctacgtggaattatccgccgaccgcgacgccgacagcgacgaccgcgcccaatggaggaaagccaacccgagcttcccgcgccgcaccagcgaaaccagcatgctgcgcatgcaacgccagcttggcaaggacagcttccgccgcgaggcactgggcatctgggacgagaccaccaccagccaggccatcaaccccgaacaatgggccaaagccgccaccggcacacccaacatcaaaggactgatcggctacgcgctcgacatgaaacccgaccgcagctcgctggccatcggcggcgccgtcaaccacagggacggcaccgcgcacatcgaactgcgccgcttcgaggccacccaatccaaaggcacccaatgggcggtcgactacatcgccgaccactggccgcgcacagcaagcgtggccatcgactcgcaatcacccgccatgagcctgctggccgacctcaaagcccggcacgtgaaagtcatcgtcaccaactacagcgacatgggccgcgcctgcggcaaattcctcgacatgctcagagacggcaaactcacccacctgccggacgacaaagcaccggcgctcgccacggccgtggccaacgccaccacacgcagcatcggcaaatccggcgtcgtcggatggaacccgatgggcagcgacatcgacataagcccgctcgtggcatgcacgctcgccctctacggcaccaccataaccaaacgagacccggaccgagtacaggaggtcatgatcggatgagcgaacaatccatcagcttcggcaacccctacctgtccaccggctcatcgttcatgacacacatcgccaacgtgcccgacgacgacatgacggacatcatccgcctactggagctctggcgcgccaaatacccgcgcaacctgctacgctccgcgttctacgacgccaaacaacgcttcaacaacctcggcatcagcatcccgaacatcgtcgcccagaaagccggcgtcgtggtcggctggccacagaaaagcgtgcgcgcgctcgccgacaagagcgtgttcgagggattcgagaccgccacgggggccgacaaccacggcatcgacgagatcatgcgcatgaacgagctcgaaaccgacatgagcgaggccgtcatcagctgctacaagcactcctgcagcttcctgaccatcgactacgacccggacgacaacgagcgcatcctcatcaccccgcgctcggccgactggtccgccgcactatgggacaacgaacgccgccgcatcaaagccgcgctgaccatcaccgacagcgacaaatggggcaacatcaccgcattcaacgcatggctgcccggccgcaactacgcctgcatgaaaaccggatacgggtgggaagcggaaccccaatacaaccggctcgaccgcgtggccgtggtgcccatcgtctacgacaagcagatggaccgccccttcggccgctcccgcatcaaccgcgccctcatgaacctgaccgacatggccatgcgcaccatggtccgcatggaagcgtccgccgaattctactcggtccccaaaatatggttcctcggcctgagccgcgaatccttccaacaggacacgtggagcgcgctcgtcagcagcatcaacgcggtcagccgcgacatcaacggcgacatccccgaactcaaacaggtctcccaggcatcgatgcaaccccacggcgacatgctcgaaaccatcgccatgctcgcctcggccgaaaccgacatcccacccgaacaactcggcatacgactggccaaccccaccagcgccgaagcgctcgccgccgccgagaaccagctgacgcgcaccgcgaaccggcagaaccgcatgttctcccgccagctcctcaacgccatgggcatggccgtgcaattgcgcgacaacagcccgcagccgccagacctgaccggcatccgccccctgtgggcgccgacccgcgaagtaagcgacgcggcgcgcgccgactactacacgaaggtcgccggcgtgaacggctactgggcggattccgacgtgggactggccaagctcggactcacggccggcgagctccaatcgttccgcgcctaccagcagcggatgaaggcgcagaggaacatcgagcagctcagacagcagcggatgaacccgcaggacacggaggcggctgatggcagcgaatccgaaggccccgccggaactgcagccgctgttggacagggcgtacagggactaccagaccgaccttgacaacctcagggagggcgcggccgacgtcatcgagaacatggtcgaccgcgaccctttgaacgtcaaggacgcgatccgcgacttctcccgagacgcctcccagctggcgaacgaatactacgacaccgtgcgcggcctgtggagcgaatacgcgggcgtccggctcgacgacttcgaccacacgcggctcatcgaccccgaccgcgccctctggcaggtgcagggcggcttcaacaacaccgactacaacggcctgacctacacgcaggtcaagaacgggcagtcgcgcgcgggactcacgatcgacgacctgtggcccgatctgggcaacccggatgacgcgatgcagttcgtcgccgacatggtcaacgccgccgcacgcctgaccacccaacgcaacatgcgcatcgacccgtcgaaaccacgatgggcaagagtgccgcgtggagcaaggacatgcgcgttctgcaccatgctcgcatcacggggcttcacctacctgagcgaggactcggcaggcttggagatgcaataccaccgggactgcgactgccagatcgtccccagctggggccgccagacactcgccggatacaaccccgaacggctcaccgccatgtggcaggaagccagcaagggaggtggcgactaccgggagaagctcaagcgcatgcgccgggacaatcccatggcgttcacggacggcgtctacccgacgccgaccatgccgtgggagcagtccgtcaggctcctgtcaatgaagggagagccaaaaggcactgcggaatcctggtaccggcgccagctcgccgtcggcgtcgacccgagcagggaaatcctcgaacggcacgagatcgtgttcctcgagaagttccagaagctgggcgaggaatacgagtggataccgaaaagccatgatggcaagcccagcaacgacttccactggctgagccacgaatgcgacgccgaactgaaatcgctggccggcctgaagtacaggaacgtggcccaacgcatcaacgacgccgtcgtcggcggcgtcgaacagggcgttgtcaaggacgtgtttgtactggacttcggaagcacgaaactgcccgacaagttcgtcaaccaactgtcgctgtacaacgcccgtcatgaatcccacatcaaagagctgtgggtgttcgactcggaaggattccaccaaatcgtattgaaatagaagaacggggataaccccccggattatgtgccggtctcaagagccggttacgtgggatccccgttacctcgattctaccatacggcgggttgccagagaggccgatcggggccgactgtaaatcggctgcatcacgccacgcaggttcgaatcctgcacccgccactccacaccacccgcacgggtggttttttatgcccggaacgggccccatcaaccacaaaggagaaccatcatgcacgacatgccgcactggcgccgattccgcaacaaccttcgtctcatcgattccggcgcgggcgaaggcggctccggcgaccccgcaacgggagacccggccgaccccggcgaggacatcgactggaaggcgaagttcgaggagcagcgcgcccactcgcgcaaatgggagcagcgcgccaaggacaacagcaaggccgccgaggaactgcaacagttcaaggactcgcagctgtccgaagccgagaaggccgccaagcgcatcaaggaactcgaagccgccaacgccgcctacgaggcggaacgacagcagaacgagtggaaggcgcaggtctccaaggagaccggcgtgcccgcctcgctgctgcacggcgacacgctcgaggccatgaccgcgaacgcgaaggccatcgaccagtacgcgcaccccaagcccaagggcatgccccaccagggcaagacccccgacggcaaggccgccggcgccgacgaacgcgcatgggccgacgacctgttctccaacctctaaacgcaatcatcccccagaaaggaacaacatcatggcaatggacaccagcaaactccacctgcccaagaccgtcgccacggccgtcgtcaacaaggtcaaggagacatcgaccatcgcggccctgtccccgagcagcccgcagatcttcaccgacaaggaatacatgatcttcaacggcgccgccgaggccgacgtgaccgccgaaggccagaccaagagctcctacgagcaagacctgaactacgtgagcggcaagacgttcaaggtgcagaccaccacacgagtcaccagcgagctcaaatgggccgacgaggacaaccgcttccagatcatccagtccatccaggccgaccaggccgaggccatcggacgcgccctcgactacgtcgtctaccacgccgtcaaccccaagaccggcgggcccctcaccggattcgacgcgctcacggcccgcgccatgcaggtcaccgccggagacgacgacatcaccaacgtcgacaacctggccgaccagctcaacgagacctacgacatcaacggcatcgccatcagccgcacgtgggcctcccgcctgcgcaagatccgcgtgcccgccaccggcatgcgctactacccggagatcccgctcaacctgcaggtcggcaccctcgacggcatcaaggccgccaccagcgccaccgtcaacggggccaaggccaagacacccaccaacgtgctcgccatcatgggcgatttcagcctcatcaaatggggcatggtgcgagacatcacgtccgagatcatcccctacggcgaccccgaccagaccggcgtcgacctcaaagcccacaaccagatcgcctaccgcaccgaggccatgttctcctacgcggtcgtcgattccaaggcgttcgccgtgctcaagacctccacggaagaaggtgcctgatgggcgcgttcacccaggacttcatcatccagccggcaggcaggaagaaacacaagaccggtgccatggacgtgcccgcgcgcctgtggaacccggacggcacgccgttcaccgctttcggaggcgtgaagaagggcacggccgtcgccaccgtggccgccgccgacgcaaccgtctcggccggcgccgcgccgaccaaggccgagttcgacgccgtggtggccgaactgaacgaaacgaaacggcagctgaacacgctcatcggatcgctcaggaccgccggcgtcatcggctaaaggagctccatcatggccgacgaacagccgaatccgttcgccacgcacgaggacctggagaaacgctggcacacgctcacgcccgacgaacaggcgcaggcggccgagctgctgctcgatgcgagcgagagcatccgcaaccacgtgtccgtctaccccgagacccatgaggaatcgtggtggacggcgcatcggcgcggcctcgagattgtgtgctgccagatggtgcgcaccgcgatggagcagcaggtgtccggcgtgcccacgggcgtcacgcagaacaccgagaccaccggccccttctccaactcctactcgtgggcttcgccggacggctacctgcgatggaacaacgactacctcaccgtgctcggcttgggtggccagcgcgccttcagcatcgacatggcatccggggaggtggtctgatggaacgtgttgacgtgtatcgtggcgcggccgaaatggatgccgacgggaacccggtgcagggagagatgcggcatgtggccacgctcatgggtttcgtggagccggtggaggcctcgcagtccccgggcgcggactcgcagggcgtggcccgccgtttcaccctgtatttccgcggggagcccacgggaatcctggacacggattgcctcgtggtgcgcggcaaaccgttgatggtggacgggccgccgctcgaatggtggaggcacgggcttcatatcggcgacgtggtcaacgcgttcgtcagggaggggtgaaaaatggcgaaaaaggtcaaggttgtgctcaaccgcaatgcgttcagctccgaggtgctgcacgaggccgtgaaaccggtcatggacagtgtgcaggagcagatggagggcatggccgaagtgcatccgtccatcaaggtgtaccgcaacgaggacaccgaccgttcgaacgtggtggccacctgtccggccgcggtggagggcgctcatggcgtgctcacgcagatgatcggcaaggtggtcgcatgagcgtgttccaacctcccaccagaacaccccgtttggaacgaatcctgctgaacctgctgcgcgaacgcttcccggatgtcgtgttcggcacgctgcgcagcaggaacaattcggaatccgaatgcgtgatcgtggcggaaccgcagcagaaggcaacacccatcagccagtacgtgcgcgtccgttgttccatctgggtgcgtagggacgacggcaccggcgaactcgccgcctcgcacgagcttgccagcagcatcgaactgtatctgaccggcttgtggcctccgattccgatcatcagcatcgagcatgattccgggccggttcgcatgaccgacgagaacggctgcatctactcgtatctgattctcctgcttcagacgaacaccgtttgaggcagtccataattccaacgattcgttttgaaaggcgatcatcatggctgacaacagttacatcagctcaggcaacaacgccgaactcgtgcgcgccgtcaaggactacgcagtgttcctgttcggcgaaggcgagacatacacgaaaccggcgggcgccgattggacgccgccggcgaacaagctgcccatcggctacaacaccgaggacggcaccaccatccacccggagccgggcgacgagaccgagatcaagggccacaacggcgacgtggtgtattcggagaccgatccgggctactggacgttccggttctccgcgctcgaaggcaagaagagcgtcgtggaactctacacaaactccaccgtggacaaggatggaggcatccacgtcaaggatgcgtctacctccaagaccatgtcgatggtcatcgccggcatcgaccagaaggaacgtcccatcgtcatctacgcggagaagatcaaggtctccgaccgtgacgacatcaccctcaaatccaccgacctgctccagtacaacatgacgctcaagacgttcaagggcagcgacggctaccagtggcatgcgtggggaatggtcgtggaaccgtccgcatccaccgcagcccataacgccacggcggaagccgcggccgaagcctgaccagcttcctcccccgcgggactccgctcttcacccgcggggcttttgattcttccccgcatccaggatggcggtcccgatgcggggaacctcatatccgaccgccaaaccagcaaaaaagaaaaaccgtatcaaggagaccgccatgaccaaccaatacgcgaaggtcgaacccatcatcaacgacgacgaccagctggaggacgtgcacctcgacgttctcggcgtcaaactcgacctgcccaacctcaacagtgccgacctgcccatcgacctcgtcaacgtgatcctgctgatcaaaagccagccggtgctctccgacgaacagaccgcgctcgccatgagcgcgttcctcgcctacttccaacagttgcgtccggactattggaacgcgttgcgcaagaccggccacgccatggcatggctcaccgccaccgtgcgcacctgggccgaacaatccggcctcgacccaaaagcgtttacctcagtgccctccacgccaatcacagggaagcgttagacgccgactggctcgccacataccacaccacatggaagcccgtcacgctcgccgaatggctcaacgcgcccgcggacaggaaacccaaagccaactacggcatcggccaggcatggcggctcacgagacagatcctcaggaaccataccagccattgtttcgcggcgctcgccggctggacgtacacgcccaccggggccgaaatcgccatgtgggacatgttcgaactcgaaggcaggctgcaacgcgaaggctggcgaccctggacggacaggcacgcggacccgttcgcgccgacgcgattggaaaccagccaagcgcgtaaggaacgactcgaacgccgcgaactcctcaagcaacgcttccacatcaccgactagccccgaccgccatcggggagccaacaccactatcaggatggaggaccccgatggcacaggacatcggcaccgtatacgtgcaggtggcaccctccggcaaggacttcggcaaaaccctcgaaggcgacatcaccggcagtgtggacaccgcagccaggaaaagcggaggcagcctcaccggcaccctcggcaaggcattcggcaaaatcggcaaactcggactcggcgccatcggcaccatcaccggaggcgtcaccgcgctcgccgcaaaaggcggcttcacccgcgccctgaacatcgaaaacgcgcaagccaagctcaaaggcctcggccacgacgccaacagcgtcagcgagatcatgaacaacgcgctcgccagtgtgaagggcaccgcgttcggattgggtgatgccgccaccgtggccgccagcctatcggcggccggcatcgcatccggcgagcagatgaccaaggtcctcaagaccgtggccgacaccgcgcaaatctcgggccgatcactcaccgacatcggcaccatcttcggatccgtcgccgcacgaggcaaactccaaggcgacgacatgctccaactgatgagctccggcgtgcccgtcctccaaatgctcgccaaacacctcaacaccacctccgaagacgtgtccgacatggtctcgaaaggcaaaatcgacttccagaccttcgccgacgccatgcaggaagggttgggtggagccgcattggctgccggcgacacgttcagcggcgctttggcgaacgtgaaggccgctctcagccgattgggcgaaggccccggcaagctggcgctcgaatcgttgcgcaagacgttcaacgcggccattccggccgtggacgcgctctcaagccagctcacaccgttcgtggagcagttgaacggcaagctcaccccgtatgtggacagggccgtcaagctcatcgagcaattcagccaggggttgcaggacggcagcatcaccgttcaggacatcgtcggcagtctcggccaattggccggagcgttcgcattgttcgccggggtcggcggcaacgtggacaagatcaccaacgtgttcgacacgctcggcaaactcggtgacggcgggatcggccagctcaccggaaagctcaagcagatgcccggccagctccagtcgagcctgacgggcctgcagcagttcaaatcgtatttcaacaaggatatccgcgacgctctcgccgtggacggcgacccgttcgcgtcggccgtcaaccgcatccggcagggcgcggacaagctcacgggcccgttcagactgctcggcgcgaagatcgcgggctccgatgtgggccagtcggtcgccggagtggcggacaggctgggtgtcggattcggaaagctcaccagcgcattcgattcgaacatcaaggtgctgggctccaaagtcggcaacggcttcggcggcatattctccaagatctcggacagcaagctcgtatccggactgtcatcggtggccggcaaggcgaaatccgccatgagtccggtcgtatccggattgggtgacgtgttcggtggcatcggcgacatcgtgggtccgaaactgcaggccggattgggcaagatcggctccctgttcggctcgttcttcagccccggcaatttcatgaagtacatgggcatagccggcatcattgccgcgttggtcgcgggtctcggcatgctggaccagagcatgcaggggcagttgttcgcgatgataggccagctgtccgcgcaactgccgacactgctgcagcagctgaacatgcagatcaccgccagcctgccggccatgctcgcgcagggcgcggccatcctcaccgcgctgatgaacgcgatcagcacgaacgcaccccagctgatgaccaccgccgtgctcatcgtcaccacgttggtcaacgggctggcctcgcaactgcctacgctgctgccggccgcgctcaacatgatcatggcgctcgtctccggattggcatccaacgtcggacagctgctcaacagcggcatgcagctcctcctcggcctcgtgcagggcctcatgaacgcgctgccgcagctcatcgcgcaggcacccaccatcatcggcaacctcgccagttcgatagccgcgaacctgccgcagatcctgcagacgggcgtgcagatcctcgtcaccctggccaacggcctggccagcgccataccgcagctgatcggtaagatcccggccatcgtgaaaagcatctgggacgctttcacgtcggtgaactggggcagcgtcggcatgaacatcatcaagggtatcgccagcggcgtcgcctcggcggccggcaccctcgtcaacgcggccgtcaacgccgccaaggacgcgctcaactgggtcaaggacaagctcggcatccattcgccgtcacgcgtgttccgtgacgaggtcggcgtgatgatcggccggggcatggccgaaggcatcgaccgcagccaggaagtcgtcaaccggagcctcggcgaactcgccgatgggctcacgttggacggctacacgttcggcatgcccacccccgtgatgagcctgccggccaacgcctgccagatggtcaacggcacgcagtcgaaccagcagggcatgcaatcccagttggacgagctgctggccgaggtgaaggcgttccacgaggatatgccgttcattctgcaacagttgggcatcaacatcgacgggcgggaattcggaagggcggtgcgacgctatgcaaaggcttgagtacgtgtgttccaccggcggctcgatctcgttcgaaggccccatctacggggagacgatgccatcgttgagaggacgcgcgtggacgtacacgctcggcgcgcgcacccttaccggggtggcatggcaggcccgtgaactcacgcttacggtgaaggccgtggacggcgaaacccaattggaccggctgcgcatgctcaccgaccatgacgtgctcgcgcactccagggactccacgatatcgggcctgctgcgcgtggacgacgtgtgggagtgcagggcgctcatcaccaaaagcgaaccgcaatccatcacgccgcgcatcatcgaaacccaattgaccgtgacccaattgggcatgtggcgacgcagcctgccgaccgtcacctatgcgcccagcgaccccgacgcctaccagtatctcgatcacccgtatgacatggactacgattacgggccgccatccgccccaccggtgatagccgtggacgggttggacccgatgccgttccgcatgaccatatacgggccctgctcgaatccgaccgtcacgatcggcggcaaccagtaccggatcaccggtgacatccccggcggcgctcgcgtcgaggtggatgcggtggagggcgagcgttcggtggcgttcgtcaacgcggccggcgaccggatcaactggttcgcgaacgcggaacgcggtgccggccttgattccggcagctacatcttccagccgttgccggcgggccgcgccgaagtgagctggccgggaggctacacgttcaagctcacgcccgtcgaggagaggagcgaaccaccgtggtcagcctcatagtcaccgacgcgaagcacaagccgttgcgcgcggtggacgactacatgctcgatctcgcctacggcagcgatgagaattcgttcaaactcacctgcctgccgcagccggaggccggcgcgctgatcataatcgacggcaccgaatacggcgggttggtgaccgtgcgcaacacggacggcagcgtggagggccccacctggcatggcctgctctcacgccgcatcctccaacccgatacgggtcgggattacctcaccgtatccggcgctgccggcgatgtgctcaacatgttgttcaaacgcatcggattggatgcgctgttcaccgcgtccgcccggcacgcggtcaccatcggctcctattcgttcgaccggtatacggacgcgtacacgggcatccggaagatgctcgccgccaacaatgcgaaactccgtctcatctgggcggacgggcgtgtgaacgcgtatgcgctgcccgccgaacactacggcgacagcatcgacagtgatctgctcgaattcaaagcctcattggactcgcagccggtgaaccatctcatcggattgggcaccggggaactcaaagaccgtgcggtcgtccactggtacgcggatgtcaacggcaacgtgagccaaacccaatcattgaccggattggcggaacgtcaggccgtctacgactattccaacgcgaaacccgacgagctgaacaccgagaccaggaagaagctcatcgaactgcaatcccagggcggcgtcgaggtcaccataacggacaacacgttgagcatggacattggcgacacggtcaccggccgtgacaaccggctcggcatcacgctcaccgtgcccgtggccaagaaggtcgtgaaatcatccggcggcatcctgtccgtggactacgagtgcggcaccgcgtcaggcgatacgacgagtctcagcggctctgcggaatccaacggctccaccggttcgggcggctccggcgcgtactacgcggacggggtcaccatcaccatgcgcaacaacacgttcagcgcggtcgtcaccccttcgcgcgtggacgacgtggagaaaacagccaaggacgcctacacgctcgcctcgaactattcggccgaaatcggcaaggcacagcaggattccatcgccgccatcgccgcggcagccatgaacgtggcctcgataaccacggccacgccattgtccgcgagcaggaacggccaggccgtgcacatcacggcaacggaggccacggccgaaggatccgggctcatgagcgccgcggacaagcggaaactcgacggattggacacctacgcgcttccggccgccaccattgccacgttgggtggagtcagacctgacggcagcaccatcaccgtcaatgaggatggcgtcatcaccgcgcacgccacatcgaccggcaacggaatcctgttcccggtcggctacgtggtcatgaacaccaccggctcggatccggcgaatgatttcggcggcgtctgggaggaacggccctccctgggcgcgcacatgtgggaaaggacgggatgacacatgaagacactgggccgtacatgcctgctcgaggcgaacctcatcctcgtggccggcgtcaccaacacctatcgcctcagatggctgcgcagggtcaccgacaaaaacggggtcacggtcgtcagacccatggacctgaccgggtggacgccccacatacaggtccgccgcgacgggctcaccgtcatcgacctcgccccctacacgctcctggacacggacgggaccatcaccatccgcgtcccggacgaggccacgcaaggcctgcccgcgggcgcgggcgcgtgggacctgctcctcgaagacccctcgggcgacgtgacccgcctggccgccgggcccgcgcttgtcgaaaccaccgtgagcgacaccgaaaggagtccgcattgatccgcgcattggacggctgctcgtgcgacgaggggccggtaatcatcctcgaggacgcgatcatcggcgacgtgagcatcgtctacgccaccgacgcggacatcgacaacctgttcccaacaccaaccacagataaggaggaacacgatggctaacaccagcaaggtcatcgacctggaccggctcgcccggttcaaagcaaagcaggacgcggccaacgacgccaagttcgcactcaagggcgaaggcggctcgatcgccacggccgacaaggcgggcatcgtcaagcccggcggtgatttcgacatcaccgaggacggcaccatcagcctgtacaaggcgatgggcattaactcgttcaccgtttccccatcgcaggcggaacgcggttcgacggtcgcggacgtgaccgtcgcatggagcctgtccaagacgccgaaatcgctcaccctggacgacaaggcgcaggacacggcatccaagggcacgacactctccggcgtgaacctcaaaacgagcaagacgtacacgctcaaggccaccgacgcgcgaaacgccgtcgccacccgcaccgccgacgtcgctttccgcgacaagcgccactggtgggtcgccgccagcctcgacgcggcgggagtgaccgaccagatcatcaaccaggcaaccggcgaactcgccgcagggtacaccaaaacgttcaccctgaacgctgcggccggacagcacatctactacgcgttccccgcgccgtggggcacgccccgattcttcgtcggcggcttcgaaggcggcttcgcgttgttgaagacgttcgaccacaagaacgcgagcggcgcgaccatcagctacgcggtctggaaatccacgaacgcgggtctcggcaacaccaccgtcgaagtgaagtaaaggagaaccctgatggcaatcgaactgatcgacacgctcgcgccgaagaacaacggcacgttccccatggtcaaagccaaggatgtggacgtggacggcaaacgactccccgagaaactcaaggagctcgaaacggctgccggaaacatcgagaccgccaccgacgcggacatcaacaacctgttcaaccccagcagcaagtaacgaaaggaaaccatcatggccacgaaattcatcaacctgaacaacctcgccacattcctcgccaaactcaagaccctgttcgtcgccaaggaactcaagaccggcagcaccagcacctacaaggtgctctccgacaacaacctcaccgacgaactcgtcaccaagatcaataacgcgggagactccacgttctccggcgcatacgcggacctgaccggcaagccttccatcggcggcaaggagatcgccagcggtaaccagaccgcagccagcctcggcctcgccacccccgcggacgtgaccgccgccgccaacaacgcgcgcgccggcgcagtcaacgacgtcaagaatctcggctaccagaccacctcccaggtcgagaccgccatcaccgcgaagggctaccagaccgccgcccaggtcgacaccatcgtcaccggcaagggctaccagaccgccgccaacgtggactccaaggtcaacgccgcgaagaccgaactgcagaactcgctcggctccgcattccgcgccaagggatccacgatgttcgccagcctgcccgcccccgcatccgccaccaagggcgacgtgtggaacatcaccgaccagttcaccaccgacgaccagttcgtcgacggttcaggcaagaccctgcccgccggcaccaacgtcgtcgccgtggccgtcaccaccggcgacaccaccgtcatgaaatgggacgcgctcacaggcatgatcgatttgagcggctacatgcgcaaaaccgacctcaccccggccagcgacgccgaaatcgacgccctgttcgcctaagggaccccggccatggcggaaacatacgtcaccctccacggcctcgcacgggcggtcacgaacctgctgcaacgcaccaacacgcgcactatgttcacggccgcccaccccatcggcgagatcatcgaaaccacccccaacctcgaccccaacacaatcggcggcacatggacacgcctccccgacaccatcggccgaggccgcctctggaaacgcaccgcataaacgtcaggagaacacatgacagtcgaactcatcaccggctacgccggcaccccacacatcggcagcgacgacatcggcgcattccaggccggcatcgtcggacccggcgactacgcgctcgccaccggtaatcagctcagggccaccatgagcaacgcgaacaccatcgccgtccaatcaggcgacgccgtattgaacggccgccatgtgcacctgaccggcaccaccaccgccaccgtgcaatccggcacccaaggccagaaacgcaacgatctcgtggtgcttcgctacacgaagaacaccaccaccggcgtggaaacctgctcaatcgtggtcctcaagggcacccccaccaccggtaccccggcggatccggcccacaacaccggcagtatcctcgacggcgtcgccacccacgacatgctcctctaccgcatcccgatcaacggcatcaccgtcggtaccctcgtcccgctcttcaacgtgctgaaaccaatgaaggacgtgtgggattcgctaacccctatacggtccggcaaaaaaaacgcgacgttcaccggcagcgtcgctgacgtcctgtccgatgcggaataccgtgccctggtcggccggagctacactggtggcgatgtggttgttttcacgcccgtcaccaccggcgtggatacggcgctggtcgcatgctacgacgtgccccataaggtcgtccgcgccatccaggtcggcacccagcagaacatcacgatggatgtccggtttgcggtgatccccgccgtctaacgcgcgccgagaatcctcgtgatggtcaggcactgcgtgtctgacgtgttgccttccatcacgtggattcggtgtccgatgatctgcacgctcgtgtcggcgatccggacgagagtggccttgcctgacgcgagcccgttcacgaaattcatgccgacgaatgagaggacgatcgatcctgcttcggcggcagtgtggaacagcctcgggtaatggtcatcatcattaccctcgatgatcagctcgcggaaatccgtgatcgattcggcgagcgggagggtgccggttttgccgctggcgccctcccataggacggtgggggttagcgaaagctaggcggtcagccagcagccagtacaggtttggtaatatcctttatccgctttgccgcggatggtgatgcttccatcagagcttatataccagctaccgacagcgccgccattgttcgatgcaaacagaatcgacccgtaggaagctggcctgtatccttccgggattttctctatagctttcaattctccggtcgcataactagatgatggcgaaggttggccgaccgctataacgatgcgacctatgcgcatgagtagtacattcatcgcgtaggggccagtaaacgatacagacgattgggttagcgaatccctatccgcgccacatgacggcccagttgacgcggataggtgccgtgtttttaccgtcgaacatgacatcgatgcggtttccggacgggctgacacgcacagaggtgacctgacggccgttcgcgtcccagtcaccgttgatggcggcaacgaccacgtcattgttccagtcgcggccgaactgggttttgaactggccgaacgtccacagggtcgcgtagccgccgctaccggcatccttatagacgccactgccagtgtagagatgcagcggggttagcgaatccctatcaacgtatgagggcgtgctcccatgtgcgttgcgcttcgcggagtacttcactgtctgggcgcaggtagtagcgggctgttgtagcgatgctggagtggccgagtgctcgactgaccaccgccacatctacgccggcgcctaacgcggtggacgcccagctatggcgcaggttccgtctcggcacatacggcaggttctgcgatctgcaccatgtggcgtagcgacgagcgacctggccgggattcaacgagccgatgagtcggccaccgtctcgtggcctgatctcacggagtcgaagtaccgcgaatcgcggcagcacgatggtgcgacggctcaactcggtttttggatctacgattacctcgtgcccgtccacccattgcaggccgcgctggaccctgaccttgccggtgttgaggttcagatcctgccattccaatccgagggcttcttcggtgcgcaatccgaggcatacgctgcagatcagccatgcctcgagctcatgcccgtggaaaccctgcagcaactggcgtatctggcggatatccaaaacctccggttcataaccgctcggtttcggtggcgtgaccctgccggtcacgtccgcatccagtaatccgagccgcaccgccgaacgcagcatctgccgcaatacggcccacgccttacgcgccgctccggccgacgtgatcgagtccagccacgattggatacgcggccctgtcaggtcagccaggtccatgtcacccaattcgggtcgtatgtgacgtcgccatgcactcgcatatccgacgcgcgtgcattcgcgcagcctgccacatgacggccaatacgactcgtcccaatactcattcagcaacatttcatacctccaaaacccacacgcagcatggccgttccatgcggatctgcgtgtgggttttccataccgtaggagccgtgcatgaacctgcccgagggattgccagcatgggcgtacatcgtggtgagcgccctggtgctcgccgcccagatcgtcaccgccatctggatcaaccacagaggggacgagagggatcgggcgacgcgcggcgagataacgaacaaccatgagatgccgttgcgcgacgacctcgacgacaaggccctgcgcacattggacgccatcgaatcattgcgcggcgcggtcgacggtctgcgtgacgacatgaacggcgagttcgcgaccgtcaatcgtcgcatcaccactaccgagcagaacctcatcgaactgcgccacgaggtcaacgacctccggcgcggaggaaacaaccaccaatagaaaggaacaccaatggcaaacaccaaaggcgtggccgaccacaaggccgccaacaccaatatccccggcctgaccgcggagcgcacgaaatccatcgtgctgctgctcgtccagctgttcagcgtcgtccagaccggcctgtccatcgctggcatcagccagctgccgttcacatcggaccaggtgagcacggcgatcaccggcgtcatcgccgtcatcgcatccgtatatgcgtggtggcgcaacaacaacttgaccgtggccgccgtgcagggccagcaggtcgtcaatgccgtcaagcttgcccaggacacaggtaacgccgtggatatgccgggcgaggtcgtgcccatgagcgagatgatctccgacccggacgccaagaccaccacggagtgactaatagtgcagatcaaggaggagatcgtcaacgcagggcacggctacctcaatccgtccctgttcgccgtccacagcacggcgaatcccggcgccacggcccgcaaccaccgggacctgtggtcgcgaggctacgactacgcggtgcacctcacgtccgactggaccgaggcgattcattgcgtgccctacgaccggctgtgctggcaggtcggcaacggcaacggcacgtgcgagggcatcgagatctgcgaggccaccaacgcgtcggacttctggcgcggcatcgacatcgcagccgacgtgatagcccagcgcctccgcacgcacgggtggggcgtcgaccgcatgcacccacaccaatggttcagccagacctacggcggatccgaccatacggaccccatcccgtacttcacgcgcttcggctacaactggggcgccttcgtccaactcgtccaacagaagctatccggcgccacagccgggcaggaggtagacatcatggcaggaatgatgatccgcaacgacaacaccggggtcatctactattgcgagcccggcaagggccgcaccgctctcacacaccccgaccaggccaacctgctccagcaggccggcgtgccgctcatccacggcaacaacggcgccccatggtggggtcgtttcgaccaggtcgacgcgctcgtgcgcaagaccatggaacagctcggcgtatgaaccgcatccaatggctcgtcgaatgcgcgggcctgatcgcagccgtactcgcactcgaactgtatgctgcgctcgccgacgaccaaggcatgccctgaaaaccgaacgccccgctcaggcatcgcagacggctctcatgagcttgactgcggccggacggggccgatttttcacgttgtaggcgcggtccgagacggtgtaaatttatccgatttttatccgatgacctctgaaaacgacatatatcaccgaactcaacgaatgaactacataggcacaaaacgttgaaattccaaccgttttaggtcttacagaatttgatggagaaagacgaaaacaggtcgaatacaacaggatgtcgccggttcaaatccggctagcccgaccgaaagccctactcccgactgggatgtaggattttttcctttttatagtcggatgccatcgctcatttcccctccgccaccgcatcgatctcatcctgacgccgccaccgcttgaggtttggcaacagcgccgacatgcagtcctcggcctgttcgacgctgatatggcaggattccgccatcatcggcgcgcatgcggcgaccaattcatcgctattggcatagtcctgaagaaaaacgccgtcttcatagcagtagttgcaataatctccgtttcgcgttccatccggttcggtgccgtgatcttccgggcggtaaaacggcatggcacaactttggcaaaaaccattgtccggcatttccataagcctcgccatcggcacctcaaaacgggtgctgataagccgaatcatgtcgatgctcggctctgccgttcccttctcccagcgggaaagcgcctgttgggtgacgaacagctcgtgcgcgaactgcgactgcgtaagacctcgctcctcgcgcacgactttgataacctgaccgatcgacatgactacctcccgacatcggaaaacgattcgcgcgtctcgctgtgcgcttgctgattccagtctaagggcatgtcccgttcgccaagcgcgggtacaacaaaccgttgttcgcgcttgtatcccggaggaagaaacagctcggtcgaacctatttcctctccaccccttcaattctcccggttcctctgactcctttgcgagcgccgcggatgggatgagcacgcttacgtatggggttgcgccagacaggacgtcgtcgtagaagcgctgtttggcgtcgatgaagtcgatggaatcctggatttccgcgagctgctcgaccagccgcgcccgcttgccggcgagcatctacttgcgttcggggatgctcggctcgtggaggagcgtaaggggcgcgagtaggggttcgcggctttgctgcggtctctccctcacccggctacaccgggagctccctcgtcagagggagcttaaattcggtctggttataggcccatgggcttcttgggctttttggcgctcatgagcatgaggaagctgcgggactgggcggtgatcatgaagcccgcctcatagctcagcgccggctcattcgggttgtgcgtatccacgaccagctgccatttgcggccgtatcgctcatccggcagggtgaacataatcggctcgtaatgcgcgttgaagatcaggatgaagtcattgtcgaccatccggttgccgtaccagtcgacctccggaatatccgaaccgttcagatagatcatcatggagaacgcatgcgtgttctgccagtcgtccatatccatgatcgagccggtgtggtcgaaccattcgacctgcggaatcatgttcgaatcgtcgccgggctcacggcctgtgaagaagcgacggcggtgcaacaccggatgatccaaacgcagatgaatgagtttggaaacgaaggcgagcagttccttgcgtcccttgtcaagatgccagttggtccaggagatctcgttgtcctgacagtaggcgttgttgttgccctgctgggtgcgggccacttcgtcgccaccgcaaatcatcgggataccctggctgaacagcaacgtggcgaacatgttgcgcatctgacgctgacgcaagtcgttgacgtccggaatattggtcgggccttcaacgccgcaattccaagagcgattgttgctctcgccgtcgcgattgccctcgccattggcttcgttgtgcttttcgttgtagctgaccaggtcgttcatcgtgaaaccgtcatgcgcggtgatgaagttcacggacgccaccggtcgacggccgttgacctgatacagatcggagctgcccatgaggcgtgatgcgaattcgggcaacgtggagggctgtgagcgccagaagtcgcgcaccgtgtcgcggtagcggccattccattcggaccagctggacgggaagccgcccacctgatagccgccggagcccagatcccacggttcggcaatcagcttcacgcgcgagatgatcgggtcctgctccacgatgtcgaagaacgcggacagcttgtcgacctcctggaactggcgtgccagcgtggcggccagatcgaagcggaagccgtcgacgtgcatttcggtaacccagtagcgcagcgaatcggtaatcaactgcagcgcgtgcggcgagcgcataagcagcgagttgccggtaccggtggtgtcgaagtagtgctgctggtcgccttccaccagtcggtagtaggaggcgttgtcgatgcccttgaagctcagggtggggcccatatggttgccttcggcggtgtggttgtacaccacgtcgaggatgacttccatgccggcgtgatggtaggccttgaccatggacttgaattcgttgacctgctcgccgcgttccccggaggaggagtaggcgttgtgcggcgcgaagaagccgatggtgttgtagccccagtagttcgacaggcccttctcctgcaggaaggagtcgttgacgaactggtggatcggcatgagttcgatggcggtgacgccgagcttcttcaggtattcgatgacgctcgggtaggccaggccggcgtaggtgccgcggatgtccggcggcacgtccatgttgaggttggtcatgccgcgcacgtgcgcctcgtagatcaccgaatcgtggtacgagatgtaggggtgctggtcgttgccccaatcgaagtagggattgatgacggccgacttcatggtgtgggcggccgagtcaaggtcgttcatcgccgaggtgtcgtccgggcttttgaaccagtaggagaacaggctttcgtcgccgtcgatgttgccttcgatggccttggcatacgggtcgagcagcagtttgttggggttgcatctgaggccgtgcatcgggtcatagggaccgtagacgcggtagccgtagcgttggccgggctggaggccggggatatagttatgccatacgtatgagttctgttcggtcatttcgatgcgcgtttccgcatcgtgctcgtcgaacaggcatagctcgactttctgcgcaacctgtgagtacagcgcgaagttcacaccggcgccgtcatagctggcgcccagcggatacattgatccaggtctgatctgcatagttttcagtatcccactttcttgtgtcactgatgtgccggggagttgaacgtcaggagaacagcgacggcttgtctttgtcggagttcctgacgatgagtctgcgtaacgcctcatgctggatggcgatcatcgaattggatgaggtgatgcgcgtggcggcaaggtcgctccacggaatccacgcggattccacgtgctcgtccgcgtcgaaatggcgctgctcccgcctgaacgggcccaaatgcaacaccatgatgtgggccagttcgtcggtcatgccttcggacgagtagaaatcgcccacgaagtcaacacccatggtgtcacggtccggcaccacgccggtttcctcggccagttccctcagggccgcgtccatgatgtcctcgccctcgtccatgagaccggcgggaagcccgtaggcgaacatgtccgatccggcacggtattcgcgttcgatgaggtaacggtcggtggacatgtcgtgcacgagcatgaccacacagggggcgtgacgcagcacctggcggccgatctcgtgttccttgccctgcttgtcggtcagagcgatgcgcatgtcgtccacgtggaagatgcgcccggtataaacggtttcgctactgatcactttggcgggcacgtccatgtcgatgccgtccgaggaggcgttcagcttatggtcgagccgatgctccagttgttcctgcttgcttccgccagacatgtcatctcctcggaaaaaacgtttttgccacgttactatagcgtcttaatctcgatgcgcggtaatggacagcgtccatggatcggtcgtgtcgtggaaccactcgacttcaggccttgctccggtcgcttgttcgatggcggctggcacgtcatcgatcgcgtagttgaaccacatggattcgatggcggcatgaggggtgttgatgaagcagggacgcacatggctctcccccgccattccatggccgagcatgatgccttgggacctcatacgggcttcataccgggcttgttcgatggcgtcggtcaccgggtggtgacgcaaatcgctggttacgtacacgtccgcaccggtggcacgtacctcgttgaacagggagtccccggagccaggcagaatggccacatactgaacaaaagtgtccgaatcgccgcatacctggatgccgagcgcgctggtcatgccatgatcggacacttcgtcgaatactcgctgagcgaaatccttcagggcaacaggcttcggcaaacgacccacacgccccaagccgaccggatgagaggcgtttgcatcgtcaatcggcacgagtggtttctggtcgatgagtccgaagtagtcggccgccgcctgtcccacgccgcgatacgcagcgtcggcattagtgtgccctacccacagcccgcagccgtgctggtagagtctgcggacgatgtcgccccggaaaccgagtccgctcgtctcgtgtacggaacggaagaacaacgggtgatgggtgatgagcaggtccgcgccagtagcgatggccttgtcaatgatggcggaggtcgggtcggcggcgaacacgatgcggtgcacgtcgtgactcagatcgccgacaatgaggcccggctcatcccattcctcggcgtagcgcaatgggtacagggtctcgagaacgtcgatgacttgcttgagattcggcatatgtcccattgtagtgggctattgctgcaagggactcattctgcaattgcggacaagccatgctcgtgctcttcattgctcgactatcggctcgccttcgcctacaaacaatccactggactgtttgctcaacggctcagccccctcacccgaggggagctagaaattgtcagtgtgcagcgagttgccagtcggaaccgatgccgcacgatacgtccagcggcacggcaaggtcgacggcgtgttccatggcgttgcgcaccagttcggtgacctggtcgccttctcccggcgcgatttccactaccagttcatcgtgaatctgcagaatgatacggctcttgacgtgagcctcggccaaggtctgctcggcgcgaatcatcgcaatcttcatgatgtcggcggcggatccctgaatcggtgcgttgagtgccgcacgttcagcggcctcacgcgcaacacgattggtcgaatgcagggccgggaagtagcgacgtcgtccgaaaatggtttccgtataccccttctctcgggcattggccaccagcgattcaaggtaatcgtgcaccttgccaaaggtatcgaaataccggtttttcaacgcttccgcttcacgtggcgcgatcttgagttgctgggcaagaccatacgtgctcagaccataggccaatccgtagctcatggcttttacgtggctgcgctggtcgccggtgatctggtcgaccggcagcttgtagaccatcgaggccacgtatttgtggaagtcggctccggagcggaacgcttcgatcagcgcctcatcatcggacagatcagccataatgcgcagctcgacctgtgagtaatcgcagctcatcagggcctcgtacccctcccccggcacgaacacgccacgaatctcacggccggcggcgttccgattggggatgttctgcaggttcggatccacggagctcaatcggccggtggcggcaacggtttgctcgaaagtggtgtggatgcgctcatctgatgtgttggtggcatcgatcagcgtttggacgatctgcttgagcttgttgatctcgcgatggcgcagcaacgctccgaggaaaccgttggcccgctcattgtccactgatttgacatacagatcctgcaatgcggccgcattcgtggtgtatgagccggacttggtgcgtttggtgggtttcaaacccatatcttcgaacagcaccttctgcagctgcttggggctttgcaggttgatttcggtgccggcatactcccaagccatttcctgcgcttggcgagcctcggcggcaaactggtcacgcatggagacgagtcgaacgctatcgactttggctcctgtgtgctccatgccgtgcagcacgcgggaaacaggaagttcaatcgcgcgcatcagccagcattgttcacgctcgtcgataatcggcccgagcgtgacggcgaggctgcggataatggccaaatcacgcagacgatgttcgttcggatcttcttcgacctgatcgtcgtcgaagtccaacgtgccttgcgaaggctgttcggtttcggtgaagtggatgtcgaggaagtgctcggccgcctgcttgaggctatcggcatggaaatccggttgggccagatacccggcaagcttggtgtcgaacatcggcaggtccatgtcaagatcgaccgcgcccaaaagatgcagcaattctttatacccatgcacgatggtgcgggagtgttcgcttttcaggaaccgcgcaagctgtgctcgcagggtatcggtgattggaaggggcactatggccgctgatgttgccgtggccacggcaatggcttgtgccgtggcacgccccggcctttcgtcgccccatgcggccacggtccaagcgtggccgaccgcgtcgccgcagatggcatgccgctgcgagccatcgccatagtcggaaaccgtgaaatcggcgatttcaccgggaaccttgacttcgacgcgatgggccttgacccattcgtcgaactgctccggagcagtgatgctcgtgggttccggcaggttcagatcgaggctgctatcctgctcgttctgctcattattcgtagactcgccagctccggatgtgttggatgccttggccccggtattgaaggttttcagtacacgactcttggtgcgaggtccgaattcaagctccttgaacagggcgtcgatctgtgccacgtccacggtgccgaatgtcagatcctcgatatcgacgcctagatcgacgtctcgtaccagtgcgttgactttgcgattgagtttgacctggtcgatattggcccgcagtgattcgccttttttgccgccgatttcatcggcgtgctcgcaaatgccgtcgagggaaccgaattggttgatccacttggccgcaaagccgtcgcctacgccgggcacaccgggaatattgtcggcggtttcgcctcggagtgccgccagatccggatattgtgcgggagtgactttgtatttgtcgatgatggactgcggcgtcatatgcttcaggtctttgaagtgatggcccgggtacaacacggtgacgttgtcatccaccagctggaaagcgtctcggtcaccggacaataccagtgtgtggtaaccggccttgtctcccatggtggcgagggtggcgatcacgtcgtcgccttcgaatcccggcttctcgatgtaggtgacgccgagggccgtgagcatgcgttgaatcaatggcagctgggtgagcagctcttcgggagccgcctcacgggtgcctttgtattgcggaagcatctcattgcggaatgtgccgcccttcacatcgaaggcgacgcccagatggtcgggcttctccgcatcgatcacctgcgcgagcatggtggcaaaaccccagacggcgttggtggcctggccgctggaggtgctgaagttgtcgaccggcagggcgaaaaatgcacggaaggccagcgagtggccgtccaccaccagcaatgtttcattggtgggtacggtcacgctggcctctcccatagtgtgtttgtgttgctttacgactcagtacggcgacgccgataatcagcgttcgcccgaatcagaaggcttcggatcgccgtacttggcgatgatggcctgagccaggcgcttcttggggatgcgctggtccatggaggtcttctgaatccaacggaaggcaccctgctcggagaagtccgccttgtccatcagcagacccttggcgcggtcgacgagcttgcgctcctcaagcgtgtcttcggccttcttgagcttctcttcggtttccttgagctgatcggtggtttccttgagcttacgttcgctgcgctccacgctgtccagcaaatcgttgatctcggcgaaacggcccatggccacctcgagggtcggcagcagcttggattcctcgtacggcttggtgacgtatgccatggcgccagcgccggtggccttcttcaccagatcggtctgggagaatgcggtgagcatgacgacgggggcgatgttttcatcgcagataatgccggcagcggtgatgccgtccatacgcggcatcttgacatccatgcacaccacatcagggcggtacttgcgggtcagttccacggcttcctcgccgttggcggcctgaccaacgacctcataaccgttgtcttccagcatggcgaccagatccatgcggttcacggcttcgtcctcggccacgacaacggtacgcggaccgtcctcgggcttggccttgcgctcagcaggttcgctttcattggccacggccttgagctcttcgtcggtcagcacctcatcgatgttgatactcggttcttcggacttcttccttgcagccatgccaacctctttcttgaattacccaacaatggggttcacaataatttcagcgaactcctaactaaagtgccctcggtgggactcgaacccaccaccttcgcataccctgccgagctgagggcaattcctcgtcaggaatcgctcctgactcagtttaccctcctgtacatcctgttcgcggtttctctgcgagctttgcccgcacgctgaaccgttcccgttttgtacggcagtcaagagtagcggctgcggacgcggcctgtcaaatatcggcgtgtgggagaatggagtttccgttttcgcggagtgtccacatagatgcagggtttaccaaggtgaccgtgttctttagggtgtgcgctgcgcgaagacggttttttattggctgaaggaggccgaagatggttgaagagacaaagaggcccttgcgccgcaggcgttttgggtgcattctcgaacgcaagggttcgacaggggatgtcacgagcatcgaggctcgttatatctcgccgatcaatggtcagcgtgtgtcgaaacgtttcgcgccgggcaggcggggcgatgccgaggattggctcgagaccgagaggtcgatcgtcgatctgcaccgtcgtgggatgatgacgtggattcctccacgggaccgggatgggaacacgttgacgccgaagctgacgttcggcgtgttcgccgacgggtatgtgcgccggcatcgcaggaaggacggcgccgagatcgcgggctcgacgttgcgtaacctgcgcaatgacatcaagcatctcaaggaggcgttcggcgacgtgaaactggccgagttgaccgaggagctggtgaccgagtggtattacgggccgcatccgaacggggaatggcagttccgctcggaatgcatccggttgaagatgctgttgcgggaggcgtgtgcgccggtctccaagggcgctcctcccctgttggcggagaacccgttcacgctgccgattccgcccgagccggaggctgggtcgtcggatattccgccggtcacgcccgacgaactgtaccatatatataatgcgatgccgggctatacgcggttgtcggtgtatctcgcggcctgtgcgggcggcatgcgcatcggcgaggtctgcggtctgatggacacggacttcgacttggagaacaaggtgctgatgatccgtcgcagcgtcagccatggcgcggatgatctgggcccgtcccggatcggcaggctgaagacgaaggggtcccggcgtacggtgcctatcccggacatgctgattcctttgattcgcatgcatctcgaggatcgtccggaccagtcgaaccacatgttcttccaggccaagcgcggcgagatcctgtgtcagaacactctgcgcaaccacttcatgaaggcccgcaaggcggcgggccgtcccgacctgcagttccgcactctgcgcgtgacccatgccacccgtctcatgctcgatggcagcagtctcaaggagacgatggacgccctcggacatgtgagggaggagaccacgttgcggcattacctgcgtgccgtgccggagcatcagagggaggccgcggaacgcaccgccgcctatctgctgtccgcggacccgtcgctcgcgatcgcctcgctgcctcccgctcccgccgggctggacgcggacggcgatgcgggcgacatggccgcgctggcgttgctgcttggccaggtgtcgacgctgatggccggcatcgccgcccggaacgcgcagccggccggatagcccggcttccgcccgcccctgcggtcacgcgcctatggccggaccgtccatgcccgcatcctgcgcgggtccgggacggtccggcgtttccatgggcatcgcgccgggcagtacggcggggtcggggaacatgttcgcggcgggccatagcccggtcggcccctcgtcgggtgcgggatcgtagccgggggccgtcgcctgcgcctggcggatgcattcgctcacactcccctggaacgtgctctcgcgggtggcggcccggcggaccagatcgaggccggcggcgttgctgcggtccatgtcgacgatgagcatggtcggcatgcccgcgccgaggatcaggtgccggcccgtggtctccacgaggtcgtcgtgcggcgtgatgatcggatggtccgtgacctgcaacgggttggcgggatcgtcgggcagagcgaggtggatgtcctccggcttggtggcggggatgcggatgggttggacggcgagcggctgggcggggtcggggtttctggtggcgatttccccggtgatccatgcggcgttccagtcgtagacgccgaggggtgcgtgcaggtcgggctcggccatgacgcgggcctggagcgcgtgggcgcggatgacgcccctgttctcatgccagtgggagttgaggagtccgatggaggcgagcagctggtctcccaccatgcggcccttgtccttgtacctgttccattccgcggctccttgcggctggtccgccgggttgagcgcgtcgcgtgcgacctggatggcgccgagggcgtgcgcgaggtcgagcgcgatgtccttccatgggcggcgggtgtcgatcgcgatggcgtgttcgtcgagccggtagcccatgggttcggcggcggccttcgcctcgtgcctgacggccaggccctgccgcgtgagggtcttcgagagggcctgtgcgacccgtgcgaacaggtgggtctcctcggcctcgtcgagcgtgaagtcgggcaggatgccgcccttctcctggatgttttggatgtcctgttcggtgtagtcgccacggtccttgagatgcggggcccgccaggctggcgtggtgttgcgggatatgtcggccatgatggtcctccttgatgggcggggccgtctttcggccccttcccatccggcacccgcacgccgcgagccgccggccgattgcatcccgtccgtcaccggcatgtacttcacgacgtacaatcgggatatgggagaaatcacgatggaaccggcttaccacggtatcgaggaggagaccgtcacgcgtctgccgtccaaggcgttcgacgagtttctcaaggccctcgacaggccggtgccgcagaccgcccgggaccttatcggcatggagcccgattggctatgaggttcgcgtccccgcgtcgggcctggtccggcgacgtgctcgacgggtccggctgcggccgtcgcgcccatctacgagcggctgccacttcgtgcgcgggacgccgagaaacacggacatcggccgtataacgtaagtcggaaaaaacagcaggccctccgccgcgggacggagggcccgccttcgggcggagaatcagatctcggccagcgccttgtctaggagcgtgcgcaccgcattgctgcggctcatgtggtgtttgcgcatgtaccgttccagcttcgcgtcgcgttcgtcgtccagacggacgcggatcacgttggaggcaggggtgctgcccacggctaggggacggcctggggttctcttcagcgcctcggatagctgctcgtcggtgtagcccctctcggcctcctcggcatcggccttgagcatcgcggcctcgtcggccggcagttcgtcgtaggagaggatgtcgtagttcatgtccattgcctgcctccttccagcagtttcacgtatcgggtcctcatgcgcatcgcatggatgagcgccggccccctcgatgtgtcggccaccaccacctccagtggaaggccatccggtgatatacccagatataggaccttgagggggtcctcacgcagcacgaggtcgcgaagcggatgctccaccacgtacatggcgtcatccggttcgatgccgtgcttgagcgccgaggggaatatgttcacggtaatattgtgacacaaaataggcgacgggtcaaggacgtatgggggcacggtccgtcgcggccattgtgatccagtcgacgatcgagattctggtaggtggcgatctcatcctgttgggcttggtcctgcgtcaggtcgcgttgccgttggaggccgcctgccggtggcgttggaggctgtcgcgtatggacgccgatgccgccctggccctcgcccgggcgttgtcttccttccgggattacgtctcggttagatgagccgccctgttttgtccgcatatcgatggcatgcgtcgcatggcttgagtgacaaccatgacaatgatcaggaggaggcgtgcgatgacgggttcggctcatggcggtccggccgacgacaatgatgtcggaggtgttttccgcgtatgcgtgggcgtagaagaatcggctcgttccgccccgtcgacgtggggtgttttcgatgaaccgttgacggatcatgatctgctggtattgtcgcgcgcgtttgatttctcggacgggctcagggagcattgcgtgccggccgcttgggaggcccttgattcgacattggattccggtgtgcgcgagcttgtatcgcatccgccccggaccgaggccgagcttgcagcggccatcgcgggtttgggtcatgccgtcgcccggcgggcggtggatggtgcgctcgatcatcttcagtccagatggctgtaacgctgcacttcgatgatgttgcggggcaatctgttctccgtttccccggatggcgcatgttccgtccatcgtgtggactggttggtccgccggcagtggtcggctatctcctttgatatgagccgcatggtctttcctgacggttcggacggtttcggtcagctggggcatgtacatggtcccattatccccaatatcccttctttggcccgatatcggcgggattcgggccggcggcggcgtggatggccggattgcgtgtcgtgtgttgggaggcttgcatggctggtggcgaggggaagcgggggtcgtcgggcaaggcgttcgtggtggccggcatggcggtcgcggccccgctgctcacggtcgtggtcgtgttgttgtgcctggtgatcctggtggtcgcgatcctgcagtcggattacggcctggggacgcgttgcgtgacgggctcctcatcgtgggtggattgggcggtgtcgatagcgaaggacgataagcacgggtattcgcagcccaaccgcgggggcgacccggattacgactgctcgtcgttcgtgtgggcggcgctgcaccatgcgggattcgacgtgggttcgagcccgttcaacactgacggcatggattcggtgttgaaggcggccagtttcgaacggtcggatttcagggatgtggcgtccctgcaggcgggcgacgtcgtgtgggcggacgggcatacggagatctacatgggtgatggcgagttcgtgggcgcgcattgggacgagaggcatggggtcgagggcaggacgcccggcgaccagaccggtgacgagatcggcgtgacgtccacgttgaacgcgcggtacacgcgcgtgtaccgtgcgccggcctcgcagggctcgcaggcggtgtcgggcggcacgtcggattccggttgggacgggatgggcgcggagcaggcgaaggccgcatggttcggcggcctggccggtccgggcaatacgtgcgtctcgtatccgcagggccagtgcacgtggggcgcgtgcctgcgcgcctaccgtctggggtggaagcatgtgggccagtattggggcgatggcggcatgtgggcctcgtccgcggccgcggagggttacagggtgacgcggacggccccggtgccgggcgcgatcgtgagtttcccgcccggcgtgcagggcgctgacccggcggccgggcatgtggccgtggtcgagtcggtggacgcgtcgaagggcacgttcacgatcagcgagatgaacgcgcatggcccggtgtacacgtcgcgcgagctgcccatcgcgggcggcgcgaacttcatcctgcccaaggacccgatccacggggccggcgggggttcctcgtcgacggcgacgtgctcggcgggcgaccaggacggcgagaaggcgagcgtggaggaggcgaagaggatcgcgaagcgcaagatgaaggacatgggctgggatgacggttcccagttcgagtgtctggacacgatcttcaccgaggagtcgggctggcggtgggacgccaccaacccggacagcggcgcgtacggcatcccccagtcgctgccggcggagaagatggcctcggccggccaggattggcggacgaacgcggccacgcagatcgactggggcctgaaatacatccatgacaggtacgggacgccgtgcggcgcgtacgcggaacgcagggccaagggctggtactgagattatcggcgtccgttcgggtggtttttccgggagcggtcgtctcatggcgttcccgggccggccggcgcatgattttcttctcttttttcccgtgcgccggcgggccgctttccttcacggccccacgcccctcccccgggcgtggggcctttcctttctttccggcccgttatcggccgtgggccgtgccggcgcgtggtggatgcgcgggcccgtgttgtcgggccgtggaggcttgtgatgagggaggccgtgatgtccgggatggtgttggccgatgattcgctgatcaacctgttccccgatcccgcgtgggatgtggcggggttccgtgacctggcgggaggcgtgatagcggtgtgcctgtacgcggcggtcgcgatggtgatcgtcggcgtgctgaccctgctgccgggcctgatcacgaacaacatgatggagcgcgccttctcctggaagcgtctgctgtgcgcgttgatgatcccgttgacgatcggcgcggcgacgagcgggttcgcgtggggcgcgggcgcgttcggcacggacgggctggccgtgaacgactcgtaccagtccgcgaacggtcatcccgactggaagggcgtgaagaacgacgaggcgaagaagtcggacgatctgggcggcgtggtccggcagttgggcgaggacatcgcgaaccgtgtgggcaaggccgcgggcgacgcgatcgacaaggccctgtcgacgggcaagaaggcgtggcagtggctgtccggcggcgacgggaagggcaacgtgttccagaaggccggccaggcggcgggcgacgccgcttcgggcgcctgggactggctgtcgggcggggacgggaagggcaacgtgttccagaaggccggggacgccgcgtccggggcctgggattgggcttcgggcggcgacgggaaaggcaacgtgttcgagaagacgggccaggcggcgggcgacctgtggtcgtccctgttcggctgagccgtccggcccgttatcggcatcgggcgtcgtacgggcccggtggcggtggggaaaggagggtgaatcatgaccattattcatccaatcgccgccaccgcgtccgatatcgtgctggcgttgaccgacaacgacctgtccgggttctccgtgtccccgaactggacgttcttcccgttcatgagcctggtgtcgaacatcgtgggcggcctgtgggctttgggcatcttcgtggcgacggccgcgtggatcatcgccgcgttctcctgggtcgtgtccaaggcgatccacaatagcacgatgcagcagtacagcggcatcgtgttcgtgtggatcgcgctgggcatgatgctgctcggctcggccatggcgatcgtcaagttcgcgtccacgcaggccctgttctgacctcggggcccgtccccttttcctccgggcccgtcccgccgtcggggcgggccctttccttttctcgtttttccgttgttgggaggctgtcgtgggcgatatcgtcgaggcggtgctgcagaagctgttcccgtggatgctggacccgatgggcaaggcgttgcagggcatgatggtgggcgcgttctcgtcaaccgccggatccgtgtcgtacgcggagtggaacgtggcgatcacggccgcgaacaggatcggctgggtgatgggtttcgtgaacatgctcatctgcgcggtgggcgcggtgcatgcggccgtgaaggccagcccggcggagtcggtcaagtcgttcgcgatggcggtgctcgcctggccgttgaccgcgatctgcgtgagcgtgatgatcacgtgcgaggggatcgtgagcctcctgtccgcgaggatcctcgcggtgggcgcggacacgaccaagggccggggcatggagtcgatggtgtcggccatgttcaagaagatcctggagcaggcgtccgtcctgcattcgctgacgatgctgctcgtctatctggtgttgttcgtgggcgtgttcctcctgtgctgcatgctcgcggcccgcaccctgtgcctggtgctgctggccgcggtcgcccccttgccggtgatgagcgccggctggaaggcgacccggccggcgatgcgccgctggctttcggccgtggtgggcgtgatgctggccaagccgttggccgcgctggtgatcacggtcgggtcggcgctgatgacctcgcagaccacgtcgggcgtgggcgagggcagtttctgggatctactggtcggcatcgccgcgatctacatggcctgctattcgccgaagatgatcatgccggtcgtgcagttcctgggcgacgaccggagcatgggcatgcagcaggccgcgagccaggcgggccggaacgcgctggtgaccgcggcccagctgacccggcaggtcgtgaccgcggccgccggggtggcgaccggcggggccgcggcggcgggcgtgcagttgcccggcatggcgcagggcgggctggccgccctgaccggccaatgggggcaggtcggcgaacaggccggaaaaatgctcgccggctccaaggccgacggcaaggacaaggatgatggcggcggggcccgggattccggcgcccatgccgccgacccgtcgaaggacgacgggtacgagccgccggtctccgctcccccgggcccggatggctcggccattccggcgcccgatggcgcgtcgtccgccggaaccgcgcccggcggcgagggaggggacggtggccggggcgtcgcgggccgtgacggttcggacggtgccgacgggatcggcggcgagggaggccggggcggcgccggcggcgagggccggcccggcacgccgggtgccccgggcgatccgggacctgccgggatgcccggaccggacgcggcgccggcgcccccggtctcgccacagtcgccgtcgggcccggtcctggcctgacttatcgatgcgttgccgggtggcgtccccgtatgggcggggatcgcgcccggcccttttttcttttttgattggaggttgctgatggtggatgccgacggcagggacgacggggcgagggtgcccacggcggcgttcagccgcctgtcggccacgaacgtcttgttcgggtggacatggccgcagatcggcgtgggcctggccggcctggtcatggtcgtgggcggcgcggcggcgggcatggtgctgccgttgatgctcgcgggcggcgtggtcatggcgtacgggctgatccgttacgaggggttgagcctgatggcgtggacgtacgtatggctggcgtggcggcggcgtgtgcgcgacgggtcgacccgatggtcggcgagcccgctcgcctcgggccggccggcgggcgtgctgggcgtgtggggccaggtcgagtcccgggcccaggtggtcgaggggtccggcgtggaggtggtcggcaccccgttccatggcgcctgctacctgttcgacccggaacgccggcgggcgaccgcggtgctcgcgttgaaggtcgaggagtggacgttgagcacggatgcgtcgaaatcgtcgcgcgcggccgccttgaacgatctgaccgcccgtctggcggacacgccgggagtggtcgagctcaaggagaccgcgctcctgctgccgggagccgcgcccgctccggacctgcccgacgatggcgggtcgccggagtggatgcgccgcgacatggcggaattgtgggccctgccggaggtcatgaccccgttggcgaacgtgagctacgtgtccgtgacctgcgacgtggaccggctcaagggcgtggaccacgcccggggccggctcacggaacgcgaacgggtcggggtcgcgttgggcgacctggtgaagatgaccgtcgccccggccctggtcgaatgcggggcgcgccccggttcggtgcgctggtgcggcctggacgacctgcgcacgctgatccggtcggtttcggatccggccggcaacgcggaccgtcctccggtcacccgcgacgagccgacgctgggctggtgcgaggagagcctcgacggggagagcgtgaccctggaatcgtgcgtggcgcgcacctggtgggtgacccagtggcccgaccggcccgtgccggcgggctggacgcgcgacatcctgcagggcggcaggatgatcgccctgacccatatctggaggcccatgagcatggagaaaagcgagaaggacctgagggaccgcgagtccagcatcctgcagcgcgacacgttgcagaaccagcggaaactgtcgcgcgacgaacgccgtgagcgccgcgagcagcggcagcgagaggcggagcaggacgcgaactggcccgacaccgaccatcaggggttcatcaccctgttcgccccggaccgcgacatgctggccgtgttcgaacgcgacctgcgcgtgcgcgtcggcaagtaccatctgcgcctgtccggcctgcgcggccagcagcggcaggcgttgaccgcggtcctgccgctggggttgtgaccatgggcgcgcacggccaggaggactggttcgacgaggtcatgcccgggttggacgacgggcggcctggtgggaaacggcgattcccatggcccggccggcatgggaaggacgacggggacgaggccgaggcccgcaccaggccccgtatcggggtgcgtgtgggcgtggcgacggtgatcgtcacgggtctcatggtcacggccgggctgactgcgggcatggtctccgcgaaccggcgcgaacggctggccgacgcgtcggcggcgtgcgaacgatccgcccgggcatggtccgcgggatcggccgcatggggccgggaccgcgaccggatcatgggatcggtcgacctcgacgcgctgcgcgccactgaccccgatatggcggacaccctcgaacggctttccgccgaccccgtcacgccggccggatgcacggccggaggcgacacggcaacgctcgacgcggacgcgaaacgcatctccaaggccgccgacaggctcgcgaaacgttcggaacggctggaaaaggccgtggcgaaagccggccagacggtcggcgacgccgaatcgtcacgggccaggagccggctcgaacatgccgtggccgacgcgcggggcctgctggcggggagcacggcggaccagtacaaggtgccgtacctgtaccgtcggctcgaacagctcacggaacaggcggcggggctgctcgacgacgggtccgcgtccccggcggacatggaccggctctcccagggcatcgactccatggtcgcctcgctcgcctccggcacgcgatgacgggccgccatacggttatcggcccggcgcacgcgtgtacggacaaacggatcaggaaacaggaaggaatcggtcatgccgtgtcggtcagagcgttccggactcatcgaacgcgccatcctcgcgcgatcaatgggggcgggccgatgatgcacctcatactcgtgatcgccgtcgttttcgttttcgccgcgtcctgtctgctgacgttcggcctgtgccgcgcggccacgcgccgcgacatgctcgaggcccgttggcgtgaggagtcggccggttccgtgggtgaggagagccatgagagcgcatgaaacgcttgagcgtgccgggcgtcatggcggcttcccggcccgtggttccgcttcgggcctgttggcggcctgcccgtcggacggcagccacgacttctacctgtcgatgatgctcgacgttcccgtgccgcgcgtgcccatgctgcgcgcacgtctgcaagactcccgccgaggggcgcaacgcgcatccgacgcacaggaagctggccgcgtggtgcaagtgcagcgtgggcacggtcaaacgccatttgtcatggctggaagggggacgtgtggtgatggagcagcggttccgtctgcgtgacggttcgccggtcgtgccgcgctggcgccgttgacgatataggcgtccttcgtgggtgtcggcgtcggcgatcatgtgctttttccgttcagggaggtttcgtatggctgatgctcctgccggggtccgtgccggcaaggccgggggtccgcatgggttgcgggtcctgtccccggccgatccggggtatgtggagtggtgccggtccggcatgccccagaggatccgtctgctcaagctcgccgccgagaaacgccgccggatcgagcagggcgtgatctgtccgaaatgccataggcgccgggtccgtgccggcgacacgttgtgcgcccagtgccgtcacttggaggatctgccccgctgccgggaatgcgggaggcggacgagccgtcccgtggacgggttttgcgcccgatgcctgaaactggtccgggaacaggccaggccgatgtgcccgaaatgcggcaggtgccggtgcctcgagggcgaggacatgtgcggcaggtgccgggcgcaccgtgtgttgccatcctgttcgcgttgcggcgcgccgcggcggaagggttcgccggacgggttgtgcggccgatgccggcagctcctttcggggaaggcgaggacatgaacccgatggacgtggccttggaggccctgtacttgctgggtgtggtgctatgctgcgcgctcctgtcccgcgaggagggctcgcgcgagggcctgggttcgcgtcgcgcccgcctgttcatgctggcgttggcggtggaggcgatgcaggcggggttgggttcgctcgcgttccgggagccgtggggcgcgccgttcgcgccctggcaggcgttcgacctggcgggcgcggtcctggcggacctgttcctcgcacgggccctgctgcgcggcgacggcggggctcccggtccggactaccggtgacgcgtaccgccggtcattcctcccgttcgtgttcgtgttccacctcgaagcggatcttgagccgcgtacggccgcggcgggcatggcgtgcggcgcggcttcgcccgccgccgttttcccggaggccgtggcgggtgtggcgtccccacgcatgaacgtgggccaagagttttctcgcggccgccatgacgcgcaggagcgacagcgccacgaggcagccgatggcgagcagcgccaccaggtcgcggttccgggcggcgggcaggttctggatgatttcgaggaggtcgagcatggcctcgatggtgtttgcgatgtattccatgtgccgctgtatgcgtccgacgcccctgctcatgttcacgtctgattcccggtccgatgacggccgagaacgttatggtcgtccacccgccgaaatcggtgccgccgcgggtgatcgcgccatggggaaggaacatcctgaatgattggccatattggatcggagtgcgggaggaaggccctggactttctggccgtcgggcggtcccgcctcactgcatgtcggctgcgcggccggcgggctgcatcgtccggctcacactggaccagaaccggacatgccgtcgaaacccctataattgtcatgtcgtcagaacaagcccggagaaggatatgccatcaatgcttacagtcgcggagacggggagcttgtccgttcctctcgtctccaaccacgatgtggcttcgccgttgagatatcccggcggcaaaagcgtgctgtccgggtacgtcgcctcgcttatcgatgttctcggcattcgtgacgtcacgtatgtcgaaccctatgccgggggtgccggtgtcgctctgcgtctgttgaaggaccacaaagtatcgaaggtagttatcaacgactacgatcccgacgtgttcgcgttctggaacagcgctgtcaatgattcggcttcgttcctggaacgattcgaccgggcggaacccactatcgaggaatggcataggcagaaacgcatcatcgcggaccctgccagcgagctggacagggggttcgcgttcttcttcctcaacagaaccaacagatccggcgtgctgaacggcggcgtgatcggaggattgaaacagaacggtagatacaaggtttcggcgcggtacaacaaggcctcgctaagacgaaaacttgaatttctcggggaacacgccgactccatcgaggtcagaaacgaggatggcagggccgtggtcgaacgattcgtcggattccctgaggcgttcatctatgcggatccgccttacgtggagaaaggcggcagcctgtatatgaacgccttggacgatgagaggcacagggagctcggaaatctgctgaacaatcatgccgactcccattggatgctcacctatgacgatacggcgttgatacgcgagctgtacggggaacggtacggtggcctgtttcctttgcaatacagcgcctccgcccggcgcaccgcgaacgagctgatgatcttttccgatacactgggcaaggccgcagcccacatgcactgacgcgaaggagaggacatggcgaatccgttcggggaaaagaatatcggcccatgggagggccagcaggtggagtacattccgctggatgatctggtcctgtggacggagaatccccgcgatccgctggatggcgattacacgaacgacgatgtcatccgtcgcgcaaccgacggacgcaacgacaagcaatggcagttgtccaagctgtcgaaagagatgggcgacagattcgatttgagcgaactgcccacggtatgcagaatcgatgacggaccgaagtacagggtatacgacggcaacaggcgtgtcattctggcgatgctccgcaaggccggtctcactactgagggccagcaacaactggtgcctccggatttcccagaccccatcccatgcaacgtgtgcgacgaagagaccgcgctggagaatgtggaacgcaagcacagaggtaacgggagctggaagcagtacgagcgggaccgtttcatgtgttcgactacaggggaggcccgaaaaccgttctcatacggctggaggagctcatcaaggcggtgacgaaatggcccgccctgaacatgagatacgtcgaagatgacgtcttcaacaaaaagcatctcgaggagatgggtcttcttcccgacgagccggacttcggggttcctctggagctgctggaggagctcgtggaggccgtcgccgacaaactggataatgagctgaacacgcgcaacgcgcgaaacgaccccgccagcgtcctaccgggcgaactcatggaccgtatcagagaagcacggcaccgccgaccggcgggcgaaaaggccgacggacgggaaagggaacttccctccgacaattccgagcctccatcgcaatcccatggtggtcttggccgggatgatgcgcttcgccccgatacgtccgggacactcccccacaccgatgcatccgccaggaggcgaaggggacgcacccgtcaggtcaagccggcatccattcccgtgttcgggaacccttcgggtctacggctgcagacgggagacgtcaacaacatgtatcgcactttggaggaactgtggaacatgtatgcgcgcggaggcatgcggaatgccgccgcgttcgtgccgatctttcgcatggggctgcgtctgctgatcgatacggccgccatggaacgatgcggcggattggacagatatgtgggcgagtatgccggggaagcgaaaaaacgtctcaggcaggcggcaaacagcgctgatctcgttacctttatgcgcaaccaggcggtgtcgccggaaaatctgctccgactgctccagaacggcgcacatgcgtatacttcgaccgggaacaaggaacaagccctagccatgagtatcctgatcggggaaatgctttcgatcagccacggacgtccatgattcgggggaacggcgtttcatgggacacaagactgtggcagccatttaccagcaaatcgccgtgacgggccgagcttctctataaaccgggtcgcgcgttcacggacggtccggaatccggccatcgcgcacagagtttttcactcctcatcaagccgatacgggggcacgttcggcgtgcatcatggcatgagacgtcacactctcatgggacgggaaagaatttccggctgtcggaggacaatcgttttcgtatcggctttccacatgagaagggggaaacatggaacacggggatgacggtcgttcgcgggatgatgtcatggacggccccgcattgccgccggatgagtctgggcggatactcaatccgttcaggaaggccttcgcctgggcacgcgtgcgtctgaacctgtcgggagagcttttcggcacaccgcagtgtcctgtcgcgcggatcctcgcacccgtcctgaccgttctgggagcttcgatcctcgtgtgcgatctgttcgagagcccgtggagggaggtcctggccttcgcagctctggcggccgccttgttttccgtgggatacaggcctcatccgctcgacgcgttgaggaggcccggcaagcccatgcggtggttcctctgtctcgggtgcgtcctcgtcctgccggttgtgaccttctatatatcggcactgctggtttccctcatacccgacacgtcggagaacgcgggtatcgccgcgacggacacgttcggcgagtatgtggtcatgttcatccagatcatgggcgaggcgtgcctgtcgattcttctgttcgcgctgctgtataaggccctcaatcgggcatggggccggtcggatccatgggtccgttccctcgtcgcgtggctggtttcggcctttctgttcggcatgctgcatctgcctacgtatagatggaattttctgcaatgcttggtcatcttcttctcgctgttcctgggattcgccgcgttcgtcgcgacgcgcagctggacgattctgttcctttcccatttcctgtacgacctgctcagcaggcccatggtgctgaatgcgtgccgatacgccgcccttctgtggctcctggtcgccgcggcttgcgtgtactggcatttcgggaaggggagcgccagccgtccggcttcccctcccgctcccccgatatcggcggattgtcgggtggatggcatgccgggcggcgggatcgccggccgtggcataggatgtgttcatgcggaccgtccctctctcccggagggggtgccggcggttggtccgatgacgggaaaggaacgaggatgagcgaagaggacaaggtgccgtccccggacggcgcgggcgtggtgcccgagcctgagacggttcgcaggcgtccgaagtggctggcgcccgcggccgtgggttgcgtgctggtgctgctcgccgtgggcggtgtggccggctaccgtatgtggtcggcgcgcgaactggccgaggcgaaggaggcttgcgccgtggcggccgacggggcgcgtggcgcggcgaacgactacaatgcggtcgtcaacggccaggccgccgacgcctcggcggtcaccgtcgaccaggtgaaggacgcgaggaccgtggacgcgctggccaaggcgttgaagaccacggtgcccgaatacgaggggtgcttggccggttccaaggccggtttggacgaggcgacgtcgaagctcgacaggcaggccgcctggtacaagacccatgccgcatcgctcgggaaggccgtcaaggcggtggaatcctcgaggctggacaggacggtcgaggacgcggagaagctgctcgccgattcgaagggcagggtcgccgacgagaagacccgtagcatgttggagcaggccatcaaggacagggacgcggacgcgatcggcgaggccgtgaacgcggtggacgggtcggtcaaggccaaggcgaaggccgacgccgacgcgaaggccagaagggaggccgaggagaaggcccaggccgaacaggaggcccaggcggcggccgacgcggcggcggcccaggcgcaggcgcagcagcaggcccagtcctatggcggcggctactcgtacggcggcggcaccggctacaccggtggaggctacaccggcggcggctacacgggaggaggcacgtacacgccgcccgcgaccggaggcggcaacggtgggggttccgcctccagcggaccaatcagcggaggacacggatgtactactgattgtcctccaccatcaagcgacggtctgattcatcattaacgactatcaataaagtccataagggtcttgctcgaatttcgggcaagaccctttttatttccaagttctcttttccctgtgtttttcctgtgatatcggtgtggtttcccggggtacgcgggtgggggtcgtggagtccggcctgtgggacgggttccgtgaggggcgggagaggcccgtcctgttgatcaacacagggaggagacccttatgggttttcgtcatgatagggcgtcggccgggcggagtcatgaaccgctcgcgcgtggcgcgcatggggcggggccggcacgcacggtgcttgccggcctggtggccgtggccacgctggccacgggcggcctggtggcgtcgaccgcgtatgcgggcggcgcgggagacaaccgtccgggcggcgcgaccggcggccttcccgcgggcatgttctggcagtacaaggacgacgcgtccggcagcttcggtccggccgcgaacgccgacggctcgccgcgcatcgcgtcggtggaggccgcgtacaagcgtgccggcgtgagtgtggtgaacgacggcgtgtacgacgggccgggggcgatccgcgatacgttgcggggtgcgttgtcgaagtgcgtggccgggttccgtcagcgtcatccgggcgagggcgacggcgactgccgtgtcgtgggcgtgggctcggtcgccggccagcagggcggcagatgggtgtacaacgggtccggcggctattcggcgtccgagtggtactcgtcctgggactcgcagatcaaaccgtatacatataactatgccggcacacaaagctaccgtacctcagatggctttgatgatgatccgtcgaacagcgtggacaagatcgcgtattcgaacgtggctgcggccgacgcgacgccgaacctaatcatcatcgtgctggacaagtaccagccgaagccgccggagacgcctccggccccgccgacgaagaaggtggagcagggcacgagcgctgatggcatgtcgaacgagacggtgatctcgacgggcactggcgtgggcggcaagaggatggtcgtccaggatgcgatcgatccgaacggcatggcgtacaaggtcacgggccagaaggtcacggacacgaccaccggccaggacgtgtccgcgaagttcacgttcaacacggcggacgggcagccggccccgaacgatgtggccacggccacgtggaagggcggcgacctgccggaaaggcacacattcgagtaccgtctgaccatcacggtctcgctgccttccacgtcgaaggtcacggacacgccgtccgtcacgtggaacgacaagggcacgggcaaggccgacggccacgggttcccgacctggcagccgaacccggacaagagctggatcctgtaccgtgacggcaagtggcaagccgtggtcgatccgggcgagacgaacaggaccggcgcggacgacatgaagttcctcgacggggacacggtcggctccgcggtgaacggcaccgtggaccccggtctgaaggaggctccctccaagctggagctgaccgacgactgggccgccgccgactatctggtcgacccgcaggacgcgtcgaagatccgcgtgttcgcggccgaggccgagcccgaccgcaccgacacggtcgacggcgccacggtgaagcactacacgcagaccagcgtcgcggacatcgcgaacaagggcaccgacgtgaccgacatgttcgacatcaaggtcgagggcaccgtggcgaccgccaccgcgaaaccggactatttgaagaccctgaagggcatgaggaagggcctgcagctgaccctgctcgtcccgttcaccgtgaacttcgcggacggcaagggcgcggcccgggtgcgcgaggacttcggcaggaagccgggcgacgaggtcacgttctgcacctcgccggacggcaaggagctgaccaacaagggcagccagaccgtgaacgggcagaccgagccgaccaacaagccgaagatctgcggctacgtgcctccggtgaagaaggacgtgatcgcggaatcctcgcagggcggcggccaggagagcgtggacggcaaggtcgtccacccgggccagaaggtcgagtaccagctgaccaccgagccgaagctgcccgccgacctggccaccatggtcacgagcgtggcgttcacggactcctatgacgagaacctcgtgccggacaagcagaccgtcgagatgatggacctgaacaccggcaaggtcgtgccgaagtccaagtacgcgaccaggtgggatgaaggcaggcacctgttccagctgaccgtgaaggaccagtcgctgatcggccagtggcgcgcctcctccagcccgcgcgtccagatccgcttcgagggcaccgtcagggaggatgcccccaccgaccacaagatcggcaacaagtgggtgctgaccctgaacaacagcctgaccccgtcgaacgaggtgttcaacctgccgcccgtcttcaacccctcgaagaaggacacccagtccaaggagcagggcgacccgaccgtctcgatcgacggcaagacgatgctgctgggcgacaccggccactacacgatcgacctcgacgccacgcagaaggaccaggcctacaaggtatggcgactaggcctgacggatgatttcgatgacgagtacgtgagcatcgacccgtcgaggatcgagatcacgggcgacgacggcaaggactacaccaacgcgttcaacatccaggtgagggacggcgtcgcctacgcgtacgcgaagaccgtggacaccgagatccccgcgaccggcgagaccgtgaagggcgacccgcagcccgcggacctgaaggcctacagcgagaagtccgacaaggaccacgacccgttgaaggacccggccatcgaccagtcgctgctcggccagcactacgcggtcaccctgccctacacggtggtcaaggtcaccgacggctacgtggtgaagaacaccgcggtccagatcgtcaacaacgtgaggaagaagaccaacaccgtctccaacccgttgaagccgatcaacccgaagaaggacgtgaccgtgaaggtcggcggccacagcgtcgacggcaggagcgtctacctggactccacgttcctctaccagctcgacagctcgatcctgcccgcggaccgcgcctaccagaagatcgcgaactggggcatcaccgaccagctcgacccggcgtacgacaaggcgaccggccagtgggccgtgtacgcggcccgcgacctgtaccggggcggcgaggccatcgccaggaagggcgagagaatcgccggcagcggcttcgacagctcgaggctcggcggcgacatgttcaccgcgaacatcgacccctccaccggcctcgtggacatccaggccacccaggcgtacctggacctcgtgtccgcggacgacgcgcacgagcagggctggcgcgcctacgtgcaggtcacgcgcgtgaaggtcaccgaccgccacgagaacgtgttcaccgagcacgtgaacggcaaggacctgaccagcaacatcgtgtggacccgcacccctgacctgaccccgggcatcaagctcgagaagtgggacaggaggagcggctggccgaagggcgaccgcgacgactccaaggacgcgctcgacggcgcgaaggacggcgacgtgatcgtgttcacgatcaccaacacaagcaaggacgacgccggctacggcgcatggttcaaggccagcgacctgaagctcgaggaccacaccatcgtcggcgacggcgaggtgaaggacctcaagtacccggacaactggtccacgctggtcctcaagcccggccagagcgtcgaggtgaccggcacgctcaccggattcaccaaggacaggcacaccgaccgcgccaaggtcaccggcaccccgttggtcgaatgccccgtggtggacaaggacccgttcggcggcgcctccggcaagccgtccacaggcggcgaagccggcgacggcgacggtcccaggcaggtgaccgtcggcgatcgcacgctgtgcgaggacacgcccgtcgagtccaacaccgacgactggaacggccgccggtcgctgctgggcgagaccggttccgcgatcctgcccgtcggcgtgggcgcgctgctcatggccggcatcggcgccgccgtcgtgatggtccgccgccgcaagtcggcgcatgacgacacggacgcggccctcatgccgcgccacgccgcctgacccgacggggcccgtcccatgcgcgtcgccgcgtggaagggccccttcccggggccggcatcccgaccgggacgccggcccctcatccatgcaacgacatcgatcactcccctccctgtcggggagggggcgggcgcggcatgcggccgcgcccataggagaaggacacgatatgaggaacatcatccgcatcggcgccggcacggaccgccggaaccggttcgtcgcgatcgcgttgggcgtcgccctggcggccggaccggccgccatgatgcccgcggcggcgctggccgcgccggccacggacgccgcggccgcgagcacgacggccggcacgaccatcacactgcaaggcgcagacggagcaagcctggccggccacacgttcgacgtgtaccggatcggcacgtacaccgaccaggtcctggacggcgcgcagatttccagtctcggcgtgcgcggcgacacggcatccaacgcgtgggcggccgacgcgatcggcatcgccaacgcgtacgatccaagcacggccgacgacatcggcaaggtgtacggctatgatgacgcgggcaacatcgccaacatcaagatggactcccaggccaggcagttgcgcaacatcagcaaggccctggcccagtcctcgaggcggccggccgccatccagggcggcacgaacctgacgaccacccggtccacgctgacgatcaacgtgccctccgagggcctttactacatcaccgattccgcgggcaacccgattatggtcggcacgaaatccggcaacgcgaacatcatgaagaacgacgcgaaggacccgcagtggcggaccctgggcgtcgcggtcgtcaaggcgaaaagcgtgagggtcgacaagaaggtccaggtgcagcgcaacggcaccacggtaggcaaggacggcaccaccaacgatccggtcggcgtgaccgtcggcgacaccgtcaccaacacggtcgaggtgaccgtgccgaacaagcaggccgcatccgccgtcaagttcaagctcatcgaccagccgaagggccagacgtacgtgaagggctcgctgagcgtccggctgaagaacgcgccgcagaccgacatcacggccgacgcgggcatctacgacgggaccacgcagaacaacgcgaaaagcatccccggcgacccgaccctgaagaccgcggacaacaagcccgccgacccggatctcgccatccccgcaggcggctggggcatcgacggcaggaaacttctcgacaaatactccaacaggacgatcgtcatcacctaccgcatgaccgtcgacaaggccagcgtcaccgacccggccaacaacaccatccacacgtacggcacgttcaccgacggcatccacttcacgaccatcaccgaccaggacaaggccgacatcaaggcctacgacttcacgctgcggaaggtggacgcgggcaacgtgaacacgctgctcgacggcgcccggttccagatccagcgcaacggcaaatggatgaatctcgactggaacaccggcaaatggtcggatgcggccaaccaggatgccgccaccgtgttcgtgaccggcgacacgaaccatgacgggacggccgacaacagggacgacgcgagccagaggggcctcatccggttcaagggcctcggctacggcacgtacacggtcaccgaaacccgggagccggccggctacgccagctacgcgaaaccgacgttcaccgtcaccatcgacgacgcgggcaccagcatccagtacaggggcaccggcaccgtgccgaacctgaccggcaggctggacaacaacaccgtccaggtcaagaacgtcgcgaatctgacccaactgccgcagaccggcggcgtgctcgcgttcgcgttctggctggcctgcgccatgcccctgttcgcgatcggcggcaccatggccgtgcgcggcgcgcgcaaccgccgcgacgcgctgacgctcacgcatgacggcggcaatccggccgcctgacacatgtcccggccctccaggccggggttccgccgatagggggcggggtcgcgtcccctatcggcctctcatcaccgaatgattcttttttatccggcccgccacgaggggttcgtacgggtcttggcccatccgtcggaagacattgcgagggatgggggaaggaaaaccgataatgcgcacatggctgaaacggatggtcgccggcatcgtgtcggcgggcaccctgatgggcggcgggctcctgatggcgggcaccgcgaacgcggacgagatccgcatgcccgacatcggcaagaccatcacgagcctgacggcatcggccgccacgacgtatccaagggagctcgtcaacggcggattcgactacctgcccgcgggcggctggaacgtcatcagtcccaagctgaacacctcaagaggcaagttcacaagcgtcgacccggtcaacgggcagtacatccgcaatgcgcatgtcacagatggaaacgtcgcatgggtgaaatgggacggttttgatgcctccaaattcgggtggatctccgaccagaaaggcgggaaaccccaaggcttcgtcaccgaccacgcaaacagcgtcgaattgcagcgggacaatgatacggacaatacgtatgcggagatcgtcggcagcgaaatcggcaaaagcatctatcagaagatcgacacgcagaacagcactgacgccgtatacacggtgcgcttcgaccatgcggcactgagttccgagcatgccgacgggatgcaggcgctggtcaacggcaagcccgtgaccatgacccgaatcggcggcaacaaggccggggacaagaccggttggacgggtacggacatcgtcacccacgcgaccaacacggatcattaccgtcatgacggtcagtgggcgacctacgagggcaaggtcacgatcccggcgaacacgcctgtcagcacgttcatgttcaaatcgctgaatgaagcgaaacccgacatgggcaacctgatcgacaacctgacgttcaagatcgcgtacaggctgagctacgactcgaacggcggcacgaaggcgaaggccagccagatcagttccatgaccgagggcaaggtgtccgagaccgacggcaaggtgaagacggtggcggacgacgcggccggttccatcccgtccaacgaaaccgccggcgccgtcaagcaggccaagtcgaagaccaatggcagcgtgcgtctcgcggcggatgacgatgtggcggaatacgccgtcaacggcctgccggaccacctcgtcaacggcgacttcgaatacccgaccgccgacatcatggggaaatcgggcgggcgattctggtatatcagccagaacgacaattcatggtgggcgaacgcgaaggagaagcgctccacgctgcccgccggattcgacaagagcaagttcgcatggcattcgacgcagaccgggaacacgcactatccgatcctcgaacgcgctgatgacatacaggtcgattacaagggcgacggcacgaaccattacagcgagatcaccgccgcgcaggccggatccacgctctatcaggacgtggccaccacgcccggcgtcatgtaccgttggagcctcaagcacgcgagcatcaactcggcgaacatcgaccgcatgagcgtcatgatcggcgaacccggcaaggagaccgctcaggaggcgacgcgcgccaccgtcaacgggaacggcgacaagaccggcaaggtcggcaccgagatcgccaccaaggtctccaacagcgcgtccgacgggtgggaccacaccggccagtgggagacgtacaccggcacgtacatcgcaacctcgaccgtcactcggttcgcgttccgcagcatcgaaggcggcggcaagacgcagggcgaatcgtgggacggcaacctgctggacgacgtgcagttcaccaaggcgtacaagctttcctacgataagaacgcttccgacgcgaccggttccgtcccgtcgaatcagcgtggcaaggagaacgccgtcgagcccgccgaatcgaagactaccggaaacgtgaagacggtggcggataatacgtcgaatctgccggaccatctggtgaacggcacgttcgattatcgcggcaacgagatcatcaacgagaaccagagggtctacggcgacacaacctacctcgccataatcagcgcgaagaccggcgtcatcggcaacccgctgcacagcaagctcgacaactgggattccggcaagttcggctggaaatccaacgacgccaccgccggcgtcgacaccgtcgaggtgcagcgccgcaatcacaccccgtatccgaccaacgcgggcaacgtgtggggcgagatcgccgcagccaagcggggcaagtacatctaccaggacatcgccaccacgcccggcgtcgtgtacaggtggagcctcaagcacgcgtcccgcaacgcgggccaggacgacagcatgcaggtcatgatcggtgaacccggcaagaccgtcgcacagcaggcgacccgcaccacatccaacgggtcggacaagaccggcagcgtcggcaccacgatcaccacgcacggcaccgcgcaggacggcaagtgggagacctataccggcgactacctcgccacctcgaccacgacccgcttcacgttcaggagtgtcagggactccaacggtcagggcctcgacttcaccgccgagggcaactgcgtcgacgacctaagcttcgacaaggcgtacaagctctcttacgacaagaattcttcggacgcgaccggcagcgtgccctccagtcaatacggcaaggagaacaccgtccagcccgccaagtccaagaccacgggcagtgtcggactcgcggctgacaaaaccgcttccggcctgacggtgcatgatctgaagaagaacgacaagggcaaggtgccctccaattcgaaggcggattccacgcagccggccgcgttcaaggctccggacgccaaggtggaggccatcgcctccaggtccgcgggcgacgagctggccgtgaacggcgggttcgacaccccgaagtggacgatcgccaaggaggggcagggcctgccctgggtgtatgtgacgcccaataagggcatgatccgctcctacgcgcaggccatggccggacagacgggcgtgaaggccggcggcctgaccgccgccacgttcgcttggcaggatctcgatgccatcggcggcatccagaacttcgaactgcaccgggagaaggacgggaacacggccgccgacgtgcatgcgggccgtaccgtcgcccagaccgtgaacacgacgcccggcgccagctacacgttcagtatccgccactccggccgctccaaaggcaacgcgggcggcgtgacattgctcaccggccccgacaaggatcatctcaccccagtcaaactgacccgcaccacggtctccaagaccggccagaagtacggggacaagaccggcgatgtggggaccgtcgcctacacgcactccgattccatggacgccacggaaggcagccacgaaccgtgggaccattccgacgactgggaatcctacgagggcacggtcattatcccagccggacaatcccgcacgatgatcgcctacaggggcgtcgccaaggacggtactcttactgcctccgccaatgacagcatcatcgacgacctgagcttccgcctcgcctacaagctcagctacgacgcgaacggcggggccaagaagagcacgtcgcagatcaaggcctccaccgatggcaaggtgaagaccatcgccggcaagaccgacagtctgccgaccgaactggtcaacggctcgttcgactatccggccggcctgatcgccggtgtctccaccaaatacccgtgggacgactggaccgtcgtcgacccgatcaacggcagatacgcgcggcacatcggcatcgataaggacccctgggcgccaatcccgggatgggacgcctccaaattcgcatggaagtcgacccagaccaagggaaccgactggcagcagatcgcacagggagtcgaactgcagaaggactccaagaccggcaaccagtacgcggaactcgtcgcgggacatgcgggcaccgccatctaccaggacatcgccaccatcccgggcgtgtcctaccgctggacgttgaagcacgccagcctcgacaggaaccacctcgacgggatgagcgtcatgatcggcgaacccggcaaggaatccgcccaggacgcgaggcgaaccaccgtcaacggcaacggcgaccagccgggcgacgtcggcaaggtcatctccacgaaggtgagcaacgacgccgagtcgaaccatgagtcgaaccattccagccgtaaccatgacgggcagtgggagacctacaccggcacgtacatcgccaccgggacggtcacccgcttcaccttcaagtcggtaagctccagcaacaacgtcaacggcaacatcctcgacgatctgagcttcaccaaggcctacaggctcggctacgacgggaacggcggaaccggccaagtgccctcgcgcaccgagacgggcaggaccgaaaccgccgcatccgggacggatggcacggtcaggcttgcggccgacaagagcgccggaccggaatccggaaccatcgcggacgaccgcagggtgctgaccgacacgaccgccagacaggatgacgggaccagccagcggacgatcacccgatccgacggttccgtgcgcgtggagacgatcgccgacacgggcgccgtatccggctgccaggtctattatccggccggcaccaggatcactttggcgaccgcgaaggccgactccgactgctgggattccagccagatcggcaagaccaaccgcacgttctacggttggagcgcgaacacggacgccaacgacagggacgtgcccgtcggcgacaccatggaccggaacacgctgaacgcgaacgtcaggacggagatcgtcatgcccgccagggcgaagaccgtatacgcattgtgggccatcaaccccaccctgtcgtacaacgtgaacgcgcccgccggcagcaacgcgcccggcacgcccgtatcgcagaccgtgccctacaacacggccgccgccgacaaatccggttgggcggccggcgacacgggcaagattcccggctaccggttcgacggctggtacacggccccgaacggcggaaacaaatacgatttctacacgccgctcaccggcaacgtgaccgtgtacgcgcactgggtcggcaacgggtacacagtcagattcgccggcaacggggcgaccggcggcggcaccccggatcaggcgttccaatacaacatcggccagaacctgcgccggaacgggttcgtccgcgacgggtacacgttcaccgggtggaagcgcgccgacaaccagcaggcgtacggcgacggccagtgggtcacgaacctgaccacgcagccggacgggatcgtcaccatggtcgcccaatggtcggccaacgaggcccacatccgctacaatccgaacccgccggccggcaagaccgcgggaggccagggcacccccaactgggatggccacaccggagacacgccgaccatcggccagaacggctggacgatcgacgggtacacgttcgccggctgggccaccagcccggacgggagcggcgccaggtacgcgccgggagccaggtggacggcgaacggcacgctcaccctgtacgcgcagtggacgcccggccaggccagcctcacctacgacggcaacggggcgaccggcggcaagaccgacccgcagactggcaagaccgacgagaagatcaacgtgcgcgacaacgggttcacgcgcgacggctacacgttcgtcacgtggaacactcaggccgactgcaagggcaatgcagtgaaacctaacagcgagtggacgttgcgtggttccagcaccctgtatgcctgctgggccggtaacgcgcaaaccctcacctatcacggcaacggcgcgaccggaggcaacacggcggcgcaatccggcaagaccggtgacgaactgaccacaaacgccaatggtttcacccgcgacggatacacgttcgttcgttgggacaccgccaaggacggttccggcaccgcatacggcgaaggcaagaacggcgtcagccagtacgtgatgaagccagcaggcaacgacctgtacgccatctggaaggcaaacccggcaaccatccagtaccgcaacgactggccgaacaccacaggcagcacacccgacaccaccggcaacaccggcgacacggtgaccatcagccagaacagcttcgaccgtccaggctacacgttcaccggctggagcaccagcaaacgcggcgacccaagcctgcaaccgggcgacaaacacacgcttgaaccgagaaccaccaccgtgtgggcccaatggaaggccgaccccgcacacctggtgtacaacagcaacatcggaaccgtcggctcggaaaccaagacggtggacggtgttgtcgaccagaccgtgaagaccatcacgaacccgttcgaccgtcctggttacacattctccggctggaacacgcaggccgacggcaagggcaaggcatacgccacgggagccgactacgtgctgacggccaacgacaagtccacgacgaagaacacctccgtgctctacgcgcagtggaaaatcaacggtgccagcctgaagttcaacccgaacggcggcatcggccatgtcgatgacgtgaccggcgacgccttctccaccgtcaccatccccggtgacgcgaaggagccgaagatcacccgacccggctaccggttcgtcggatggagcacggagaagaacccgcccgcagggagcactttcctgcagccgggcgaaggcaaggtcacactgcccgccgaaggcagcaccaccgtgtacgcccagtgggagccgagcctgaccaccctgccgttcacgggcggacaggcccaggtgccgaccatctggctgtacgccggattcgcgctcatgctgatcgcgctcggcgtgatgatgccgatgctacgcatgcgcatggccgcaaccaagcgcaccggtaagcacatgccgatcaccggcggaaagcacgcgaagtgacggcagcggccgaaaccgacgtgtgggagagcgtcgcggatgcggtccgcgacaagcgggcgcgcgacaatcgcgcccgccggctcgtccgccattcccggatctacgcggtcgccgcagtcatctgcctgatcgcgggcatggtgcttgtcgccatgccccgcatccagcagacgctcggcgaccgcgccgttgacgagcaggcgcgatccgtcagccagacggccgcgctgtttccggaatcctcccgtcaaagcgtcatccaatctgccatcgcatataatcagcgtctttatgaaggcggtcagccacagataggcgaacctgtgttcgacgggaagaccgagggcaatttcgagggcgatgccgaataccggcgtcaactgtccgtgaatgggttggatgccatgggtgagattctgattccgaagatcagcgtcgacatgcccatcctccacggagctggtcaagatgtgctcgaacatgcggccggccatctggcgggcaccagtctgcctatcggtggcaagaatacgcgcgccgtaatcaccggtcattcgaatctgaaaggcgcgaccctgttcacccggctcggtgaactcgaagacggcgacccgttctatatcaaggtcatgggtaacacgctcgcctatcgagtcaccagcaaacgcatcgtctctcctaccgacacgaaatcgttgcgtgtccataaggggaaggacgaggtcacgctcctcacctgtacggggcagggcaatacgctgcgactgcttgtcacgggggagcgcaacagcatgcccgatcaggcccccttgcccggagatgccacgggggacgtaaaaaaggcggcttttgtttcgggcgtcaccgtgccggggatattggctgtcggattttcgctttgtcgcagtcggcgtgccgtgggtcatcatataggtttgccacagacacatgatagtgacaatttgcgttagtaaaaaaaggtgatactatatgtttgtgaaacaaaaacacgtaatctcccgacatcggggtaaacccgaaaaggaagacacatacacgagaaagaagaaactccccatgacacacggcatcaccaagatcacagtggcaaccaccgccgtgatggcaacccttgccgctccggcagtcgcaatggccgacgaaaccacaaccaccggcgaccaaaccaatcaggcaatcacacaggcccaagacagcatccagcaggcacagcagagcaccaccgaagccaaccaggccatcgcacaggcatccccgaccggcgtgaccgaagcacaggccaaggccgacgccgccgcagccgcactggacaccgccaagcagaacctcgacgccgccgccgcccagcagcagacagccgcaaacaaccagcagcaggcccagaagaattatgacgacgccaacaaggcccaacagcaggccgcacaggatgcgaccggcacggccgacaagatcgccgccgcccagcaggccgcgaacaccgcgtccaacgccatcaatgacgccagcaaggccatgcggcaggcatccgacaaccagtcgaagggcgaaaccgacaagcaggccgcacagaccgcgaaggatgaggccacggccgaatccgcctcccatcagcaggccgccgacaaggcccagaccgatattgatgcggccgacaggcaggccacggacgcgcagaagaaggccgatgcggcggataccgccatcagtgatgcgcagaagaaggccggccgggccgatgaggacgcgaagcaggccgcggccgacaaggccgccgccgagaaggagctgacggaagccaggaggcagcaggcttcggcgaccggcgacaagacgaaggccgacgaggcggtgaacgtcgcgcaagccaagctggatgcggccaggcaggccgaggccaaggcgcttgaagccaagcggaaggccgatgccaaggtcgagcaattgtccaaggatgatggaggtctttccgacctggccgcgaagctcgaagcggcgaagaaggccgcagccgacgccgccaccgcccagcagaaggcggaacaggcgcagaaggatgccgacaaggcggtgtccgactcctcttccaacgccgaggcgaagcagcaggccgccgccgatgccaagagcgaggccgacgccaagaaggaagcggcagacgagactcaggacaagctgtctcagggcgcagtggcctacttcggcgacaagggtgcctctcaggcagtcaaggttctcaccgatccgaccgtcaccgagtatcttgacgccattcataatggtgccaagggtgatgcgaccacgttggacaacatgatcgaggccctgaagttcatccaggaagccaatcagcttcgcgcgaaggaaggcctgcagcccctcaaggtcagtgacaccctgatggcacaggccatggcggatgcggattatgccaacaacaacgtgaaccatccacttcaattccccgccagcgaaaacctcgcctggggttacactgatccctttaggggctggtacgacacggagaagtccatgtatgagaaggacatgtccgacggtgtcctggattgcaaggcctcggacggcaagcccgtcaaaccctgcgcttatggccattacaccacgctggtcaaccccgatttgaccctcaccggtttcggcgtcagccagaacggcaacatcacgggtatcggcgggaacacccatagtcagctgttcaccgaaaacgctaacggaatcggctccgacgcgggccgcatcatggacgttgacgcatacctgactgatttgactgcctaccgtgattccctgaccggagccgacgccgcataccagaccgcattgtccaagagcaagcaggccgcacaggacgcttccgatgcggccaaggcgctggccgccgcccagcagtccgcacggaaggccgctgaggaagcccagcaggccgcgcagaaggccagggatttgcaggctgccgccgccgaggcgcagaaagcgtatgacgaggccgtgaaggcgaacgaggacaaggccaaggcgttggaggaagccaggaaggatcaagccgataagaacgcggcttattccgccgcccagcaggccaccaaggaagcccggtccggagccgacgccgccaccgacgcccagaccgcagcccagacggcagtggacaaggcgaacacggcagtcgccgccgcacaggcgaagatcgataccgccgacaagctggaccagaccgccgccaagaacaagacggatgcggaagccgcgatcaagcaggcgaacacggacaagacgaaggccgcagccgacctggccgccgccaaggcagccaaggccgaggccgagaaggccaagcaggccgcgctcgacgccaagaccgtttccgacgcgaaggttgaagccgccgccaagcaggtcaaggccgccgacgaggccatcgccgacgccaaggccgcatacgcgaaggcgaaggacgacctcaacgcggccaccggcaagctcaacgacgcccagaacaccatcaagcgtctgcagaacgccgaggagaacctcaagaaggcgaacgcgaagctgacggaagcgcagtccaagctggacgaggcgaacaaggccaaggatgaggccgacaaggcatacgagaaagccaaggccgactatgatgccaagctcgccgacaagcaggcgtccgacaaggagctcgccgccgccaagcaggccgaagccgaagcccagaagaaggccgaggaggaagccaagaagcagcaggaagcccagaagaaggccgaccaagccaagcaggatgccgaagccaagaagcagaaggccgaacaggccaagaagcaggccgcaggtgtgacgaacaatggtctggcctccaccggatcggacaccaccgcaatcgccacgctggcggcgatcatgaccatcgccggtgctggctgcgtgctcctgcgtgtacgttccgccaagcatgccgatggatggcatgcagtcgaggactgattctcaccgcaccaaacgtgttttgcccgccttcgacccgaaacaggggagaggcgggcaaaaccgtattcccacataccgaagcaaaacggtagcttcttttgttactatcagaaaaaagtcagtgaattacgtgaaagggtctggctatgaacgatgtaggacatgcgccactcccaggcgacgtgctgctacaccaatacctgcaaccaaacaacatcaccatgtaccgtctggcgaaagccatgaacctgccacaaaccaccatcagtggcctgatacacgggaaaagacgcatcaccacaagcctcgcataccatctcgcctacgtgttgggcacatcaccggaatactggctggaattgcagatgaattacgacattgaaaactacgacaaattcaacgaaaacggactgacggccctcattgataatacggtcggcgacactgtctagtcagaacgatgacgagcagaagaacgagctcatcgacaggatgatggccgtgctgaagatgaaatcggacaaggacaccgagaccaagaggttcaagttcgccgtcatcggtgccgtggcggtcctcggctgtttcctgaccggcgcggttctggcggctttgggaggaagcagccagatcagcacgggcgaggatgacgatccgtccgaggagtgacctgatccggccttctcatccccaatgcgggaacaggtggcggaagagcctctcgccggcctcctgctcgtcgagcacgcccatcgtgtattcgtcgacgatgaaccgggtcctcgccatccgttccgccgtctcgtccgacatggtttccgttttcgcatcgccttcctcgatgcgcgtggggacgcggacgagttccagatcggatatcccctcgggcatggtcccgtccggcagacatacgacgacctcctctcccccgccatcgagctcggtcagcttgcagatgccggtgccgtccaccgattccaggtattcgcccagttcggggatcccgtcgcgtgtgaatctgcacatgcgcagcccctgcccatccattgatcccccaatcatgccggatgcccggcatatcccgtcatcatgctacttcctttcgtccgttcatgaatcagacacgccatcatcgccatccggagacgacggcccgttgcccggctgtcggccgaagatggattccccgtcgcccaacgctcccagggatcgcagctcgccgtcgaaccggtcgcgttcggcttgttcgcgcagttcccgctcccagatctcgtagtcgtcggcgtgcagcccctcgtcgggcccgaccttccagtcgaagcgtcgcagccggctgatgccgggcatgacggtgccgtccggacgtgtcaacggatggttgacgacgaccttgagaccggccggccactcgtcggtgacggcgaacccggatccgtcgcccagcgtctcgtattcgcccacgagcctcctgccttgctcgtaccattcgcacatgtgcagcgtgaacgacccgtcctcatgctcctcgtacatgaccgtctcctcttccgcaatcctaaagctcgatgtcctgggcgagcatggtggccgcgtcgtttttgtgttcaatccaccatgccgcgtcgttcatccgcagcacctgcctgcgcagttcggcgaacgcgtcacggtcctcgatgcgcgcgtggcgggcgagcacgtcgacctggcttagggtgcggcgtcgtatcggctccgcccggtcgcactgggatttcgagccccacagttcgcagaacccgtcaagcctgttgcgctgccgggacgcgatgccgatgcaggcgggacatgacacccgttccgcgttcctcacccgctgttcgacgaccacgtacgggccgtccacgttgatccgctcctggtgcccgcatgcgtgcgtgacgaatctccaagccatgacctaccgccttcccgaaaacaagaaccgaaccagcattcgaacaaatgttctattaaggcggggacatgcacccgtttgacgcccggcgggaacgctacgaccgacgcggggcgcgccgcgactccggcccgtattccgacgatgtcatggtacaatttattgtacaaacaggaggtgcgtgatgacacaggccgtggcctacagcaatttcagggcgaatctcaagacctatatgcgcagggtcaacgaggacgccgacacccttctcgtgaccaacgcgaacccggaggacaacgtggtcgtcatgagcgccgacgactacgattcgctcatggagacgctgcgcgtctaccagaacccatatctgagcgacaaggtgatgcgcggcatggcgcaggtacggcagggccagacgatggcccacgaccttgtcgaagcgggcgcgtgatgctgctctgctggaccgaagacgcctgggccgactacctgtactggcaatcccaggaccggaagaccctcaagcgcgtcaacgcgctcatacgggatatgcagcgtaccccgttcgagggcatcggcaagcccgagcccctcaaatggggcctgtccggcgcatggtcgcggcgcatcgactcagccaaccgcatcatctacaccgtcgccgacgacaggctctgcatcctctccgcgaaggaccactactgaacgacatggggcggaacggctcgtgtgccttatcgacgttttcggtcgacgcggctttctcggacaggattcgctggcagttcccgagccggctccaaaagaatcagcaggggtgtggatcactccccaatacgccacagaacttatcttcaacccatccaccgtctccaccgttgccgccgccctggggcggctgcggctgtggtgcgggctgtggctgtggtgcgggcgtgtacccgccaccggtggattgctgcggcgtgtacgtgtatccgccctgggattgcgtgtatccggtgtaacctccggtcgtatcgcccgtgtaggaggagccgttgtccggcgcctgggccgtgctctccgccgcctgctcctccttttcggccctggccttcgcgtccgcatcggacttcgccctgacggagtcgttgaccgccttcaccgcatccgagatcgccttcccgtccttcgattcgatggcgttctccaatgcggtgcgaaccttgtcgtcctccaccctgcccttggagtcgttcaggaccttggtcgcgtcggcaacgatcttgtcggtcttcgaggcgttgaccgcatccgccttgcccctgatctcgttcacggtcttcgcgtatacgtccgcggtcttgtcgagctgcgcggccgccgcccggatgcccttcaacccatccgccgggcattcggggatatcggtcttcgtggtcgaagcggccttcacggtcgaggtcaatacggcgaccgtcttcgcgtccttgacctccgaatccttgaccgtgattgcggtcttcaccgcatccgactccagatactccgtcagcttcttctgcgccttcaccgccttgtcgtatgaggtggcgcattcctctgaagccgccgtcaactgattatggttccaatacaggtatccaccggtgccgacagccgccaaaacaacgacggcagtacccccagcaatcaacggaaccagccacttcggatgcttacgatccggaggtaggtggacttcgaattccgtcaccggctcaaccggtggcgtgacgttcatgttcataggttcttctttctcattcatttgtctttccttatactatgtcgttgactttgacttctccccacggctaaagccgggggattctaagctttgatgggacgtgcgtctccggggtagcacccggatggcgtcttacggtcccgtgggcttcagggacaagtcctgccctgatgagcatgttcaacgccgcgttcttatcacgatccttcaccattccgcaatgctgacagcggcgcgaatccggtcagcaggaaaaaccagtaccagggttttccggcggtggcgaaggcccgttcgatcagagatccgttcatgacatcatattgggaacgcagccagtgcttgtagaatgccagcgcgatgatgtaggccagggatgcgaggacggtggctttctctcctacggggatttgtctgatcacgttcctgattctagtgaacgatcagtcccgccgcgaagacgatcacgccccagatgaacgtgagtcgtgcggggtccgccttgtcgccgtggccgacccattcgagcgccgtcttcatgccggcgagcatcgtgtgggcgagcatgaggcagaacaggaacacggagaccgcgagcagcggggtcaccgttttctcgaccgccatattcaccattcccgcccccagaaggacgaacgaggcgacggtgcaggccacggccgccgcatccgcgcggcttcttttcccgtgtccgatcagcgggtatacgcataggcagcagatggccagcaggacgagcggtgccagggtcagcgcggtttgcgcgtccgcgtcggagaccattctcaggtagtccgttttcctcaggcgcggcagtacttggtaggagatgaatcccagcacggccgtcgccatggcggcggccatcccgacgcgcagcagcactcccttgcatatcgccgcggcatcggtgccatgttcctgctccatgcccttgctccttccgttcgttgtttccgtatcggttttcctcggatccggttcccggatcgtttttcttgttccgttttctgacgataaccgggtttcccggctcgggcacgttcctgttcatgcccgagtcctcgtggctgccaccgtggccgccggccgttatcggcggtcccgctggtggtgtccgtggaagcgtggccgcttgcccgtccgtcgcgtcttccgttttccggttcaggtgtcggcgggctgattgggagagtgtgtcatgctgtcggttctggtgttgctgctggtggtggccgcggcgtcgttcgcgtatcgcgcgttctggatgctgcgggcccgtccgtcgtcccggtatgtggggagccgtttccgtgacgaggtggtggcgatgagccgtcgccagcgtcgtcgcgcgttctggggcaatgtgctgctgtgcgtgttgtgcgtggccgcgatggtgttggtcggcgtgctggtgggcggcatgggcggctcggtgtgaccgtccgtcgtcgtttcgcttccggcccgtcggcgtgtccggcgggctttcgtcttgtgtgtgggcctgatcgtcggaggttggtgtgatgtctggttcgactggggatgctccggtgttggagggagaacaccggttgggcgagggcatgcgtcgcggcgtgttctgtctgggtctggtgccggtggcgacggggttgacgctgcgcgaggcgatgtggatgcagtgttgtctgacggcgggtgtggagcccgggccgatgcccgcgcatgcgttccgtcgcgccgaccggcatgcggtggaggacgcgatgggcgtggccccgggtctgatgcgcgcgatggccgcggatgcgaaacggcgtcggcgcatggtggacgcggacgaggaggggcgtctgcccctcggttcgccctcccccgtggacatgatgacccgtgatttccgcgtgcggccggtcacggcgtggcatcagaccagcacggggcgtgcgggggtcctgtccacgctggtggcggggtcgggggcgcctcgcatcgacgggccggtcatcggcgtggatgtgctgtcgcgtgagttgtggcggttcgattcgtgggcgacgtatgacgcgccgggcgttcacggcccgcatatgacgaccagtccggacgtgttcatctgcggcctgcgcggcaacggcaagtcgttcgcggcgaaggtgatggcgttgcgtgagatcgaggcgggccgtcatgtgatcgtccagtcggatcgcgagggcgagtggggccgggtcgccaatcatgtgggaggccaggtcgtctcgccgggcggcggccattatctgaacccgttcgcgttgccggaccgtccgtccgccggcgaggacgatttgtggcgtcaggaggtgctttccgggcgcaaggcggcgttcatgagcctggcggaggcattgcgcgaggatggaggcccgttcccgctggatcgcgacatgcaggtggtcgtggaccgtgtggcggtgtcgttcggcactgggccgatgacgttggaggcggcggtggaccgtctcgcggaccgttcgtgggtggatggggagtcgccctcgatgacgggtttcgagcatgagccggcgttggcccgtgcggcggcggccgcggcggctcgcgtgtatgcgccgatggtgcgcggcggcaccctgtcgggcatgttcgacagggagtccacgatccggttggacccgtcgagcccgatgatcgtgttcgacacgtcgagtccggcgttgaacaacgagcagctcaagcgcgtgttcacggcggcggtgagctcgtggatcgaccgtctgctgcaggggcgagacgggagacggcggatcgtagtcgacgaggaggcgtgggacctgctgtcgaacgcacgtctggtggactcgttgcagaccagacagcggtccgccggccattggggatgcgcgacctggctgatcgtgcatggcgtgaacgacatgacgcatgtgttcggcgagggcagcgagcagcgtggccgtgtcgaggagatcctcaaccagatgcagacgaagatcatcttccgtcagggcgggtcgaacatcgacatgctcagccggctggtcccggatctgagcgaggacgagcggcgggtgattcccacgctgccgcaggggcttggggtgtggagggtcggcgcggagcatccgcgcatggtgcgcgccctggccggtccgaccctgtcggccctgttcgacacgagcgacctgaggtccgcggcctgaaccgcatcgtttttgttgtatccgtttctccgtattcgtttctccgtattcgttggtgaggaggccgctgatggcggatgtgtccggggatcgtccctggtatgaggagctggcgcccgatctggagggcgatgccggccggggcgtggaggggtcgcgtgtcgattcgcgccgtcgggtcatggccgtgtggcgtgggttcgaggactcgcgtgcgggcgtgtggctggcggagcatacgcggcttctggccggtttgtcgagtgaggggtcggtgctggtgcgtcgtctggccgtgggcgttctgctcgcggcgatggcgttcacgctgctgctgttcgcggcggcgggcggcgacccggtggccggcgggctgctggccatgcccttctggatggccgcgttggccgtgtgcgccgtgctgtgggcgttctgggacgcgtaccgtgattccggggagcggctcgtagatcgcctgtcctcggctccgggcatggccacgcgtcgtcaggtcgcggccgcgtgcggggtgcgcgaggtgatgcgcacgatggtgccgagcgtgctgccggccatgctggccgcggccatgcgggagcgtcgcatgggcggcgacccggtgtggccgaggccctggcaggcggccatgtacgtgggcgaatgccatcacgtcggtgtctggctgtcgttggagatgcacgcgtacgtgctgggaccgaccaggtccggcaagacagtgacggtcgtgatccccgcggtggtggaggcgcccggcttcgtgctggccacgtcgacgcgcagcgacatcatctcggcgacccgtcgcctgcgggagaggggtgtggcggatccgtcgaacggggcccggtacggcggccgtggccgtgtccatatcttcgacccggaggggttgggcgcggcggatccgctgacccggcacaacatgcgttggaccccgttgcaggggtgcgaggacccgaccacggcgatgcgccgcgcgcagaccctggtgggtgtgggcggattgggccaggggtcgaacaacagggagtggggcgtgagcgcgggaggctatatccaggcgcttctgtatgcggcggcgatcagcaacctgccgatctcgaaatgctacgagtggtcggtcagcccccgcaaggcgctcgaggccgcggacctgatccgcgagcatacgggcgaacgggagatgctgcgctgggcggacacgatccgtggcctggagaccatggacacgcgccaacggtcgagcgaatggttcggcgtgaggaacgcgttcgcgatcctcgcggacccgaaggtgcgttcgacgatggatttctcgccgcgcgacccgcgtctgatcgatccgaggcgcatggtcgaggatcatgacaccgtgtacgtgctcagccggccgaaatcgcaggcgggcggaggcgtgaacgcgggcctgttcgccgtgctcctgctggacacgttccaggaggcgtgccaggatctcgccctgtcgcgcgaggcgtcgggacccaacctgcgcaagatcgagccgccggcccggttcgtgctcgacgagctgagcaacatcgagacgtggggcggcctgcgcaacgcgatcacgcagggcggcggcaacggctatcagttgctcgtggtcgagcagtcgcgcgacatgatggtgcgcgactacgaccgggagaccgagcagaccgtttggaacaactgcaaccggatcatgctgggcggcgtcaccgaccgggacagcctcgaatggtggggcatgcagatcggccggcatgaggtcacccgtttcgagtccacgtggaatccgggacagggcccgctcggaggggtcacggaacgccgcggcgcggaggagaccgtgctgccgtgggagctgagccgtctgccgcgcgggtggatggtcgtccagcccgtacgcgaggcgccggccctggtccgcgccccgcatttcatggaacgcggatggtggcatgacgcgaaaggagacaggtgatggacgacacccgtgacgaggtcggcgagatcctggccggcatgacgggaggccggaccggtacggccggcggcgtctcatcccccgtgccgccggccgcggactgggcccgtgggctcgacgccgcgtcggcgtcggccgcgcggctgaccgtgctcctgtcggacgtgtacagggcgcatcagggcaaggacccgtcggccagcctggccgcgcagatcgagcagaccgtgcgcaacctgaccggcgagcctccgcaagagccggaatacgggccgggcctgtggacggcgatgccgcaacgctcctgggagacgatgggcatggcccggccgatcgactggaccggcgcgccctcgcgcacggagatcgacctgatgacgatgcacgcgatccgctacggcgaatggctgtgccgcacgttccccacatgggagcagacgctgcccgcctgctggatcgagcacgacgacgtggtggccgaggtgttcgccctgaaatgccatgcggacctggccgcggcctcccccaacggcggcatgtacatgccggccctcatgcaggacatccaccaggccctcgcccgggtcaaggaatacctgacggcggccggcacgggagaatcctcccacgcgcatcacatggacggcgaacagcatgcctcgcgccgacgcgcccgggaggtcgaatacgagtcgtggtatcgccggcgcggcggatggaagacggaaccggcgttcaccggccgttggcggggcggcgaggatttcgtctcctccacgctccttgcctatgggacgcctccctcgcccgcctcgcatgacgatccctccgccgacgtgctcatggccacgctggcgggctgcgaggaacggctggacggctaccggcgttcccgcgacggcatccgccgcatgcccgacgggccggaacgcgaccgcctgtcacgccagctcgccgcggacaccgacggcgatctgcgggaactgtccgaccggtggcgtgactggaggtccatggagctcgcggcccgcgaccggctcgaccaggccatcgcctccatcgaacgacggctcgacgaccggaaggcacccctgtcccatgaggaggccgaggaggcgcgcgcactggcgtcacggggacgcgccctgctcgacgaggccggggacccgcgttggaaccccgactcgtaccggccccgggacccggacgaggagctgaagctcgcgaaacggctcgaaggcatcgcccgcgaacgggatctcgattccctggaacagctcgaccggctcacggccacgatacgcgcgacgatcggcccgaggggaggcatgcgcccatgaccatgccggacctgttcgaacaactcgactcccctgccgagaccggcgacgattggatccgccgcctgctctcggaaccggacgagactccctcccccacgccggccgccggcgacgacggcaccgataccggccatgagcccgatcttccccaagaggaggaaaggattgtcccgccgcaggcctcaggaccgggggccggtggcgatgtgacggctcccccgcctcccggcgcgcatgcgatccccctgccggcatccgacgacacgtcgccatccgatgacctggatgacatgcaccaggacgcgattccgggattcggcaccgatatggatgccgatgagcccgcccgtgcgggccatgccgtccggatcgtactgacggtgctcgccgtggtcgccgccgtggcgctcgtcggcgtgatcgccgccggcgccgtcaccgcgtccgcccgccacggcgcggaacaggcgcaggccgtgctgcgggagaccaatacgattgcgactcggttcgtcaaagcccacaaggcgtccgacctcgccgacgcgaaggcatggagccgtctggacaggcggatttcagacaacgcgaggatactcgacgagcccgccgcccggctgtccatcagggatgctggatcgttgaagaaccgcgcgggcaaggccaataaggacacgaacacgctggtgtcggcggcgaggagggccctcgccatcaaacaggaggccgacgcgcgcgaatcgctcgcgaaggcggtcggcgaggccaccaagctccgggacggcgcgaaacgcgacgacgacaccggcacggccatcgacgatctgacgacgatcctcgaacgggccgccgagcccggcaaggacgtcaccgtcaaggagctcgaggatctggcctcccgggtcgagcaggcgaggaagaccctcgaacaggccatcgccacgcaggcggagcatgcgaaggccaagcgcgcggccgaggagaaagcggcacgggaacgccaggagagggaacgacaggccgaacagcagaccgtccccgacccgacgccgccacagcagcaacagcaatggataccccaataccagtcgggacagtcggggcaatcgggcggaaccggctcccagcccggcaacggctggagcgtgccgtcccccagcgacggcaacggcctgcccggcaacgatccgggactatagcccatcatccattcgaaaggagcaccatcatgacggacgagacaccacgcaaagacgagcacagggaacgtcagggccttctcggccgagcaagggaccgattcgagcggatggagccgaaacggcaggcgctgctgctcgccgtcgcggccgtaatcgcattggcggccacgatcgcgctcaacccgttccagtccacgacatccgatcaaccggaacctcaatccgcccaacaggcgacagacagcgacaaggatacgaaaaaccagtcccggacggacccgtcttcggaaccatcggaattcaccggttccacggaggacatcgccaacaaggcccggtcgatcctcaactccccggacggcggcaacatcgacacgttcggccagacgctcatccgccacggcgacaaggacctaggcaacgcgaccgacctgttcgacgcgatcggccggcaggagaaggaatccactgtccgcgcattggccgacgaatggtatgccgaggcgttgccgaaggccgccggataccggctcgacgatctcaaatccagtctgcccaaagcggaacatgccgtggacaggcttcccgaccccacgccggacgactgcacgggcctggccaaggccgcgaaacaggcgcgaacgttggtcgacgccggatccgacgactacgacaagctcacctccgcgcagcagaccctcaccaaatcgatcagcgcatgcaccgccaacatgaccgtcgaccagatcgaccgcctgttccctcaggacggaccatcggtcaccatacccgacaccggaaaggaagcacaatgacagcggacaccacgcggcgggagcacagcggttccggcatccgtctcggcatcggctcctgccccggcatagcgaagatcctgccggccggcatccgaggcatcacattgcccgacggcacacgcgtgcgcatgctgcgctgcgtgacccgggagggcggcgccgacatccccgtcgccctgatccccgccaccggggcggtccacaaccgcatgctcggggccgccggcggccagatcgtcgagttcgccggcaggccacgtctctaccggcccgagaagggcggccccatcctcgcgttcaccgtcaccgacctgcgcatccgcgacaccgatgaggcccgcatgctgcgcgccggacaaaacagaagatagtcggccagtttttcagtcccaatattctacgcacatccggaatttccacgctgccctcatggcatcagtttttccgcgcaaccgcatcgcggatggcggaaagcgcttcatccggggttttgccggataccgcagattcggaaaaccgctgcagctaccgatgtacatcttgcattcgtcagaccactggacttggtacaggaaccgatcggcgggctttaccggctccccagacgtctatgcccatgcggaggacggcttctccacccacatgtcccatatatctctggcctgttccgtcaagataagagcgaataccgcagatacaaacacgtcgaccatatcaggtgccgccgcccctaccgcaactgcaacagtgagcaggactggatagtacgttgtcttccggaattgcaggatactgtcttggtttttccgccgcacaatgctcaatataattccgagaaggcttggtattcccagtaaagcgaacaggatagcggaaggaagattctcctttgctcccccgttggcaccggtcgcgcagttgtaagaagaaattgcaagtccgaatatgcaaaatgaaacgaatacaccctgaacaatccagtgcaagggcaaggacatctcattcggactgtcaagccatagcgcaaacatatctacgatgaccatgattgccatcgatacggccatgatgcctccgctggccggatcattatggacgaatcctttgaattgcttgatgataacaatcacaaatacgatgccagcaagtccaataatgacaaatcctatccactgacgcaattgcgatttcagtcttacacgtgtttcgcgattttcttcactatctggctgaatcgacttgtaggtttccccgttttcggccgaaatctctttatcctgtgctgcggagcatccattctcagtcttatcggcttccaacgcattcgccacaacctcaacgggctccggctctccctcttgctcctccacacgcctgtcttcggtttccttcttctccatcatgccgattggccccgtagccggccgagcctccagatcatcatgcacggccggacgtgcacgcgcactcaatgtcgcgatccaggaaagcagcgcgacgaccatggcagtcactgatagcacgatggcaatcatcgctttcccattgtttttactcatatttgtttcttttagctgttctgaccgtcacaccatttccatggtagatgggcgtttttaccgtccgtgaacagactcatcaggcaatgtccagctgtatcaggaatttgcaggccataccctgtcgtgtaggttcggcttcggtcgcgtgcggttctgtaaaatgcctgcctatggcgaagacggtgataagggtcatgttcgatgatgcgacggctgcggaagggtttctcgagcgttgccgcggcgagggactggacgccgtggtcgaggacgcgcggccgatcggcacggtgaagcgcaatgggcccggtctggcgtcatggctgaaagcccatccgggctggcatgtggtggcggagtcggtgaatcggcgtgcggcgtgggccgcggcctggaagattcggcatggcgagcgtcgcggtttcgaggacgggttgtgggacgcccaggcgcagaaccgtgatggcaggtgggtggtgattgcccgccgcgcctcgaaacgccgcaatatccccggcgagggcatggacccgttgttctagaacgatgtcgggccgcttgtcgtggactgccagtggagattccccgtttccacctgttccatgggtgatggccacggaagcatgccggtccctattcccgtttcggcacccatgaccaccgttttgtgggtgctgtcatcgccggcggactccgccagtgagcggacttcgcggatacgggcggaaagcatggtcgcgatggccgtgattcgcgtttcaggtacgagtcccgtgactgacaggcggtgtcccacctgttcctcccacccatcgagcttgccaaggtcatatctggtccagtcggatatgaggcgcagctgtcggcgggctgtcggcgtcttataagtcgcgtagaacggtttggccttgtagtcgcggttgtctatggcgagctctccgcaccacagagaggctccggtgtcgaacaacggcgcgggccggacccgcagtgtctccacgtcgcggatgagaccgaagttattgtaatggcggtcgatgttccgcatgaggtagtccacgagtagccaatcgtcggtcgcatgcaccaccgccgccccttcgcagccgaacagttgcgccgccctgatccactggtccctggcgctcaggcgattatccctcttcaccgattcgagaatctgccatgcggatacgagttcctcggtgtccgtcagcatttcgggacaggtggatactggcctgttgtcgtattcgccgagattatatctgactgctggtatgccgagcctggagcaaaggtccgatgcgatgagttcgttgaccggttcctgtccggtacgtccggctttgatcagtatcctggtgccgtcgcccgcaatggtccatcgtttcggaaggtcgccgccggtggatgcgtcgggcgcgttgaggctgaacctgtgggaggaggaacgggcagtcaggagggttcgtccaagttcctcgtcaaacgggttggtgaagaagttcacggtatcccattcgaggtcggatgattcgggcttgacccaatactggtcggaaaggctgagtccatgcgagcggttgaggagttccaccgccgatcttattcccatcgagtcaagtatgccgcgtatcccatcccgagtgggtgggatggcccttcttctccaccaagcatcgatgcttttcgcgtagatcgcgggtttgccgtgggagatgagctcgagaggcaaccttgaacaatccagtatacggccgctgccgacggccttccccgatgaaggatcgtagtcgaaggccagcaccggatgtcggcgacacatgattatccgtcgttccacgtccgtttccctccttgctccggtgtcagtcactccatcgtatcccgtttccccatcgtcaccatcgtagtatgcgtgccgccgtgtccaggctccggaagaggggctggtggccggcgaggtttcgcaggagcgtttcgagctcggggatgggcaggtatcggctcgcgatggtccagacggtcgcgacggcgatgagggtgagtatggcggtgacggtgatccacaggatctgcctgatgagtccgccgccggtggtggcacggccggtgacgccggcgagcaccgtgagcgtgacggcgaggacgatcagggtgccggtgtcccatgagtccagggtccgggtcattgcgtcggcccatcgggcgagttgttcgatgatggttcctgccgtgtcttccattgcgggttcctttcctccatggctgcggggttcggcgtctccacgcggggcgtcgggttttccggccgattacgggtggttttcctggtcttgccggggttgacgacgccgcttccttgcccggtgatgcgtgcgtcgaggttgcaccagtgctgttcctgccggccggaccggcccggcggcctttgcccgatgggctggtcggggtcgtcgatgtgccacatgtcccggtagacggccacgtcgcgcagcaggttgtggtcgccgtgtttccgcgccgtttccatgacggtcctcgaccagggctgttcgcccgtggcggcctgtcgggcgagggcgtcggcccgttgggtgatgaggagttcgttctggcgcaccaggtcgagggcggcggtgtttctggatgccttgatgggcgggatgatgccggcggtccagccgtcgcgcaccgcgccgttgagccggtcgagcaggccgctgctgagccggccggccatgacggcggcggggtcctgccggtttccgtgctcgtccttggggctgatgtcgcggctgacgatggccatggcccgcttggggtcggtcatccaggcgcgggaccatagcgcgcgcagccattcccagttcggggacctcgtgatcatgctcacgatgcccgggttgtggcattggcggagtttggcctcgaggtgggggccggcgatgaggccggctgcgtagtcgtgttcgcgcaggagtcgtgtcaggctgtatctctcctcgtgttcgtcgatgcgggtttcggtggcggtgcgcgtgtcggggcgcgtcaggagtgtggagagcatgcgttggcgggcgatggcttcgggatcggtgtccgatccggacagcatggcttccgtctgccgggtcttctcgtccttgcatgcgtagaggaggtggttctcctcgcggcctcgtgtggcggccacgtattgcaggttgcatgggacgcgcgcgtcggaggggaacatggcggcgcaccggtcgacggtcatgccctggcttttgtggatggtggtcgcgtatccggcctcgcagttcgctttcgcccagtcccggggtatggtccattgccttccgtccgcgtcgcggcatgtgatcgcgtccgtgtcgatgcgggtgacggtgaacgccatgccgttctcgatgcggtgtccgtcggggccacgtacctggtggtcgttggcgcgggacacgatccggtccccggctcctatcttcaggccgtcggacagcgtggcgaggcgggacgggtccccgtcggacaggccgagcacgcgccgttcgaggatggtgcgctggttcatggcgcgcacctgttcgttggtgccggcgacgaggagcgtggtcttgcccgtcttctgccattgcagggtcatccggtacgcctcctcctcgcattcccggtcctcgccccagtggagacggtggtgggccgcgtattcggcgacgagccggcggcatgcctcgacgctgtccggtttcgcgcggtcgccgccggcgcgcaggcgcagcgtggctttgccttcgtctgcccatctggcccgtccgccgtcggggtcgttcgcccagagcccggggtcgctgcggaagcgccacaggctggtgagggtcgcgcaccggtgttcccgttcggcccaggcgagcagtccgcccggtgcggcgggcgcgtcgagctgcatggggtcgccggtcagtacgagcctggctccggcccgttcgcacagttcggcgatggcgtccagttccggggtgccgaccatgcccgcctcgtctacgatgacgagctgtccggggtggatgaggccggcctgttcccgggcgtcggattcgctgatggcgcggcgtatccggtcgcgttcggcgggggtgcgcgccgcggcgagccggcaccggaattcgcgtcgcaggtcgtcgatctgcgcccggtgccgttcggacacgttgtcgaggagcttggcgatggtgatcgcgttggtgccgatgctgtcggcgagctcgtccctggcccggacggacagggtcaggccgagcacggatcccctcccgtgccgggtctcccatgctcgggcgacggcgcgcatggtggtcgtctttccggtgccggcggggccgatgagcgcgctggccgcgtgcgggttctcgagcaggtatgcggcggccttcgcctggtcgtcgctcagccggtttccgccggcccgcatggactggatgagccgggtgccctccccgggtccccaggcgagcgggtcggtccggccgaacgtggccatgacgcgtttttccatgtcgaggatcgtctggctggtgtatcggtcgagtgtggggtcgtcgaacgtgctgcgtccggcgcggctgacgagcgcggggtcgtcgccggcctgtcctgcacggtagcgggtcggggttattttcacgcagcggcggatggcgagttcggcgacctggttggcggtgtcggcgcgggccgtggggtcgagccggatgtcggcgaggaggcgttcggcttcggcccggatgttgctgagcgtccatgtggcgcgggtgcgttcggtgtgtgccatggcagcgtcggcgagccgttcgagttccgtctggccgggtgtctggtggtcggcgagctgtccggcgaggcggatgcccgcggcccgggaggcggtctgtcccagttctatggtcctgtcccggtgcgagtcgaccgcctgccacatggcgtcgatgctggtgccgggggcttcggcccgcagtttgccgtgccatcgtcgggtcagttcggccagtccgggtcgggcgtcggtcttgggcttgcgggtttccagccagacctgtttgtggagttcggcgcgtcgtttccatccgatcgtatggccggtgcggcgttcctcctcgtcgatgatggcggcgagccgggtttcgatctccctgtcgcgtccgctgaacgcgtcgatgagctcctcgggcactccctggacctcgccggccacggccctggtgccgcgtccgcgggcgcgggccggttcgtgccaggcccagccgagtcgttgggtgagcaggtccttgacgaggttggcgttgtattcgctcagttcgacggtggccccgtagacggcgcgtccgtcgagcgcggtccattggccgtccgtggtgcggcgcacccggttggagatgaccaggtgcgtgtgcgggtgggggtcgccgtccctggagtcccagtggtcgaaggcgaagccggcgaccccgtcgcaggccgtgctggcgacgccgccggccccggcccgggtggccgcgtattcggcttcgaagtagccgatggtcatgtcggccgcctggtggaggcattcgtcgatggcgcggcgtgtgtcctgatcggcgaacgcccagaggatgctcacgcttttgggcacggtctgggtcagatcgtatccggcgatgggcggttgcccgtcgttgtcggcccgtatgccggcctggtcgaggctgcggccggtttcggggtttcggcgttcgttgatgagcatgcgcacggtctcggcgccggcctgccgtccggtctcgccgccgagcagcctgctggccgatccgatccatcggccgggcgggttgccttcggcgttgtagtaggcggctgggtcggggcctgtgagcggtccgggcgtggcctcgtcgggtatggcgccgtcggcctggagcgcctcgcgcgtgcggtcgaggtagtagtcggcgctgctgagtttggtcatgctgatggccatgcgtggtcctctcccttccctgcggcgccgcgggccggtccgtggcggcgcaggagtcgttccgcgtccccgtcctcgccggtccggtcgcatgcgtcgatgatgcggccgatctggccgtcgggtcccgcctgcgtgacggaccgggggtcgtgggcggcggcgagcgtgagcatgcgcatgagcaggatgtgggtgcgggcgcgcgtctcgatgccatgtcgccgtatggtttcggtgtccagttcgatggcgtgcgccctcgtcagcaggtcgtcggcgttcattctgagcctttcgatggttccggcgttggcggcggagcgcagcatgcgccgatcgcgcgccgtcttgtagtcatgtgacttgcggcatgcgtcgccgcagtattcgcctcgcgtgccggtatcgagccgtgcgccgcattcgtggcacgatcgccgtgggcgggcacttgtcccggtgcgggcgagccggttccacctgttgcggcaccggtcggagcagaagtcgggcacgggtccctgggcgggcttgtacacgggttcgccgcacatgcggcagtggccggccggcacccgtcccggttccgccttgcgcgcctggcgccggcatcgggccgagcagtacccgtccgcccataccagggtctcggggtgcgggcaccgggcccatctgcatcggccgggtctgggccattcgcttgtggcccctgtggtccctgggcggtcgctcatggcctggccccttcgtcgagggaccaccatccgtggtccgcgccgttgcgtcctcgatggtcctcggcccatatgccctcgatgatccggtccatgtcgacggcccgcgggcccgcgccgtcgtcgtggtccaggtcggcgcgccattcgtcgtccaccccgggcccgggttcgggccacatgccctcgagcgtgtggtcttcgcccgtgtcggtcatggccgggtccatggtccatgggcgtggacccctccagccggtcaggcccgcgatccggcccatgcccttgcgtccgatggaccgggccaggtccacggcccaccggtcctcgtatgccatgagcgtttccggttcgagccgcatgagcgccgccatgcatctgaccgaccagtagcacagttcgaccgtcccgtggtcggctgggccgacggcctcgttgcgccatgccacccgccggcgcagttcggcggccgcctcggcgacgtcgttcctggatgccatcaggagcgactcctgcgacatgcggcgtccgcgttcccgttccttcctcagctcctcccggcgccggttccggcatgcccggtggatcgacagcggcttcccgcggcgcgggtcccgctcctccaccgcgagcccgcacaccgggcatgcgggcggatcctggatcatgttcccatcgttcatggcgcccccacccggcccgtgtttcccgtcccgtcgataacgccgaaccccgatatcggacgcccggacggcaaacaccatcaaaaacgttgcagttccgccgataggcggccgccgtgaggcggtgggtgcaagaagtccatctccttcggagattgcatcgggatgtgctttttcttgggttttctgatggcgtcgtaccttgtgactggctgtgtgggttcttggttctgtcttcgttgtttctggtttctgtgtcgtgctttttcgtctgtctgggtgctggttttcatgtcgggttttatttcgcgtatgtgtctgttgtgccgctgtttgttcggggccggctgccgcacggaggccgggcatggcgcccccggcgggtgccggctcctgccgaacggggagacgtccacggtcgggagcctgctcgtcgactgtcggggatgcggcaccggtcccgggcgcgccgcgcgatgcgcatggctccgctccatgtgcgtttggggagaccggcccgatggcggtgggctctcgggccatggaccgcatgaaccgggtccacccgccgacctgcccatatggtccttggaccgtggcccggtggacagggacgccatcgtccggcccggtccatggaccaggggtggtccgcgtggccgtccccgcatgggctttcgcgtggaccacgtatttggttggtccgccgaattgtgttttagcaagttggcgtccgctttgtgagcggtgtttttccgcagtgtaggcagcgggttttccgcagggtgtgcggtatcggccgctgcctgtctgcgttgtgttggttatttggtcatgag

SEQ ID NO: 21 - DNA, 131385 bp, Bifidobacterium longum
cctttccggtcctttctggcggagatacaagcaccatccagttaagaccattccgtggtcggcatgctctgcctaaacccgaaaaatcatcgtgactaaacccgcaacaactaattgaacacaaacacgctatgtctcggccaagggtcgcacgaaggccgatgcccgcgaacggttcgacgcgaaggtcgccgagatggaacgcaccggcctgctgcccggcgccaagagcccgtacctgaaggattacgcggagcggtggctggaggaataccggctcaacgtcaagcccaccacgtaccgcacccgcgccggcaggattcatgcgtgcatggaggtcatcggctgtatccgcctcaccgagctgacccctgaccatatccgccaatgcatgcgcgtgctttccaaacggctcgcgccctccacgctcaaggaccatttcgtgagcctgaagatgatgctcgaccaggcggaactcgaggagctcatccccgtggatctgtgccgcagggtcaagccgccaagggtggagcccaccgagaccaggatcctctcgccagaccagccgaagcagctgatcgaggccgtgcccaaccggggagcgaaacgacgcggaccggccctgaccgtggacgttgacgaatcctggatgctgctgttcgaactcgcgttcgcggccggcatgagggaaggcgaacgctacgcgctcatgccctacgagctcgaacaacgcgacggcgtgcccggcatcaacgtgcagcagcagatccagcaatacggcaaaccggaggacgccgtgatacccgcctggctcaaagccgagcacctgtacggtatcctgtggctcaccacacccaaaacccacgccgcccaccggttcgtacccatatccacgagcctgtggcaacgattgtgggcgcgcatcaaacgactcgacataggcccacgcgacctcatattcaccaactcacgaggcaaccccgtgcgcagcagcaccgaacgctacaactggaacaaggccttgaaagccgccggcctcccgccggtcaccatccacagcgcacgccactggaccgccagcatgaccgcccgcgccaacatgcccgacgacgccagaaccgccatcatgggccacaccagcatcagcatgaccaaccactacacccacagggacgcggccagtctcgccgcgctcctcgaccgagccatccctgacctgcacgacgagagggatgtgatagacgcgcaggtcatcgaggaggggaaatgacgaacgtgacgcatagtagacttgtccgcatgagcataaagaaagtagacgggccacaggaccatcatcgatttatcgatgaggccggtgacatgaccttccattccgggaagcggggccgcaaaacctcctccatcgggatggacggagtttcccgatgcttcatgatcgggctcgtacatgtgaaaagtcccctcgacgatgctcgtgcgactatcgacggtttttgtgaggagatcaacagcagcaaattcttccagagctttcccagcgtccaaaagagaacaaaggagggatggcacggcttctacccgcatgccagcaaagatcctgcggaactacgctatgaattcctcaaactcatggcgcaggagatcgacttctccgcacgagtagttgtgggccgtaagataccggcgatctatcagcagaggcacaacgaacaaccacgtgaattctacgccgacctcatgtcccatctactcaaatactcagggaagatagatccgttgattctcgacgtcgcggaacgaggcagcagcacatcgaacctcaaccttcagcatgccgtggacatcgcgcaacagcgcagccgtcgcggcacggtaacgcatgaattgcgaaacaccaccaaattcaacgtccaaccgtatgatcacgaaattctcttggcgctcgccgactacagtctatggacggtccagcgagtgtacgagaagggagacgaaaagttcttcgggcttcttgaaccgaagattgtgctggtccatgatgtttatgattccagcagatatttcaaatcaaagaactattatcggccgaaatacaatcctctgaccagagcatccatcaacttcgacggatgggcgcaacctgaatggtagaaggaatagatggcccgtctcaactctagtcgtgctgtgacgacgacggcatgaagccgactttcgatgaaggacaggccaaaatccaataatacgaccagctgatccttcgaggggaaggatacctgtgtattcttgtcgctgatctataaatgatgatagacggtcatgtgggcggcagtcaagaaaatgcgacagattgtctaatcgtcgatatgtcgcagggccgccccggcgctcgcaaagagcgaccggggcggtttcgtgtttagggcttgatccgcccgacacgggatttattgcttggccgtcttgacggtgatggtggtaccgagcgcggtggtctcccagctcacgccgtccgcctcactgtaggtgaagtccttggtggcatcctgcgaggcgaggagcgcgctggccatggtctcggtgtcgtcctggctggtccatttccaatcgccggctgcggccggtgcctgataggtgcccttccagtagaggctcttggtgtcggtgccgatccagtcgacctcgatggtgtcgccgctgatggtagcttccatgtatgagctcgggtcgttggaattggtctgcttccatgtgccggtcagatcggccggctggggtttgggctcttccttattggtctcggtctttgacgtgccatcggatttggccggcgcatcggccgtagtgcttcccccgcaagcggacaggccggtaagcaacatcgccgcaacaagcagcgcgattgcctttttcatgattggtctcccttcgtgccggacattgtcgtccgacatgactcaatcatatggcgaaacacaagaaccaaggactcatcccggtgctcgcggtgagtcgtcgggatgagtccttatatggctcggaagctacgcggcgagttccacgggagcccgctcttccaatttggagtaggggataacggcacaccgtagttgcggaacgcggtgagcgcgccgcgctgcaacggcgtctgccggtcgtcgccgatgactatcagccgggaatccctgcgcttgggatccttcttcgtgtcatcccaaccgaacatgatgtctttcacggcgtccttgtcgaatcggttcggtgcctggcagaaccgggtcggatggttagcgctacgctggaacaggaaatcgaagttgtgctcgtagctggatacgcctcggatccccacgttcggagtgtagaacacatggcatgagtcgagtttcaatgcaacgtcgtcagcaaagtaggacagcacccttttctgttctgtaacggcatcagtacaatgttcgtaatgaacagttgttcgcgcaaggaaatgccggcatatggtgcgtcatgttcaaagcatagagattcattatccggcctcaacgagaatgatttggttctagcgcaatacatgctttcatgacacatgccttcgtgatacatacgttggtcagaagatattgcgctagaactcagcagtcaccgcacgtggtccacgatgtcgttgaccttggtcatatcgatatcgcgctcgccgaatgcctgccgctcgtaggccaggtcgatgtggtgttcgtgtgcgtaatcgatgatacggcgagccaaatcggcaatgtcgccggacttgttgaaggaacgaccacgcagcagcacgcgttgcataagagggcgcatcgccttgaccaacttgtaccggtctgacttcaccttcaccatccaaccgtcggcaaaatatagcaccacgccttcacgcgggcttgccttggcttcgccgattgcctgggcgacttcttccggcgaatggcagatcgccaccgtttccggccgcacgaagccgtcggcaagagtgaacgtttcctcgtgagcggcatcgatggagaacgattcggcattacgaatcagatgcagcaagcgcagcccggatgattcgtatccaacgatgtgccggtcggactcgcgatcgatgacttcaaacgccgccgtgacattccactcatgcaacatacgccacaattcggcacgtaccgctgaatctgaaggaaacgggcgctcgataagcgcggaataatccgtttgccccgacttcgaccagaagcggaacaatccaggagttcccgccgcgcccacgagcccgagaaatccgttctccttgcgctcaacgcgcacgggcaacgactctggatgttcttgagcgtgattgacgacttgggcgaacgatgtcccctccgtctcgtccacagcaaagaacttctcgaacccgcgttgcaccacctgaccgttgccgccgataaaaagccctcgcgcattgatggtgcgatccgtccaccgatgttcacgaaatgcctctgcagtgaaattgcacgcatacacgtctgtttcgccgcgcaccggaataacccgaacgtaaggatccgcgcgcatacgctccaacaggtttccattcggatcgcccggttccaacggtcggaacatcgcggtgtgaaaatgcttccaggacgaacgaatgtaatcttccggaacacggtcagcggtatcacgcgccgcattgcgacgcaacaattcgtctagaggaacgtcaaaatccctcgtttcccacagtgcgccatgacgttgagcgagtagcgccagttcggctgcataccggggattagcgtgttgcgcatctgccaccacatcccaccccgcatccaatgcgtcggcaatcatgtgccgtcccatggcaaccaccatgtcattgaatcgcttgccgtgctcggattgcagtcggtttcggacctgtgccgagccggcgatcatgagccgaatgtcatcgagagaaatcacgcaatgcggccacgtgttggcggggtcctcacaccatgagcgtgcccacgtggacttgcccgaagcgggcagtcctcgcagaataatgagctttgccatagccaagctcctttcgttgtgctgtggggcgagacaggtgccagcgatggcataaggttctgctcgccccaatattgcttgtattatgattcggctgccgaaaccgagccgcctggttcctgctgtgcggcggagtcaatgggcgccggcccgggggagtcgggcatatccagcggtgatacgtgcgttgaatcggtcgcgtgtgcatggaaccagtcggcaatctgtgtttcgcttaccggttgcagattccatgcgtccagtccaacgttgagggcttcgtggcgtgcgccctccggagacagctggtgcgtgtgaccatacagcagacgatgtccgtcgaacggcaatgcctgatcgcggaaacgtacggcatcatccggccagccataggcaagatcctcacggtaggggaaatgcgatagattgacggtctccgttgcctgcgggcggccaattccgagaccggtcagctccgccgtgctgttcggctcaatcgattcgaacagatctcgcgcgggtgcatcgtccagccaccagtcatcgtgattgccgataaccgcgtgcagatgcctgcagcgcagctgacgcaggcagctcttcagatgccggaccgatgttcggtatccgatatcgcccaaaatccacagctcgtcgtcctcgccgacaatccgattgatattggccacgattgcttcatcgtgcgcatcggtgtctgcggccttgcggaaattgagccgggaatcgtcaagcaccacgcccttcgcccaatcctcggcggccttgcgtccctgcgaggagaggagagcgtcatactgcgtgtgcccagggtcgaacgtggtgaatccgcgcagcacgctgaccagcggatgcccgaaatgcgtgtcagtagtgaaatacttcatgatctgttgttctttctgaatatgtgatggtatgcaatgggttttgctgcggtgcattgagttgcgactatgccaagaacgcatgctcgtgcaggtgcgtttatgaggcatggtgcgaacgagtcggctcgatatcaccggcaatgattcagctatgcgccaatgagaggtgtactgatcagatttgtttggcagcgagcaggctgcgcttgtttccggttattggctggaactgagcagtacgcaaaccctgtttgaaggcgcattcgagcatcgccggcaggttcgtctgctggcgcttggcgtgttcgttcacgccgttgctgctgaatgcgatgtgttgaatcatggtgtgcacaccataaggtcttacgtccgaatccgtcaaatcacggtgtgtgaaatgcctgttgtatataaaaaagtccggtgcaacgcacgatgataatgcgctgcaccggacctactgcagaaacaattgttacagactgtagatctgtgcgccgaacggccagagcgcgagcttggccattttgaacgactggatgccgaacggaatgccgatgatggtgatgcagttgagcacgcctgcacccagatagccgagcgccatccagcagccgaccagcaccacccacaggatgttggccaaggcagagccgactccgccgccgtattgcacggttttgccaaacggcgtcaaggtgagtcccgccatcttgaacgcttgaatgccgaacgggatgccgatgatggagatgcacagaatcagtcccaccaatgcccatccgattgcgatggccaatccaccaagaatgatccacaggatattgccgagaactcgcatgattagtccctttccgattccggtcgattccgcgcatgttcagcttcactattttgccagaaatcatgacggaaacactagacgcaacccttagctcgcccctgattcatacccggaccgttattcaggcggagcgtatgcgtaagcccaatccttttgtgaagattttgtgtattgtcaggcatgcgtgggtttcaccgtcgatttgaatgatgataggcttctcgatgtctgccgtacgaagaccccatcaaggagatgccatgaacctgtatcgctacgcgatgttcatcgcacgcgcctgccgtgggtcgttcgtcggcaatgttctgtttgccaatccacgaatggccctattctcgatgctggtgtagcggggacacgccttatgccgggatgtaccgatggcccatccgcagtcgacgtcgcatgaatcgctcaccatagccatcaacttacgcaaagccgcgaatcgtttgccgtatatgaatgcggaacggatggcggcttttcctttacgtccggactcatcggtgtcctcgcgtcttgacacaagcatggggccggatcgccacacatgacgttaccaacagaaggaaatgctgtgacctcacagaaaaacgcggaactcgggtccgccaccagttccgtaaagcctattgatccgcacacccgattcatcgttgtgggtgtgatcgtcgtcggctcgttcatcgcgctgctcaaccagaccgtcatgtcaccggccttgccggcactgatgcgtgatttcaatatcaccaccggcaccgtgcagtgggtgaccagcgtctacatgctggtctcgggcatcatggtgccgatttcaggctatctgattgataaattctccacccgaaagctcttcgccggagctcttgccactttcatggtcggcacactgctgtgtgccgtcgcgccgaatttcatgctgttgctcgtcgggcgcatactgcaatccgccggctccggcgtgctgttgccattggtcgccgtagtgccgatgctcgtctatccgccggataagcgcggcaccgccatgggcatggccggtatcgtcatggccgccggtccggctatcggcccggttgtcggtggtctggtgattgacagtttcggatggcgcccgatgttcattggcatcgcagtcgtgacactggtcatccttgtcggaggcacgatgatgctcaagaacgtcggcgagttgaagaacccaaagctcaacatcctgtccgtgatcctttcgaccatcgcgttcggtggcctgctctatggcttctcgtccgcttccacgatgggatggagcagtccggtcgtcattatctcaatcgtcgttggtcttgtggccttcgtcgcattcgtatacaagcaagtcaagctcgatgagccattgttgcgcgttgacacccttgccacccgcaacttccgcaactccgcgattctggtcactctgatcaacgccgcagtcgccgcaaccaacgtgacgttgcctatcttcatccagaatgtgctcggccaatccgccaccgtcaccggcatggtcatgctgcccgccgcggcggtcggcatcatcctgagtccggtcgccggcgccgcattcgacaaattcggccctcgcggcgtgggtatcggcggccttgcgctcatgaccatctctcttggtcttctcggcaccatcaacaccaggacatcagtgctgtttgtcgccgtgttctgcgcattgcaggcatccggtcaggctatcgccaacatgccgatcaacacttggggcgtcaacgctttgccgaacgacatgatcgcccatggaaacgccatcgccaacacaggccgccagatcgcggcagccattgcgacctcgcttctggtcaccgcagaaacatccatgaccgcctcgcacatgtcccagggtgtgaagtccgccacggccagcggcatcgcgttctcctacctgctgtgcgccgccatctcgctggtcgccctgatcatctgcatcttcaccgtcaccagccgtgccaaggagaaggccgcacgcaacgccaaggcctccgaggcgcaagcctccgccgaagtcgcggccgaaaccactgaaggccagcccgccgagcatcactacgccggcgcatacgtggcccccgccgcctccctgttcaagcaggcccaggaacagtccatcggcggaatcatggacgatcagccctacagctgcctggacagcgatgacatcacgcatgtggtgcgcgagttcatccgcctcaacgtctccagccttcccgtggtgaacggcgatggcaggctcgtcggcttcgtcagcgacggcgatgtcatgaaatcgattgccacctatgaatcccgtacggtttccaccggcaccggttcgacgatggtggtgttcgacgacgaaaccgtggcctccaaggtgcaggcgctctccggcaagaaggtgatggacatcgccacgcgcaaggtcgttgccgccacgcccgaccagcatgtcggagaggtggcccgaatcctcgccaagaagcagttcaagaaactgccggtggtggatggtgatggcagactcgtcggtgtgatccgccgtaagtccgtgatggaacatgccttcgatgcgctgttcccaaaggatgatcggtgattaggcgccatcatcgctgaatagaatgaatggaatatgaggcttcccttctcgcgggggaagcctcattgctttgtccgcggagtcttacggcacctgcgcaagggcaacgtcacgccttcatgattatactattgaatagtgtgttcctatcgttgcatggtgacgctaacgcatggcgtcacgatactgaagcctgccatctaacggcgggtacggctcgttgctggagtcgtgcacgcatacgcgcgtcggcgtgcgtatgccgtgatgtgacctttgtagtggaattgaagaattgagaacactcgtatgtcttctagtagtacaacaactgaaccaactgtgcgcgaaacacccgaggtttccggcgatgacaatgcgaatgcgcgcgcagcagtccatagcgcgaacaaacccggtgccgcctatgccgcagcagtggccaacggggaatccgagcgtgcgtggatccgccgtgtagtgcttctactcaccggccaggcgttctcgctgctgggctccaatattgtgcaatatgccatctggtggtggatcgtattgcagactaaaaccggttcggccatgctgctggccacgttgtttggcgtggtgccgcaggccatcgtctcgatttgcggcggctcctgggccgaccgtcacagtcgcaagttgctgattatgctgccggatatggtgattgctgtggtcaccgtcgtgctgtcgctgagcttcgcgatgggatgggcgagtctgaccatgattttcgtggtgctgttcattcgttcggcgggcggcggggtgcagacgcccgctgtgcagtcgttcataccggatgttgttccctcgggcaaactattgcgcgtcaactcaatatacggcgtgattaattcggcgaatatgattgtggcacctgcggtggctgctgtgcttatcaacacagtgccgctgtggtcgattctgttagtcgatgtgaccacggccattatcggcgtcggctttgtggcgttgatcaaagcgccgaagaagagcgcggaacatgttgcgaggcgtatggctgaagcggagaatagcgggcaacccgcactcgaaccgatgtcggatgccaatgctgatcgttcgctgattgccggcgtccgtcgtgtgtttgctgacttgaaagatggcttcagctacacatggcgccgggcgaacctgcgcaacgtggtgctcggtgacaccttggtgtgcttcgtggccgtggcgccgatgaaccttacgctgttgctcatgacccgcgaatatgagggcatcgatttgaatctcggattcatcaacctgaccaccgcctccgataaactcgccgccaacgagctgggatggagcatcggtatgctgctcggcggcgcgctgatgtctaccatcggtgccaagctcatccgcaacaacatgcgcgtggtcgccttcggcatcactctggtgggcgtctccgtcgttggtcttggcgtggttcacaatctgctggcgtatttgctgattgatgtggtgaacggtttggcttcggccatctgcatgggcccgatgcgcaccatcatccagaccgaggccgatgagaagatggtgggccgtgtattcggccttgacaccaccatgagcacactcagcatgccgctgggtatgttgatcttcgcgccgttggccgacgtgatcccgatttcgctggtgttcatcatcggcggtgtgctgactctgcccatcggcatctatctgttcggccaggcgcgccacaacaccagtgcacaggtgactcggacacaagcctgacagtcgcctgacagccacctcgcaggcgcaaagtcaactaccctatttgcgcatacagatcgtaagatgcatacttcggtagatcgtagacggtgatcgagaatggtgcggatcggccattgcccggccaatccacgaatgtgatatctccatagatgattgcgttctgtgcgttgcgcagtactagggaaatcttgatttgctgcccatcggatggcttgaatccgtctgttgtggcgcggacctcgccattgaacgtcgtgccgccgtccctgttgtctattttggatgttccgctgatggggaaggtagcggttccttgagcctcggtgacgttgtacgtatcagggctaagcacaacgaaatctacggtggccggggccgtgccctcgcccgcttggccggcgttatatacagtctgattcgggaatgccatattcagtgcttgcgtctgcgagaacacgatggaaccgtctttggcccgccccgtaatggtaatctgcggatactgcacctgctgggtcttactggtgttgcgcagggcgaaagcgtagtggacatacccttgctggtccgccgaccagccggattccactattttcagaggattgtcggtgacggtgtcttgattgtctccatcagcgccgtcagtgccgcctactccgcccgtgccattggcattgtcggttcctgacccgttcgaggagtgcccgccatcggccttatcggttgattggctgctggattgtgtcgaggaatcgggtgatgttgccgacccgataatgccaagttggcctgccaacacaatgcctcccgcaatggcggcgattatcagtgccgctccggcaatggaccacagcacgatggcgcgtttgctcaagtgcagacgccggaatagtcgagacgccgacgcgctgccgttcgttgttctcgttgatggcggatttgccgatgatgcgttcggtatgggcggattggactgggagaacagcgcctggcgaaactcttggacgctctgtggccgtttgctgggctcgaaagcgcacgcatagccgatgacggcgcgtagtcgagccggtactgcggcatcatcggcaagtcgctgctcgtagtcgctggcatcgggatatacgccggtcagcatgaatccgagtagccggcccagcgagaatacgtcggaacgcgcgtcggttttggcaaagccatattgctcaggcgaggcgaatccgtaggtgccaagcgccgtggtatcccgtgaacggttgcttgcctctgaccggatgcgcgcgatgccgaaatcgatgagatgcgcgccatcctgggccacgatgacgttggccggcgtgatgtcgcggtggataacgccgtgctggtgaagctcctgcacggcttcgcaaatttggtcgataagctgcacggccacattcggtgcaagccgcccgttttcctccgcaatttgcgcaagcgtgctgcccggcacgtaatcgtagacgatgacgaaccggtcgggcagctcgtacgtcgcttccacacgcggcagacgattactctggcaggcgctgagcgccgcccacacattgcgttgcgctaggggagagggaatcttcttgcgtacgaacgggccgttgccgtcaatgctcaccagttcggtgacgccggaaggtccgcgagcgagcgtacgctcgacatggtacgcatcgtcgatgctcatcgcatgcatcgcctgcttatcgtccatgtctctccttgatgccctcttacttgcgtctcactggtgagtgttgttgggccgaatgtcgtcaatcggccggtagcaacgtcgcctctcccatacgatacaactcgtcgtccgtggcaatgcggtcgaatccattgcgtatacaccagatgataatcgcgtcgcgtcgctgtttgcaccacagttcggaaacgcctgcaagacgaagtagccgttgggtttcacgtaatgtgcacttgagaccaaaagccagcataatggcgtgatctcggccggggcggcttttgccggagaaaatgtcataaaccactgtggcgttgaggccggatgcccgcaccacgtcggctcgtctcaggtcatgggcttccatacggtcgaacagatagtcggtcagcgtgcgtgcgctgacgagtccctcatcgagatactgctcaatgctggcgctggcgagcagccgatccaacagttcctcggtcaaatgttcttcggggatgtctgccattgcccatgctccttgtcgctgtgttgcgggtgctgtgctgcgccagcgtacgcggttgctcgattcccagcgtacaggacgccgacttttcggaaacacgccgaaaaattcagttgtcagctgatgtatggcccgcgcgtgtcgccgacaatggtcgatgccatccgtgtaggtgcggtggcggaaaggatgttcatgcgcggtatcaagcatcgacaataaagctaacatgcatacaaaatgctaatttgcgtacataataacaacgccatacactggtttcgatgtatcgcagagcaaagcgagcaataagaagggacgcaatgatgagcgaacgataccggcttgccatggcagtcggattgaccgtaacggttgccgggcttgcctcttctgtgctggtaatgctgctgcttaaggaaagaagggcatcatgacaacgccatttgatcaacaacctcagccggttccaccgtccgaaggcacgaatgacgcaccggaagatcgcgcgaatgcgcctaccgtgccgaatactgtaccggctggccaaccgaacgtagcgtctgatggtgctaccactactccgatgactccggctacggcatcgcagcggcccgccggcgcgccatttgatcgtgtatatgcggtcagtccgcaacagctgttccaagttattcacgaccagctgactactggcgccacgtttaccttggataacgaaaacacccagaccggagcgttttccttccactcctatgatggggtgaactgcacgctaaccgtagtcccgcagggtgcggcaggggccgccattcgtctggaggcgactggaaacgaaagcgccaagcgcgttgatgagttcctcgccgctctggacaagcgtattggtgtggctcctgcacccgccacacatggtgccggtgctgccactggttttgctggtgccgctgcgcctgccgtgcttgctccgaatgcacaaggggtgaagaagacttccaagctggctgtgttcgccattatttggggagtgttgttcgtactcgcccaatttgtggatgtttctggccgatcctggggcggactgctgttcgccacggtgattccggcactgctctcaggcttcgccgtatacgtgacccgcccgagtggcaaggtgcaaggccgagtgctggcctgggtggcagtcggtatcaccgttgtgggtctggtaatcggtggcgtgttcgtaattcgtgacggtgcgaaggccaaggctgatcgggcggaattggaagcatcgctcgccaccaagtgcgaagcatattcatggccggagtcggatatcgcggcgctgctgccgcagccgaaatccacaaagggtgaaattaaaagcgagtcttcggactacttctccatcgaggtgtgcgataccgacgccaagcagtatgccgactacgtcaagtccatgcaagacaacggtttcaccgtggactataacaagtccgctgacagtttcaatgccaagaacgccgatggatacagtgtgagcgtttctcgtgacactgacgacgaaaccatcatgtccatcactatccaggttccggagaagaaggaagatacgtctacggacggcgacgccgcgaagcaggatgataagagcactgatacgggcgctgattccagcgatgccaacaagcagagcgaccagtcttcggatcagaaggcgcagcagaacaccaatgacagtgctgacttcaagtccacgatggacagctacgaggcctttatcgatgagtatgttgccttcatgaacaaatatcagaaatccgataacgtggtcagcatggctaccgactatgccagcatgatgaagcgttactctgagttctcccagaaggtagacgccattgacgaaaactccctcagcagtgaggatttggcctactacaccgaggtcatgactcgatgcacgcagaagctcgcatcggtgggccagtgatcagactggcgtatcgaggtaacggttttccaagaaagggacgatgacggtatatgggtatacgcggcagacagtatacgccaatggatgagccggccttcaacaaggccatccccggaacggaggctctggccgggacactgaaagacacttttagcgcattccgtagtgggcttgggattaccgaacccgtggtttcggtgaattgtgaaggttgtggcgctccgctttccggtcatcgcaaagaagtcgttcgatgcgaatactgcgatcgcgaaacgcagctatagccaacatgccagcataacggccggtcttgcgattgcatagtcgcaagaccggccatgtgcattgagatatcgaggaaaacagatggcagttattaaggcgttcgccggcgcgctcggcggtacattcgcggacctgtggcgtgatatcatcaccgctggtccgttcacggaacacaccgtcgttgtgccgggcattccccgcggaagcaacaacgatcgcggttcgaatgaatacggttccgagggaataatcaccaatggttcgcgtatctatgtgccagagaatactgcggcgttcattttctctgaaacaggtatcgaaaacgtcatcaccgagtcgggcggttatgaatatcgcaacggggaacagagcgtgctcgccggagacggcatcggatcgttcttcaaccaggtcgccgatcgattcaccttcggaggtcagcctggccgcaccaaatatgtggccttcgtcaacctgcgtgagattcgtggcatcaaattcggcacttctgcgccgctggtgtataacgaccggttctatggcgtcgatttggaaattcgcgcacgcggatccatgtcgctaaaggtcactgatccagttcgattcgttcgtaactttgtgcctgccactaccgtgtcgtattcattcgatgatgaagggccacgtaggcagattctgtccgaattcgtacagtcgtttattgtggccatcaattcgttgtccaatgaatatcgtatttcgcaattgcccggcaaggcgaatgacatcgcagcatgcgtgcgtggcgatcgagccaatgccggtacatggaatgatcgttttggctttgaagtgtccagcgtgggcatcgaaagcatcgagttcaccgagcaatcacgtcagctcgtgcagcagttcgcctcgaataagatgaatgttgccgcatacgagggcgtttcccaacaagctggcaatatggctgcccagcagcgcattgcgcaaggtattcaagacaacggctttggcgatggcggcatgttgcttggtatgaatatggcgcaagccatcagtcctatgacggccgccccggttcaagcgccggcgccggaagccgctgctcccgcctctcacacggcatccatgtctgtggaagaacaagttgaggcgatgaagaaattgaaggaattggttgatatcggcattctctcccaagaagaatttgatgcaaaaaagcacgaaattctcggcctgtaaacggtgcattcatgcaactcgaaacagctgataatgagggaaacgctggtgcgacacggacaaaatggtgctcagggcttcgaactgggttgttcaatccgtttcgatatttcggcgactcagcgcttgttcgggccgccgtccgggaacatcaagtaagtgatgatgccggcggcggttccactggccagtgctccggtgatgacggcaagagcctgcatcgccgtgctgagcgtgggcttgcccgttgcggcagtctttgaagccttcaatgttgcggcactgggcttgcgtttctcggtggcggcgttgtcggcaacgttgccaccgtccgtattgactggggcattgtcggcaacggcctcgccgtcctgctcttgggcgcgccgttcgcgaatgcgttgctcaatgggatcgtcgaccaaagtcttgatgatgcgtgccagatcgcggtcttcacgacgtgcgatctcggcgctgaacaccgtacgtaaagcgagatactgcagtttggtcatcgggcttttgccggtctccaagttagacaccgtctgtcgcgcgactcccagctcgtcggccagttgctgagtcgtccatccggctaccttgcgaatcggacccaggttctcctgaaacttatcaatccaccattgttcgatttcagacgccgccattacgcacctccttccacgctgtcaccagtgtacgttacctgtaccgaaatcaatccaaaaaacagtgttcatgtgaaattcactgcgtatttgcgctttcgccggcttaccgagattagccttaaacaaggaataacagagtagaagcagaaggtatgcgcgtattcgatttcgacggaaccatctatgatggcgaaagcctgttcgacttgtacctgtattccgcccggcatgacccgaaagtgttccgctacatcgcccccgtgctgcggtacgcagtcaaatacaagcttggccgggccacgcttgaacaaatggaatacggcgtgggtaagatgaccgaaggctatctcacggaactgagccgatccaaacgggtggcgagcgtcgaacagctcgtggacgacttctgggaccgatattacgcacgtatcaagccttggtaccagcctgagtcggacgatgtgatcctcaccgcatccttcgatctgacggtgggggaggcctgccgcagactcggcgtgaggaatctcgtggccagcgaggtggatgtggggacgatgaaggtcacgtacctcaacttcagcaccaacaaggccaaacggttccgcgaactgtacggtccggacgtcgtcatcgacgagttctacaccgactccaaattcgatcagccgatgatcgacatggcccggcacgcgttcatggtcaaggggaacaccatcacgcaagtcaagtaggaaacaacagaaaacaacacaacgtaaccaataacgaaaggggaacatatatgagcatgccgctcgatctatacgtaatccggcatggcgaatccgaagcgaacgtcatcgtccaggcgggcgagcagggcgacaattccctgtacacgcaggacaacgtcaccgtacccgaccgctcctggagactcaccgccaccggacgcaagcaggccgactgcatcggccgctggctggtcagccagcagcagctgttcgaccgctacatggtctcgccatacgtgcgcacccgcgaaaccgcagccaccatggccctgcccaaggccaaatgggaggagaaccgtgtgctgcgcgaacgttcctggggcgagatcaacaccatcaccaaggacgaattcaaaaacaactacgcgcgcaactggaacttcaagaacaccgatccgctgtactggcgtccgccggcaggcgagtcgattgccgatgtggccgaggaccgtgtgcacaacatcctgacctcgctgagccgcaaatccgattcggaatccgtggtcatggtcacccacggcgacttcatgctcgccctgatgctcaccatcgaggatctggccgacgaggaattcctgcatcgcgccgattcggacgactggaagatcaccaactgcacctgcctgcactatacacgccgcgacccggaaaccggccgcacctccaagcgtgtgcgctgggagcagaccgcccggcccgtgctcgacgagacgaccggccgctgggaggtcaaggtggagccgtggcgcgaattcaagcgcccgtatctctccaatggcgatttggtggatgtggtgcaggccgtcgacccacacctgctggagtattacggcaaatagcctttcccggaagagagacttcacaaaatcttcgtgagctagaatggtgcgtggtgcggctggttgtgaatgccgtgccccaagcgagagcgaggagagtagtaatgtccaatatcttccaatggcaattgcatggcgacggcaagacgctggcgcccggcgaggtagtcgagcccgatgaacgtctgacttgggtgcgcaccgccggtatcggcgcacagcacgtcatcgccatgttcggtgccaccttcctggtgccgattctgacgggcttcgacccgtccaccaccctgttcttcacggctatgtccaccgcactgttcctgcttatcaacaggaacgtgctgccgagctatttgggctcgtccttcggcttcattgcaccgatcaccgcggtctccaccgccaacaagggcattgcggtcgccagcttcggcatcatggtcaccggtattctgctggccctggttggcgtgctcgtgcattacgccggctccaaatggatcgacatcatcatgccgcccgtggtcaacggcgcgattgtggccatcatcggcttcaatctggcaccttccgtgtggaccaacttccaagccgcgcccgacaccgcactggttaccctgttggccgtgctgctcgtggccgtgctgttcaagggcttgctgggccgcctcaatattttggtcggcgtgatcatcggctatgtatatgcctgcatccgtggccaggtcgacttctccgccatcggcgacgccgcatggatcggcttcccgaagttccacctgccgcaggccgatttctccatccttcccatgttcatccctgttgtgcttgtgcttgtggctgagaacgttggccatgtcaagtccgtggcccaaatgaccggccgcgactacgacaatcagatcggcaccgccctcatggccgacggcctgggcaccacgctcgccggcttcggcggcggctccggcaccaccacctacggcgagaacatcggtgtgatggccgccaccaaggtgtactccaccgccgcctactggtgcgccgccgcctttgccctgatcctgagcctgtgcccgaagttcggtgccgtgatcaacacgatccccgccggcgtgctcggtggcgtgaccacgctgctgtatggcatgatcggcatgatcggtatccgcatctgggtggagaacaaggtcaacttcgacaagccgctgaatatcatggtggcagccatcaccatgatcattgccatcggccaattcgcgttcactgttggtggcatttccttcaacggcattgccattggcacgatcgtgattcttgtggcctaccacggcctgaaggccattggcaaggcaaccggcactattgccaaagacgatccggatattttgtagtgtgttttagggctactgggctgtatcttggctcagcccttttgcacaatggcccctaccttcacgggtgggggccatttgcgtgttccatggagcggtgctcgccttacgtggtggtaaaacccatggggcggcaaatatcccatggggtggtaaaaccctcatggggcggtaggtgaaaatggctttattctgcggtttcacaatttcttcaaaccgccccatgggcaagttgccgccccatgggcaagttaccgccccgtggggtcataagtaaagagtgggatgacagtgtggcgagcaccaagcaaagtagggggcttacgctaagctcggaaagcttgcgtaatttgcgtaacctttgacatgaaaggccactgtgccccgtaataatttcgatgatcgtgacgattccgctgatttccagatgaacgacagcgcggaatcccgcccccttacctttggcgaacttggcgtacccggaccgctggtgcgcgtgcttgcggcagatgacaagaagaccgcattccccattcaggccgacaccctgcccgattcactggccggccgcgacattctcggccgagggcgcaccggctccggcaaaaccctcgcattctccattccgctgatcacccgcctcggttcctacgattcgttcggcgaaatcgcgatggaggagttccgcaaggaaatcaagcgccgcaagaaggccagcctggaagagcgccgcgccgacgacttcctgccgcacccgcgcggcctggtgctggcccccacccgcgagctcgcgaaccagatcaacgacgtgctgatgccgctggcccacacgtttggcatgaacaccaccacggtgtacggtggcgtcaagtacatccaccagatccgtgatctgaaggccggcgccgatatcgtggtcgcctgcccgggccgccttgaggacctgctgcgccagcaggcgctcacgctctcgtccgtcgaagtcgtggtcatcgatgaggccgacgaaatggccgatatgggcttcctgccgccggtcaagcgactgcttgagcagatttcgcccgacgcccagcacatgctgttctccgccacgctcgatcacggcgtggatgaagtggtgaacaccttcctgcacgatcccaaggtgcacgaggtcgattcggccaccaccgaacccgacctgatgacccaccacgtgttcgaaaccacgcgcggcgacaagcacgaactcgtgcgcatgctcgcctcgggcgaaggccgccgcatcctgttcacccgcaccaagttccaggccaagaagctcgccaagaacctgacgcagaacggcattccggccgccgagctgcacggcaacctgaaccagaaccagcgcgatcgcaacctcgctgcgttcgattccggcgatgtgcgtgtcatggtggccaccgacgtggccgcccgtggcatagacgtcggcggcgtggagctcgtggtgcaggtcgagccgccggccgacccgaagtcctttgtgcaccgctccggtcgtaccgcccgcgccggcaaggcgggcgacgtggtcaccctcgtgctgcccgagcagcgccgcgagacgcgccgcttgctgaaccaggccggcatcaagaccaagatgatcgaagtgacccacgattcgcccgaagtgcttgagcttgtgggcgaccgcgccgagcgcgtggatggttggagcctcgacaagtcgcagcccgtgggcaacccgcgcaagggcaagaacaggggcgccaagaacgcggcgggcgacgagtccggccgcggcggcaagcgcaagcacaatcgcaatcgcaaccgtgacgagcagaacgttgccgagaccgagttccagcacgagaacgcaggcggcgagtttgttgccgaaggcgagccgcagcgcaagcacggcgacaaggccagcaagaaggccgtgaagaagaaccgcaaccgtgcggaacgccgcgcaggcatgagcaaccccgaggccgagcgccgcgactatctgttcgagcatggcgatgaccgccgcgaggagcgccgcaagggcgaccgtcgcgacggatacggcaagaaccggtacgacgagcgtcaggacaatggccgcggccagtacggcaagaaccgtcgcaatgatcggtacggcaagggcgacaagttcgataagcgcgacagggccggatacggtcgcaacgatgatttcggcagccgcaggcacaatgcgggccgtgatttcgaacggtccgattcccgcgatttcgagcgtccgcgcaagcctcgccgcaatgaacgcagccacgaggattacggcttctcctatgacgagcgctcccatgacggccgcaggcagtccatgcgcaacacccgtcagggcgaaggcggcaagcgcatccatcgcaagaacgagaaccgcatcgtacgcgacgagcgttcagaaggtgccaagcgtcacgaacgccgcatgatcgccaaatacggcaacacggaaggcccgaaccgccgtcattccaagaagaatcgccacaatgcgccattccgtatgaagtctggacgccgttagtccgacagcgcgtatgaatcaggcccgacgacctttgatggtcgtcgggcctgattgtgttataggccggtgtttgcgatgcggatgcctgttcgcctgcctagcggccatgacgattgcacttatcgccgcagtcgttgtgatcgtggccatgccgaaacggcggtaatggcctgtacgcaccctagaataacggatatgacgcaatcgcagccccgatccaaacgcacgcccacccttgaaatctacgggagaatccttgacgcggcaaggcggatcgtggaacgggacggtgtggacggtctgaccatccgtgcgctgtccgcacaggccgatgtgtcgcccaccagcatctaccagcacatcggcggcaagcaggcggtgtgcgatgcgctcatcgacacatacttcaccgatctgcgcgaacagctcatcgccattgacgaatccgaccccgtgctgcgcctgcgcagggcgggcataatctaccgtgaacacgcgctggacgcccccggcatttacgcgctggtctggatggggcaggcgtcggactcggcccagcactgcctggacgccatcacgcagatcattcgatacggccaggcagcatctgtattccgcggcgatgacccccatctaatcgcatcctccatctgggtgtccatacacgggttcatccaattcgaactgcgttccgcacaaccccgcacacgcggccgcgaacgggtcgaccggtcgtacggttacctgctcgacctgctgatccgaggcattcagaggtgaatgagttagctccctctgatgagggagctcaccattgatacgctgtactgccatcggcgttgcggatggtgaaagtgggggattgctcgatgttgaggtccacggtcagggaatgctgggcgtcggcgctcgtcgaacgatagacgaagtgcttgttttccagcttcacggcctcggtacgcgcatccagcagccatgggttgcgacggcgcagcgcgatcagcgcctgatgcagccggtatgtcggctctcccagcgtggacagttcggcaggggagccggggaacttcggacgtacgtcgtcatcgccgccgaaacgctcctgcttgacgcccacatagccctgttcgtcgccgtaatagatgcttggcacgccgccgaccgtcatgagcaccgccaatgccaacgccgccttggccgggccaatctgcgatgcgatacgcgtcacgtcatggttgccgatgaacgtctgcggcacgaaggaatccaggaacgcgttgtgccgcttcaagttccaatccagctcgaagaagttctccgtctccagcgcatgctggatcgacttccatagctcgtattgcgtgatcgaatccatcgtggattcctcgatgatgcgcgggtaatcgccatggatcacctcgccgaaaatccacgaatacgggtgtgcggctttgacctgcggcaacacgcgcgcccagaacgggctcggcacggcatacgcggcgtcgaggcgccagccggcggctccgcgatccagccaatggctcatcacatggaccacatagtcaacggtctcgtcagccgaatggtccagcgccaccagatccccgtgcccctcgaacacatccaaagcgggttcgccattatcaccgacatgcgcgcggaccagaccatgccacgggttgtcggccggattcaagcgtccggcggtctcgtcaagcgccgcctgaacggccggatgattgcggctcacgtgattgaacacgccatccagcatcacctgcaatcccatgtcccggcaggccgcgacaagctgatcgaacgcggcatccccgcccaatcgcacatcgatatgcatatggtcgagcgtgtcgtatccatgcgtcgccgactcgaacaccggacccagcagcaggccggacgcgcctagatcgcgcacgtactccagccagggaattatcgcgtcaaggccgcggccatggaactggcgcgggccggcgggcctgatatcggcaccgcagaagcccagcggatacacgtgccagaacaccccgtacttcacccaatcgggcattgtgcggctcgaatccatgcttacaaccactgtgcacctcctgattgacaccgtgtccattttcgcacatcgcggtgcgaatcccgggtaatcggcatgaaacgcagtccgtgaacatgtggccaagctcacatattgggacattttcctgaggcgcgacatgccgtggctacgcttccaaccagtgccataagcagacgagagataccccaaaagggtcgcaatgaagagaacctttcccgcaaaggttattgaagaggaacagagggttattatgaccaccgccgcagcccaggccccggcacctggcaagttggaattcaaggacgattacacgccggacgaagccgaacgtgtgattcgcaattcgaagggactgcccgtaggcgtgcgtcccaaaatggtatggacatggaagaaggccctgctgtgggccgccatcgccatcgtatgtgcctgcggatgggcgattctggccgtctcgcgcggtgagcggatctccgccatctggttcctggtcgtggcgctgagctcctacgccatcgcctaccgcttctatgcctattacatccagatcaagatcatgcgcaccgacgacgcgaacgccaccccggccgagcgcgtgcatgacggcgcgaacttcgaacgcaccgaccgccgcgtgctcttcggccagcactttgccggcatctccggcgccggaccgctcgtcggcccgatcctggccgcgcagatgggctacctgccctccactctgtggatcatcctcggcgtgattttcgccggcgccgtgcaggacatgctggtgctgtggatctccgccaagcgccgcggtcgctctctgggccagatggccactgatgaaatgggtaagttcggcggtatgatcctatccatcttcctcgtggtgatgaccgccatcgccatggcattcctggcgctcgtggccatcaaggccatggccgcctcgccgtgggccgtgttctccatcggtatgaccatcccgatcgccctgatcatgggctgctaccagcgtttcctgcgccccggccgtgtcattgagaccacgctgctcggtttcgtgctgctcgtgctcgacatcgtcgccggcggatggatcgcctctatcccggccgtggccgccgtgttcacactggacgccaagcagctcgtcatcgccctggtgatctactcgttcgccgccgccgcgctgccgcactggctgctcgtcaccccgcgcgactacctgtccacgctgatgaagatcggcacgctcgtgctgctcgtcatcggcatcatcatcgccaacccgtccgtcaaggtgccgggtctgaccgaactggcctccacctccaccggcccgaccttctccggcaacctattcccgttcctgttcatcaccatcgcctgcggcgccctctccggcttccacggcgcggtgagctccggcctgaccccgaaggccgtggagaaggagaaccagattcgcatgatcggctacggttcgatgctcgtcgaatcgttcaccgccgtcatcgcgctgatcgccgcgatcaccatctcgcagggcgtgtacttctccaccaacatgtccgccgcacagatcaccgccgcatccggcgtgagcatctccgccacctccacgccgggcgaacaggccgatgccgccgtcaaggccgtggagtcgatgaaggtctccgacatcgaaggcaaccagatgcaggtcacctgggattccgtggacgagaacggcgcggccaagacctacgaaggcgccgcggcgcttgagcaggccgccgccgacatcggcgagacctccatcgtctcccgcaccggtggcgccaccacgttcgccatgggcatggccaacttcctcaagtcctacctgggcggccacgactcgatggccttctggtaccacttcgccatcatgttcgaagccctgttcatcctgaccaccgtggacaacggcacccgcgtggcccgctaccagatcggcgaaatgctcggcaacgtgcgcaagctcaagaagttcgccgacccgacctggaagcccggcaacatcatcaccacgctgatcgccaccgcgctgtggggcggactgctgtggatgggcgtgtccgacgcgaacggcggcatcaacgcgatggtgcctatcttcggcatctccaaccagctgctcgccgccgcctgcttcgtgctgatcaccgtgtgtgtggccaagatgggctactggaagcacctgtggataccggtggtaccgctcgtgtgggacatcgccgtgaccttcaccgccgacttccagaagatcttcgggccgctgagctacttcaccaccgcctccaagtatcaggcgcagatcgactccggcgagctgaccggcgaggcgctgaccaacgccaaggccgcgctgtccaacgcgtatctggacggcgtgctctccgtgttcttcctggtcatgatgggcgtcttcgtggtagtcggcatcgtggtcgtggcgcgcacgttcgccgctggcaagtacggtgccgaaacgacgtccgaggagccgttcgtggaatcccagtggttcgcgccctccagcctggtcgccaccgcgcttgagaagaaggtgcagcgcgaatacagcgccaagctgcatgagcttgtgcggaacgggcaggttgcagcgtagtgcgtcattggctccccttttttcaaggggagccaataatcagcgaaaggagacaaaatgctcggcaaactcgttgccgtatggcacggcatcgtctggtatctgcgtgagatcagcggcgaggcccgctacgaccattatcttgagcatttcgcggccgagcatcccggcgaaacaccgatgagcgaggtcgaattcattcgcgcccgcgaggaatacgaccgtctccaccccaataccagttgttgctgctgacaggccgcaatagcataacaacaccataaaacccgcgcgccatgggaactacgtagccattcttccgttacaatcagtgtgacggcttccgcccccgaagaagaaggtgttaattccccttggacgtctcactggcgcatttcctccaacaagtgctttccaacccggctctgaccgtcacaacgttgctgacgctgggagtcatcttcgtcaacggctggaccgacgcacccaacgccatcgccacctgcgtgaccacacgatgcatgcgcgtacgctccgccgtcatcatggcggccatcttcaacttcctcggcgtcttcatcatgacgcagctcaacgcctccgtggcctccaccatcagcaacatggtcgatttcggcggcgacacgaacgcggcgctcatcgccctatgcgcggcgctgttctccatcgtcgtatacagcgtgggcgcctcgctgctcggcatacccacctccgaaagccacagcctgatcgccggcctgtccggagcggccatcgccatccaaggcggcatcggcggcatcaacatgggagaatgggtcaaggtgctctacggtctggtcgcaagcctcctgttcggcttcgccgtcggctggttggtatgcaaggccgtgaccctgatttgcgctggcatggaccgccgccgcaccaacgggttcttcacctacgcgcagatcgtgggcgcggcggccatgagcttcatgcacggcgcgcaggacggccagaagttcatcggcgtgctgttcctcggcatggcgttctgcaatggccaacccagcgtgaccggtgtgatgattccgatctggctcatgattctgtgcagcaccatcatgggcgtgggcacgtccgtcggcggtgaacgcatcatcaaatccgtgggccaggacatggtgaaactcgagaaataccaaggcttctcggccgatctgtcaagcgcgctgtgcctgctcgtcatgaccgtgctcggcatccccgtctccaccacgcacaccaagaccagcgccatcatgggcgtgggcgcggtacgccgcctctccgccatcaacttcggcgtggtgcgcgacatgatgctcacctgggtgttcaccttccctggttgcggtctcatcagcttcgtaatggccaaactgttcatggtcgtgttctagaaaggaatccacccatcatggcgagacaaaaagacacgttctacttcgacggattccgccgcagcgcggactacgcatgccaggccgcgaagctgctgtccgaggtcatgcacgacttcaatccgggccagctgcgcgaacgcatggacagcatgcacgcgattgagaagtcagcggacgaggtgcgccacgacatgatggacgaactggtgaccgcgttcatcacgccgttcgaccgcgaggacatcgacgagctcggccacgtgctcgacgacgtgaccgacagcatcgaaggcgtgctcaaccgcatgtactacgacaacgtgaccgacatgcgcgacgacgcggtccagatgtcggatatggtggtgcgcgccacggaaagcatctgcgagctggtcaacgaactgccgcgattccggcattccaagacgttgcgcgaactggtgttcgccatcaacacgatcgaaacggacgccgaccacctgttcatcgagtcgatgcgcacgctgcacaccacctgcaccgatccgctgcaggtgttcgcctggcatgacgtctaccgtcacctcgaacagtgctccgacgactgcgagcgcgtggccaacaccatcgacagtatcgtcatgaaaaacagctgaggttggtttttcacaacctccctctgatgagccgagccgtgaagaaaacgccggaggcgtttttaggcgagggtgagtgacaacgagcgaataagaggtcagctgcaagctgtcctgaatcgcgttcgaggtggcatcgcgaagcgatgtcggagggagaggcctacttgaccaaaagccccctcacctatgggcgttgagccagaggatggcgagttgggtgcgattggtcaggccgagcttgtccagtatcgcgctgatgcgattgcggaccgtgccttcgctcaggaacagtctggcggcgatgtcgcggttatcgaggccctcggcgaccagcgcggtgatctcacgttcgcgctcgccaagcaggccctcgatggaatcggcggtatctctggaatcgtcggaatcggcaggatccggagttcgttcggtgagcttgccgagcacttccgcgccgagcaccacctgaccggccatcaccgcctgcagcgcgggcccgaccgccgccacatcctgtttgatgagatagcccttggcgccaagtcccatcgcctgcgcgatatacgactggtccgcaaacgtggtcaggaacagtatgcgcgcggccgggtccgtggccagaatctcgcgcgcggcatccaaaccgctggtgccgggcatctgaatatcgatcagcagcacgtccggtcggctcgccggtgtctcgaaataacggcgcacggcggcgtctccgtcatttgccatccatagcacctcggccgtgccggtggccgtcagaatcgtctccaacgactggcagacgatcggatcatcatccacgattgcgattctcatcaatccctcgattccatggtccaacgcttcttcggcacggatacgaacacacgccagccgtcctcatacggcccgcagaccgcggtgccgccaagggcgcgcacgcgcgattcgatatccgccaaacccatgccgcgcattagctcatcggccgaaccacgcatatcggcaacgccgtcggcggcgagtcgcgagccgacgtgcgtggcgcgcatcgcacgcgggcgggcagcggccgtccgggacccatcggactcggacacggccggccccggatcctgaatgaccaactgccagaacgcggggaagtcacgcaacgtcacgctcgcctcgcgcgccgcgctgtgatgcaccacgttcgacaatgcctcgcgaatcacggtcgcgaaacagcgcgagaccggcgcaggcgccttggcgatatcgttggccagcgtcacggcgaaaccgggggagatgccgtcgaacgacgtgacggcatcatcgatctgcgcggcgaaatcagtgccatcatcctcaagatcatgcaccgaacggcgcaccatcgtcatcgcatcatccaacgtcgcacccaacgtggcgaacccttgcgcagcgaccgtatcgttcgtcgccttggccaccgttttgccggcctgcgcctgcatgatcgcgcgggtcagcagatggcccacattgtcgtggatctcccgggcgatacgcgtgcgctcgccgagggtcgccatgcgaatcgactgggcgcgttcctcatcgatgtcggcgatgcgcgaacgagtggcccgcgaggattcgcgcgccctgtcctgcgcgtgcagcaacgcgcgccgcgcctcgtccgaggaggcgcgggcccggcccagaacgaatccaagcagggcgaccagcgtcatcaccagcgtctggagacggtcggtgccacgggcgaaccaaagcgcgatcagcggcaacacccatatccagcgcgcggcggccgaaagccacggggccgaacgcattgcatcggcaagggaacggcgagaggccgcggtccgcgagacactgggggagcggccacttgccgcagtccgtgccccagcccgggctccggtcgaggcgagggccggcagccgtgcagtatcgtaggcgatgagcggcatgaacgcgcaccatgaaggcaccgccacggcgatgacgagatacgccgtacacaagacccaagaccattgcgcgggacgcagccattccaccaatccggcgacggaaacggccaacagcaggccggcgatgaacacgccatcggaccgtagcccgacaagccaggccaaagccaggcccaacacgagtagcaagcccatctcggccaacacgcgcatggcacctccccggctcgacgctcttccaccaccagtctagcggtgtgcggaacacgacgaacttgacgggcgtgcggaattacccgcatgacggtccaagacaacgggcctacacttcccgaatagatgaggcacaagcgtcggatgtcgtcgacacaaccgtaaagggatgataccgatgattacgcaaagccacagggcgtccaactattcgatggacgagatcagcctgatgccggtcgataaggtgtacaaggccatgcagaccgacgccgaaggactgtaatgacaaatgtcacgcctgtacggccaagtcgtgacgtttgcctgtggcggcgtccggccccttcttgggatgatggaatcgccaaggaagggagtgactatgacaaccgacaacagagcttccgaacacgactcgacaaccaacccggctctggccgtgcacgtcagccaactggtcaaacgctacggcgacatggtggcgctcgactattttgaccttgacgtgaaccagggcgagattttcgggctgcttggaccgaacgggtccggcaaaaccaccgcgatcaactgcatcctcgcgctgctcacctacgattcgggcacgattcgcgtgttcggccagccgatgacgccgacctcctacgcgctgaaacgtcgtatcggcatcgtgccgcagaacgtggccgtgttcaacgaactgaccgtcaccgaaaacatcgactacttctgctcgctgtacgtgccgaagaaaaccgaccgcgcgccgctggtcgaggagtccatcgaattcgtcggactccaggacttccgcaagttccggcccggcaaactgtccggcggtctgctgcgacgcctgaacatcgcctgcggcatcgcgcacaagcctaacctgatcttcctcgacgaacccacggtcgccgtcgacccgcaaagccgcaattcgattctggaaggcatccagcggctcaaccaggccggcgccacggtgatctacaccagccactacatggaggaggtcgaacagatctgcgaccgcatcctcatcatggaccacggccggcacctggcgctcggaaccgccgacgagctcaagaacatgatcgacacgggcgagcgcatcaccatcgaaacgctcgatctggcggattcggcgatggccgaggtccgtgcgctgccgtgcgtgatcgaagccacctacgacggcaaggaactcgacgtgcgatgccgtcgcggcgaacacaacctgaccgacgtgctcgacgcggtgaaacgctccggcgccaacatcggccacctgaccagtcgcccgcccaccctcaacgacgtgttcctcgaactcaccggcaaagcactgagggactgaccatgctcccctcagtcggcaagcaaataacttggctcccctctccgaggggagctgtcgccaaaggtgactgaggggagttcctgagtaaggagacatcatgtggaccacatttctggtcgcattgaaagcgaacttgcgtaaccggtcggcgttgttctggatgaccgtgttcccgattgtgctggcgaccatgttcaacggactgttcggcgggctggccgaagcatacgaactcaagccggtgccgatggccgtcatcgaagacacccgttggcagcaggcggacggtgcccgcaccttcgtagacgcgctggccggggaaacggaatcggcctcagacgacacgacctacgccgaaatcgaccaaaagctgctgaccatcaccacagtcgacaccgtgaaggaggccgaacaacggctcgccgacggcactgccaacggctatctgaccgccgacaataacggccgattggcgatgaccgtgagccgggaaaccgccgtcacagccaaggactccacgcaaaacagcggactggacattagcctcgcggccctgcgcagcgtcatcgacctgtacaaccgcaccgacgccgttacccggcagaccatcgccgacaatccacaggccgcgctcagccggaacttctggaacagcgtcgggcagaacgtcgacatgacccatgagacgacgctcacgcatttccagcctgacgagatcgcccgatactattacgcgctgctggccatgtcctgcatgatggccatgggatactccatcagcacagtcgccgccgcacaggcgaacctgtccgcgctgggcatacggcggaccgtagcgccgctgagccgggccaaacagctcgtcgcgggcttcctctcctgctggctgtgctcgtcggtcgccctgtccatcgcattggcctatatccggctcgcctgcaacgtctcgctcggcggacgcgaaccggcggcgatcctcgcggtcatcatcgcctcgttcatgaccagctcagcaggcaccctgctcggtgcggtgccgaagctctcgtacaacacgaaatacgggctgtcgaccggcatctcctgcacgctgtcgctgttcaccggactgtacggcgggtttgccatgcagatcagcgactggatagcccgcaacgcgcccatactcggcaccatcaaccccgcacagcaggtgacgaacctgttctacgacatcctgtactacgacagctaccggccgttcatcaccacctgcatcattctgctggcgatgagcgcggtattcctcttggccggcatcgcaatgctgaggaggcaacgttatgaacacctgtaaagccacgctgcgcgtgctgttcgcgcaccgggtctacctgatgatctacctcgtattcataggcatcctgatgatgtccatcagctgggcgatgctgacctccgcatccggctccatgtccgcggtgttcgaatcgaccaagacgcgcgtcgccatcatcgaccgcgactccgaccggggtgatatcgccacgtcgatgcgcgcctacctgcgcgattccagcgaactggtggacctcgacgacaccagcgaaacgctgcaacaggccgtcgcctcgaactgggtggacctgatcgtcatcattcccgacggattcgctgacgattatgtcgccgcggcggcggacggcgacaatccgccgaacgtggacacggttaccagctacgcatccggctccgggtcgatggcgcggatgaacgtcggcgggttcctctcgctcacccgcaccgcactgatcggcgcgcagacgagggtcgaccaggcggcgctcgccggcatgatgaacgctacaggaggggccgccggttttgatggcgcgagtctggaccaagacatgctggactcgctgccggaagggcaagtcgacaagccggatatcaaggatctgtcccaggccgccaaaatggccgccgaatcggccagcgatacagacgtgaaccatcagatcgccgtggtcgatacgccgaccgaggagtcggcaagcgctgcggatacggcggtcagcggattcggcggcaccatgaaaaccgcgctgtacccgctgtccctggcgatgaccatctgcggatcgatgatcctgggcgcgttcaccaccggcgaggtgcggcggcgtctcaccgcctcgccccgacgcatggtcctgatgggactccagcggttgctgacgttgggcggattcgcgctcgtcgtatgcgtcggctatttggtgctgtcaatcggtctgatgatggcggcggggctcgatccgttgcacctgagcgtcgggggagtgctgatgacgttcggcgcgacctgcgtgtacgcgctgatgaccgtcgcctgcggattcatgctcagcgagttcgggctctcggaagaggcggccaacgggttcgccaacatcttcggcctgctcatcatgttcacgtcgggtgtcgcattgccgattgacatgatgcccggcgtgatggtgaccatagccaagttcctgcccggctggtggtattgcaccgcgatcgacaacgcgctcggcttcggcacggcggcggaaaccggcataagcgtcgccggctggtccggctcgctgggattggtcgcactgttcggtgtgatgttcatctgcatcggcctggccgccggccgcttccgccgatcccgccccgccctggccgcgcccgccaccacgcagctggccgagtgagaaatcagcctttcaaccgataccgctgtgccgggtcgtcggcgaacttgactcgggcgacccgcccttccttcatcagctcgcgcataccggatgtggcggccagcggcgtcaactgcagttcgcgcatgatctccttgacgctcatggccgaatgccgctccagtacggtcataatcgccttgaccacgtcgcccggtgaactgttcgccatcgtgcgctgcttggtgatggtcatcgtgaacgtgttgatgtcgttgcgcgtggtcgccggctcgatgccggcctcgcgcaacgcggcggcgatgcgctggtagccgtcgccgccttccgggttcacaaacccgccgcccggatacggcgtggactccagcagcgtgaacaggaactggtttcgggtggagacgaacggcgcgcccgtcaccggatgagggctcgccagcacatcatgtgtcaccatgccgtacaggccacccggattggtgatctcgatgcgatcggtgaacacgctgatatgcacctgcgtgccgcgcgcatcgggcgaataatcacggtgggtgagcgcgttcgcaatcgcctcgcgcaacacgagcggcggatagtcgggcttcttcgcgccaatccaacgcatcaacgagtcgaccgcatcgtcgatcatcaccggaatcgaaccgaccaccgacttcgaggcgaccaatcgttcgtcaccccggaacacatcgtcccggctcgtccccggaaacacggcaatcgaaatgccgagccgcggatagaacttctgcggatagcggcccaacgccagcagtccggccaaggtggggcgcaggattccgccgacctccgactcgtcggaatcatcatggcgcaacacctgcagatccagcagcacatcgatgccgtctcggtcggcgaacacgcgcggatgctgttcgcgcacgcgtgccaacagtccggcaacaagctgcgggtcgaggtcatcggtcgtggcgtcgggcacgatatccagatcgtatgtgggctgcagatgctcctcgatgagccggtcgacctcataggaggtcatgcgccggtcgccgtcgccggtacggatgaacgagccgccgtgcggtccgagcgcggtggtgaagcagggcttgtcgcgcggcagcatctcgtcgatgcgcgcgaacaccagattcgcgccttcgaacgggcaggtgacgatcacgggccgcaccaccggcgtcatcttctcgcacgcctggctcagcgcctcctgcatggcgcgcgcgtcgaatccctcgaccggcgtgaacccgttcttttcggacaggcccaggataatccagccgccggagccattggagaacgcggacagcgtatcggtgatggtcgaggagatcttgcgcttgcattccttgacctcgcactgttgcgtatcgttgccgatcagacgcatgagttcgatcagctcagtcattttggcagtatagtcatcgaccatggcggcctccttgaaaccattgtgccccataatccgccgcccgctcgcctccagccccgccagttcaccccaattcatgcagaattcatgggccaaaccagacgaaacgaacgtcgatgtagggttcggttccgcgtgttcgccgatgatatcggccggtcgaggcgggcgggctatgttgggtggcgtgggaatcttgcgcgtgattgatgctacggctgtgtgcttcgctctgggtatatccggcccgatcagcgggactcagccaatgtgatgccgcccgcagccatctgcttgcgggccgcaacaccaagttcctcgctgaccggcacggtcagatcctcgaacacggtgacctcgaagccgagcttcttggcatcgagcgcggtgtccttgacacaatgcgattcggcgatgcccaccacatccacgcgactcacgccggcggccttcagcgcgttggccagcgtcttgccggcggattgctcggcctcgacctcctcgcgggtctggatacggtcggtattgtcctcgataccctcaaaaccggaatatgccgccgaatactggcccttcttgaaatgatgctcgatattcagcgccttgatcgccggatgcaattcggcgttcagcgtgccggccgcaccatgcttcggccacgtgtccacgaaatccggctccgccgaccagtgcgcgcccggctcgatatgccagtcctgcgtggttgcgatatacgcgtactcgctgcgatgcgcgttcacataatcggcaatccgctcggcgaccgcgttgccgcctgcgacacccagttcgccgctttcacagaacgtcggctgcacatccaccacaatcagtgccttggtcatcgtcattccccttattgccttggattcgttttgaatattgtctcgaactcgacgtgcgattgctctcatcatagccatgcgcggccctgtgggaaacgttcgggcttacactgcaagcagcaatcgaatacaagaaccaggggagggcgaccaagaccatgctggaccatctgacgttgcacgtgaaagacatcgaccgtagcatcacattctacaaacaggcgctcgcaccgctcggctatatcgtcaaggcgcatcatgagcctacgctcggattcggcgtggatgacggaaccctgcactccgatttctacgtgtcaccgattgaagggctggaggcggaggcttcgccggtcacgccggtcacacacatcgcgttcttggctgacagtcagcaagccgtgcaggcgttccatgcagccgcgctcgccgccggcggccgagacaacggcgctcccggtccgcgcccgtaccatcccggctattactccgcattcgtgctggacccggatggcaataacatcgaagccgtcgtggattgggctcattcgaacgagtaaaaacatatccgtatcgtgcctcaggcggcatcgacggcgtaggctccaaccagtcggatttgtggtcgcaacggcggtataggtcacatcacgcaagcgtgaaggtgatggtctgctcggcggtttcggtgccgatccatgtgccggctttgcggttccaatccatgccgtccgcgtgcagtgcgtcaatgccgtattgacgtgcatgcgtgaccagccagcctgccgtctgccagcaaagtcgagtgcggttgtcggcggacaggccgtccggcagcgtgatcgtcaacgttgtgctggccgtattggtcgcagcgccgttgttcgtgccggttttgccatttgggggcacaaccgagacattgacattcggcagtgtacctcctatggcggcaaccaacccgtccgcgtccgaggaggttgctggctccaacgcgcacgtgacgcccgccgaccgttcaccggtcagccccgaggcccaagcgcgtgccatcgcatcccatgtggcatatagttccggatagcctgagcgctgcacctcctgcgcggcgtcctccaccggaatcgtctcccaatccggcacctgcagcagatgatcgtagaagatgtttgtcgcataggtcatgtcggacacctgctccgccgtgccccagccttggctgggccgctgttggaacaggccgatcgaatccaagtcgccgtagtccagattcgtcagcctcgactcctgcatggccgtggcgatggccaccgtcgccgcgtgatccggcagtccgcgcgtgacggcgatgttcgcaatcagcgccgcgttctgcgcctgatcaggcgtcaaggtgcggcgggctccgtcggacgacaccgccgcgcaatatgcttcctcggccgtgcgcgcggtctcgcgaggcgtgaatagccgtggcagcagcgtccatgccgcgatcagcgccgcaacaacaagtatgacggctgcaatcagcgcgcccgcgccatgggagcggcgtctgccgtaccgcacctgttgtcccattgcgcctccaatatttcggtgtcatggctgaccgtgaccggctggcctatgcagcatgcgagatttgccgtgttccggctcggccgtcatcatgacagcgtggcatatccacctgaacgacggctgcgccatcacgcgactttgtgacaattcttcacgcttcctgacatccgcgcaaatcagcccctcgaaaccgagaatggcggtcgggattgctccgacaccaagggagctgctgccgctattgtgtgaagggcgatttgtaccgggttgaaggagaggaacacatggcacaattgcagccgtactgcgcgattgagggcaatgatgatggattgcccgtcgtgttcgtgcatggcatgggtgtggaccatcgctcgctgatgatgctcgacaaggcgtttgacggcaatgattcaattcgacgtatatatctggatctgcccggtttcggccgtacgccggcattgcccgagcatgcctgcggactgccggaaatagcggattggctgcaaacggccattgacggtcttgtcggtaaagcggctccattcgccatggtcggcaactcgatgggcggtgcgcttgtccgcgaagtattggcgcgcgaacctcgccgagtggccggtatggcattgatcgcgccggtcgtggacccgcagcatgccggccggcatgtggccgaacatgtggttgcacagcccaatcccaagctgacgcactccttgccacaggaacaggtgttcgatttcattaccatgggcgtcaaccagtcattcgacgcgtggcgacgctaccaacggttcatcctgcccggcgtggcgttgtgcgaccgtgcggcatgcaaacgactggatcagcgctattggctggccgataatcccgaggaaatgctcggcatatatgcgggtccggtgctcatcgtcaccggcaagcaagaccagatcgtcggatacgaagatcagcaagccctgttgccgcactatcccaacgccaccttcgtgacgttggacaatgccggtcacaacgcgcacatcgaccaacccgaagccgtcatcacgctcgtgcgcgaatgggtggctcatatggcgttcgctccgttgagctgacggtctgctacagtctgccgaagcctatatgcatatgagcgaccaatgccggttgacgcaatacgccttgcaaggtatatcgtttttcgatatagtcatatcgatgttcgcggtgtcgccaaaaaaacgtcggcacctgaaaggaccgggctatgaaaaactacatgaaccgatgggtgttgctcgcgttgaaagccatcgtgattctggtctggctggcctgcctatggggccaactattcgccgtaccgggattgagcggcgcgctggccggcctctacccgagccagacgtcgatgcactggccatatctcattatgggcgtgctgttcctgttctgcatcgaagcggcgttcgtggccgtatggaaactgttctccttgtccggctcgggcgcgaactcgagcaggtgatttgagatgacgattcgcatcaatctcgacgtcatgatggccaaacgcaagattggcgtcggcgagctcgccgaacaaattggcatcacgcccgccaacgtgtccattctgaagaacggacgtgccaaagccgtccgcttcaccacgttggacgccatctgcaaggcactcgactgccaacccggagacatcctcgaatgggaagatgacgattgatcgacacgccaccggctcgaactcatggttcaacttgtagtctctcccaaaatcaatgatgccctatcatcctgcaagacgatagggcatcatcatgtgattatgcgcagctgatatgtcgcgttgttatcactcggcgtccgcggccggtgcctccttgggcgcagagaggaagtgctcctcgctgggcagcacggcgttcaggatcacggccaccacgaacgccacggcgatgcagttcgaggcgaagatttgttggaacagtgccgggaactgcgtgaagatgtcgctcacctgggtgaagccgatgccgatggtcagcgaaagcgccgcaatcgtgatgttgcgctgcgtgaagcccgcctcggcaatcatctggaagcccgaaagaatgatgttgccgaacatcatgatcgtgcagccgccgagcaccgcctgcggcagcgagttgaacacctcggcgatggccggcacgaagctcgccagcaccagaatcagtccgccggagagaatcaccttgcggttgacgaccttggtcatggccaccaatccgatgttctgtgcgaacgaggtcagcggcagacagccgaacaggccggatacggtggagatcaggccgtcgccggctatggcgcccgcggtctcgcgttcggtgggcgtacggttcaggcccaccttggtcagcgcggcggtgtcacccagcacctcgaccgaggagacgacgtagagcaggccgatggagatgatcgagccccagtcgaactcaggcttgaacggcatgaactgcggcacggacacgatggcgaggttctggaaaccggagaaatcgaccttgcccatgcagatagccgccacatagccgaccaccagaccgaacagcacggacagctgcttggccgtgcccttcatcaacagctggaacgccaggcaggcaaccaaagatataagcccgagcgtcaggttctgccaggaaccgaagtccttggctccgctgccgccgccgaagctcgtggcacccacgttgagcagcgagaatccgatcgacgtgaccacgatggcggagacgatgggcggcacgaaccgacgccaatacttggccgtcaagcccagcacaagttccagaaggccgccgaccattaccgcgccgaccaccgcgccatagcccttgtccgcgcagatcgccacggcggccgccacgtaggtgaaggagatgccggtgaccatcggaagtcgcgagccgatgagccacgcgccgtacagttgcaggcaagtgcccaggcccgcaaccagcaggccggactggatgatggtggccgattgggccggggtcatcttcgcggccgaggcgacgatgaagatcggggcgaggttcgccacgaacatggccatcacatgctgcaggccgaacggaatgcccttccagaaggatactggcgcgtccagcgaagacaacgcctcaaaggatacggaatgattggttttcttctctgacatgattctcttcttctctctgttgctcccgccggcgggagcagccaatgtgctcagtgcctaaatgtgatttcgccggtctcgggattcatggactcgacgatggccagcgaatccacatcgtagccttcagcgcgcagcgcgtcaccgccgccctggaagcccttctccacggcgatgccaatgccctcgaccgtggcgccggctgcttcgcacagatcgatcagaccgcgcaacgccttgccgttggccagaaaatcgtcaataagcagcacatggtcgccggcgttcagatacttcttggccacgatcaccgggaactccttctgcttggtgaaggaatagaccgtggtggtgtactggtcgccgtcaaggttgatggactgcgccttcttggcgaacaccaccggcacattgccgaaatgctgggccgccacacacgcaatgccgatgccggacgcctcgatggtcagaatcttggtgatgtgcttgccggcgaaatgagcggcccatgccgaacccatgcggtcgaacaggcgtacgtcgcactggtggttcagaaacgcgtccaccttgagcacattacccgccttcaccgttccctcgctttggattcgctcctcaagttcctgcattgaacctcccattgttgtatgtcagtgaatgatatggatactcgtaagtgtacgttgtcctgcgctgacccgtgcatgtggtaaacatgaatgtcgcgattcaaagggaggcaacagtgtacgacgagccggaagtcatcgcacgcagcgcacaggaactcgtgggcgacctgaacccgcagcaggcggaagccgtgcaataccgcggtcaggcgctgctgatcggagccggtgcaggctccggcaaaacccgcgtgctgacccgccgcatcgcctggatcttgagccagttcggcgcatggccgagccagattctagccatcaccttcaccaacaaggccgccgccgaaatgcgcgaaagactcggctcgctgatcggcccggtggcccagcgcatgtgggtctccaccttccactccgcctgcgtgcgcattctgaggcgcgacggcaagtccatcggactcaagtccggcttctccatctacgattccgccgactccgagcgactcgtcaaaatcatcgccaccgaattcaacctcgacatcaagcgctacactccacgctcgattctcggccatatctccgacctcaagaacaatctgaccggttggaaggaaaacctcgccgttcacgcgcccgacttcacgcccggccagcgcggctaccagttcggcacggtgggcgaccttgaagccatctacgcggtgatctacgccgaatacgagcatcgcttggccctggccaacgccgtcgacttcgacgatctgatcggccgcacggtcgagttgctgcgcactgacccggccgtcgccgagtactaccatcaccgcttccgttacattctggtcgacgagtatcaggacaccaaccacgcccagtacgtgctcgtgcgcgagctggccggcgtggacacgggggagaaggccatcccgggcgcgcctaacgccggcaagtccggccccgcctggatcaccgtggtgggcgattccgaccagtccatctacgcgttccgtggtgccgacatccgcaacattcaggacttcgagcaggacttcccgaacgccaagaccatcatgctcgaacagaactatcgttcgacgcagaccattctggatgcggccaacgcggtgatcagcaacaacgagggccgcaagcccaagaaactgtggaccgcgctcggcaagggcgagccgatcgtcggctacgcggcggacaacgcccagcaggaggcccagtgggtggccaccgaaatcgcgcgcctgcacgccgaagcgggcatcgcctactccgacatggcgatcatgtaccgcgccaacgcccaatcccgctcgctcgaagaggcgctgatcaacacgaatcagccgtatcagctcgtcggcggcaccaagttctacgaacgtcgcgaaatcaaggatgcgctggcctatttgcaggcgctcgtcaatccggacgacgatgtgaatctacgccgtattctcaacgtgcccaagcgtgggcttggcgaccgcgccgaaggcgtgctgctcgcctacgcgcgtgagcatggcaccagcttcttctacgcactcatgcacttggatgagatcgaggtgccgacacgcaccgccacctcgctacgagcattccgcgatctgatgggcgcgctctcgcagttcacgcgcgcgcacgactccaagcccagcgagatcgtggccgaagtattggagaagtcgggcttaagggccgaactcgagaaatccgtggacccgcaggacgcctcccgtctggagaacctctcccagctgcagtccactgccgccgaattcgaacagaacacgcctgacgccacgttgtccgcattcctggagaccaccgcgcttgtggccgactccgaccaactacccggcgaggcggaggactccggcaaggtgacgcttatgaccttgcacaccgccaagggcctcgaatacccggtggtgttcctgaccggcatggaacagggcaccttcccgcattcgcgttcgatggaagacaccactgaactgcaggaggaacgccgactcgcctatgtgggcatcacgcgcgccaagcagcgactgtatgtcacgcgcgccgccgtccgctcccagtggggccaggccgccgatatgatgcccagccagttcctcgacgagattccggattcgctgattgattggaaacgccgtgaagccggcgtggagcgtatgcgcgccagctgggagaccgatggattcgccgacgatttgggcggctgggatgatgacgattttggcggcgccgcgtttggcgggtcgtcgacgttcggctcgcgtggttcgtccggttcgggttcgtcctatgggtcgcggtcgcggtatgggtcgtcgtatggctcgggttccggctcttcgtcgtatggttcccgttcatcgtcgtatggttcccgctccggctcgtcctcctatggttcccgctcccgttcccgttccggttcttcgtccggttcatatggtggcacccgtggcggcaaagtcaccacgcgtcgtaccgcaccgaaatccgattcgaccggctctgccgtgcctagctcgaagctcaccaaggacaatggcctgaatatcgccgacttcgccgtgggcgacatgatcagccacgaccagtacggtctcggcaaggtcaccgacgcacaagacaagggccgcaattcggtaatcaccgtggacttcggctccgccggcgtcaaacgcctcatgctccgcgtagcgccgattgagaagttgtagataaattggcccctctgacgaggggctgagttatataccaaataaattcgcaaaaaacaagacttgtgttcttcatcacagtgtgggcataatgcggaggttgtgcctacgagccctgggaacaggggagaggaaaaagtagttatgaagaacaagctgtttgcatccgtgcccaatattctgttcggcgcgctgatcaccatcgcgccccagacctttgcgcacgcctgcaccggccatgacatgccgggtgcctgccactactcgcagcaggcggccaccggcatcggcgtcgtcatcctcgtgttcggcgtcgtggctttgttcgtcgccccgcagattcgcatcggcctcaatatcgccgccgcagccgacgccctgctgctactcgccgtacccacctttctgatcggcatctgcaagggcgcgatgatgcactgccgcatggttatgctgcccacgctcatcgtgctcggcgtgctcaccatcgtgttcgcggccatcgccatctggctcgactctcgcgccgccaagcgcaactgatcgagcagacggccggagcccagccattgcgaacgctggactccggcctcgcttattgcaaccgcactataagcaacataaggactcatcgtgccatcccatatcgcattgcgcggccttccgattgaaaacctcaaacgcaagccgttccgcaccggcgcactgctcgccgtcgtcaccatcctcgcgctgacattcttcggcggcaccatgctgaccatgaacctcaacactggcatgaccagtatggagaagcgcctgggcgccgatctcatggtcgtgccgcaaaacaccgtgcagaaggccgaagcgctgctcaccaacggcaatcccagcactttctatttcaccaaagacatcgccgacgaggtcatgcaggccgacggcatcgcacaggccaccgaacagacctatatatcatcgctggccgccgcctgctgtgccgaaaagctgcagatcatcggttacgacccggacactgacttcgtcatcgaaccatgggtcgcctcccagttcgaaggaccccttgaagacggtcagatgattgcaggcgcaaacgtcaacgtgtccaccgacggcaccatcgaactctacggccgttcatggccggtcgtcgcccagctcgccaacaccggcaccagcctcgacaactcggtgttcatcaaccaaaacaccgtgcccgacatggtcgccgcctcggccaaggtctccaagcaggtcatgtccgccgaatatgccggcaaagccgtctccaccgtgatgattaagacgcagcaggggtacgaagcgcagaccgtagctgagaacatcaagcgtcttgactcccgattcgccgatttggggtacgtataccccggcggcatcaccgccaacaccagaacttcgctgaccgcgcttgtcacctacctcaagattttcgtggcggtgatctgggtaatgggcgtgattgtgctgctcgccgtattcgcctcgtcggtgaacgaacgcaaacgcgaattcgcgtccctgcgcatcatgggcgccacgcgcggcatgttgaatgccatcattctgaaggaatccgccatcatcggtctgatcggtggcgtaatcggcgtcggcgcggccagcctggtgattttcccattcagttcgctgatcggcaagcagcttcaattgccgtatctgcaagccagcccggttgcggtgatcggattcattgccgtgaccattgtgtgctctacggtcatcggcatcatcggttcgctggccaccatgtggcgtctcggccggcccgaagcctacctgaccctgcgagagggggagtgatatgactgagacaactacgccgcttcagccgaccacggttgagccgaccaagctccagccgaccacgccagctcagccgaacgcgccgactgcgccggattcgccgcacgtaaccgagacgccctccccggaccatctgctgaccttgacggacctgacccgccagttcgtccgccgcggcacgccgttcgacgccgtcagccacgtgaacctcaccgtcgatgccggcgaattcatcgccatcgtcggccggtcgggcaacggtaaaagtacgttgatcaacatggtcgctgggctgattcgcccgacctcgggaaccgtgagcgtggctggacgcaatgtgtccgacttgggcgataaagcactgtccgtgctgaggaatcgcaccatcggattcgtgactcaaagccagaccctgctcggcaacctgaccgtgctcgacaacgtgattctgcccgcaacgatgtttccggagccgctgccgttcgcccaaaacgcagaagcaacggatgccgttgctcaggtggacgctgttgcgtcgaccgatgctgtggcacaagccgctgccaccaatgatgaatcggccgccgattcggccgccgacccgttcatgccggatgtcattgcgccaatcacagaccgggaaaacacgccgtcaaacacggctgcgagccgttcggacctgttcgccacccgagctcgcacgctgctcacccagcttggtgtcgccgatctggcagacagctacccgcgcgagctgtccggcggtgaaatgcggcgcgtctccatcgcccgcgcgctgatgaaccagccgagcctgctcatcgccgacgagccgaccggcgacctcgaccaagagagcaccgacatcgtaatgcgtctgctcagagaccaagccaacaacggcacggcgattctcatggtcacccatgatcccgatgcactcgaatacgcagaccgggtgtatcgcatggacgccggagtgctgtccatagcctcggtgtaatatggtctgctggtgtctgccaacaggtagataccgtctggagtcatagcccatcagcgggtcggcggtaggtaatcgcaagagaaccaacccgttcgtgttcgttcacgacgaagcgctggggaggcccgactcagcgcttgccaggcatatgcaaggcaagcgttccgttcagataacgacagaaggattaatccaatgacgaacgttcagcgttctcgccgtcaggtgcgtctgtctcgcgccctcggcatcgcactgacccccaaggctcagcgcatcttcgaaaagcgtccgtacgctcctggcgagcacggccgtgaccgccgccgcaccgagtccgattacgcggtgcgtatgcgcgaaaagcagcgtctgcgcgctcagtacggcatctccgagaagcagcttcgcgccgcttacgagaaggccacccgtactgccggccagaccggtaacgccatgctgaccgatctcgagacccgtctcgacaacctggtgctgcgtgccggcttcgcccgcaccaccgcccaggcccgtcagttcgtggtgcaccgtcacatcctcgttgacggcaacatcgtggaccgcccgtcctaccgcgtcaagcccggccagaccattcaggtgaaggccaagagccagaccatggttccgttccagatcgccgccgaaggcgtgcaccgtgacgtgctgcctgcggtccccggctacctcgacgtgaacctgccgtccctgaaggccactgtgacccgtaagccggaggtcgaagagatcccggtgcaggtcaacatccagtacgtggtcgaattctacgcccgctgatccgggccctctggtcaacaaatccaggacataccgctcgaaccccgcgcttctttcgagaagccgcggggttcctgcgttgtagggcgattactggccgcacaccgcctggcgaatcatcgtcgcgtacgcataggcgccggtcatattcggatgaatgccgtcatcgttgaggtattcgctatgaccttcgctatacccatgccaatcgatgatgcccacgttcttgttcttcttggcggcctcacgcagcatcgtattgttgttgttctcctgccacgggtatggcatacggatggtgatgaagtatgtcggcttgccgccggtcaggtcaatgagctgttgcacttcctgctcattcgaaatcacgccgttcgtgccgaggccaaacaccaccacactgccactgtggccggcagcggtgtcctgctgatacacatccaccgcctgcggcagctgacggttcggcaggccatcgataaaagcgttcgggaatgcggcctggatggcgtccgaagtacccgacgtcactgaatcgccgaccatcatcatatccgcgttgcagctttccgttgccggatcataggcgtacttcgaaatgtcaagattgtttggcaccttttccgcaatcggtttgatgatgggcggctgagaatccgaaccgttcttattcgcgtcagcggtattggtttcgccgttcgcggcatttatggcagaagactcgggctcgggcttcgccggtttcttgaccggcttggcgggtgccgcgagttcggggcgcagctgaatggctcgcgcttgagcgatgccattccagtccaccggtgcccacgtcagcgccacaacggtcaccaatccgataaccgacatgacccacgcgcccgggcgcagccggtagccggctttcggcagcggcttggcgtgttggctacgaggcatctgcaccgatttacgggccgcctcgaccagctggtagaaggcttccgacgccgccaacaccacgacggcctcaagaacccaaccccaccacggcaacgcctgcgttcgtgtcgccgggttcatgaactgcagcagcggataatgcatgacgtacagcgagaacgatcgcgacccgatatagcgtaggggagcacaacccagcacgtgcgaccagattgagtcattgttcacggcacaggccaaggcgcacaacgatatgaacgcggtaatcaggtacccgccttggtacatgtacgacagatacccgttggcgaaccagaatccggtcagcagtgccgccaaagccgcggtgccaagaacattgcagacgatagtgagacgggcgcccgtcttgtcgccggcctgacgttcgatctgcactgtttgcgaagccgctccagcttccgcagcttccgtacctcgcgaggaaggcgcaatccagatagccaacagcgcgccggcggccagctcggcgaggcgagtatcggtaccgtaatacacgcgggaggtattggccgggtcaaacagcagcaccatgtcggcggtggaagcagccatgatgacaagaatcgccatggagcgcacccatttggacttggtgattttgccgagcaccaccatcagcaacggccaaaccagatagaactgcatcgtcacgcccaagaaccacagatgggtcagaggagaaggcaatccggccgcctcgaaatacggcaccttgcggaagatgtacacccaattgctggcgaacaaggcgctcggcagcgaatcggaaaccactttctgcaacaggctgggagcgaacatccaagtgagccaaggcaccacggcaatggtcgccagcatcaccggccataaacgagtaatgcggcggatcagatatcggccatatccaaaggacccggtgcggtccaccatgttcagtaccgaacgtgtggcaagaaaaccggtgataacgaaaaacatcgtcacgccaatgaatccgccctgcaatagcgacgggcgggtgtggaatgctatgactccaagaatcgccagagcgcgcagtccatcgatacccctgaaatgggcaggcacagacgatcgagatggtgcaggtttcaaggttatgctcacagtattctaagtgtactctcaggaatcgttaggtatactgcccggattacgcatatctcaggtagtgacctatgccgttatgacttatgacttccggcaacccgcaccgaaaccgccggaatggtgacataatcagaaccatgattcttcatctgcatctggtccgtcacggacagacctatttcaaccgatacaaccgtctgcagggatggtcgaattcgccgctgaccgagtcgggcgtcgccgatgccgtcaaggccggtgagcgactgaaaggattgacgttcgccgccgcctactgttcggacaccacgcgtgcccagcagacggccgagaaaattctcgacatcaacgaagccgcgggtaacccgcgccccgcactcgtgacggacatgcacttccgcgagcagttctacggctactacgagggacttgacatggccatggcctggtacgccgcgggagcgccccacggcgtcaaaacctacaaccaaatcgtcgagaagttcgggttgggggcctcgcgtgattttctcaaggaagccgatcccttccacgacgcggaatccgatgaggaatattggacgcgcgtcgaaggcgcgttccgtcttatcgccgacaacccgaatctcaaggacggcgacgatgtgctgcagatttcgcatggcaacacactgcttagcctcggtcaccggttcggcggccctgacctcgatctgaacgaacgcccggccaatggttcggtaaccgtgatcgacttcgacaccgacaagccgttcggcgaagccgtgaccatcgtttcgtacggcaagtagcaaatagcaagcaatacatatcgaatagcacgtacggtccacggcggcacgccgcaaacgaaagcgtcagcaggacagcctttcgcctatagccgcatacgcccacgcgcacggttttcgccctgcgcatgcaatggtatgccaagaaatagggaaggagtgctacccttaggcgagtaagtgtgaccgcaaggaggaaacaatgggagtcggagagatcgctggcctgatcgcggccatcgcgttcgcagtattggccggtttcatgatctatccgctgatcaggctgggcaagatgtttgatcagatatcgcagacggtccgggagtccggtgaacacgccatccccgcgctggacgaaggcgtgaccaccgtcaagcaggtcaacaagtcgctcgaagacgtgaacaagatttccgccgcggcttccaccaccgccaacaacgttggtgcgttgaccgatctgtatggctccttcctcggtaagcccatcatcaagatcgcttccaccttctacgcgctgaaaaccacgggtcagtccttccttgcgaagaacgccgcgaaaaccaccgtcaacgacaccgccgagaagggggagtgatgttcaaacgcatcttctgggtcggcgtcggcgtggccatcggaatcgttgccgtcaccaaggcacaggcctatgtcaaggccaatacgcctgatgcggcacgccagttcctgcttggccccgatcaggacaatgtgccgatgaaaacactcgaagggttggtcaacgagttcaatgccacccgtcgagcccgcgaggctgagctcaaccgtcagtacatcgagcgcgccaactgacacgcgcatgccgccttgccatctagtcactgaatcagctagaacaaactaatcctcataatccagtcttttccaccaataccaggcgcaactgcgcccattacccaaacaaggagttcatccgctcatgcgcactgcggacatcgcaaagcgatacctcgattattttgccaagcacgaccatctcatcgtgccctcggcatccctgatttccccgaaccccaccacgcttttcaccatcgccggcatggtgccgttcatcccgtacctgatgggtgagcagaccccgccgaagcgccgcatggcctccaaccagaagtgcgtgcgtacgctcgacatcgacgaggtcggcaagaccacccgccacggcaccttcttccagatgctcggcaacttctccttcggcgactacttcaaggaagaggccatccactacgcctgggagctgctcaccacctcgcaggatgagggcggctacggcttcgaccccgagaagctgtggatgaccacgttcaccgacgatgacgaagcccgttccatgtggatcaacgagggcgtggaccccgagcacatccagaagatgggcatggaagacaacttttggaccaccggtggccccggacccggcggcccctgctccgaaatctacgtggaccgcggccccgccttcggcaaggaaggcggcccgattgccgacgagaaccgctacatcgagatctgggacctcgtgttcgagaactacgaggtcgacaacgtcaagtccaagaccgacctgcacatcgtgggcgagcttgagaacaagaacatcgataccggtgccggcttggaacgtctggcctacctgctgcagggcaagaacaacatctacgagaccgatgaggtcttcccggtcatcgaggccgccgagcagctctccggcctgaagtacggcgagaacgaggacgccgacgtgcgcttccgcgtggtcgctgaccacgtgcgctccgccctgatgatcatgtccgacggcgtgcgcccgtccaacgtgggccgtggctacgtgctgcgccgcctgctgcgccgcaccgtgcgctccatgcgcatgctcggcgtgaccgatccggtgctgcccaccctcttcccgacctccaaggccgccatggaggccagctacccggagctcaacgacaccttccatgaggtgtccgaatccgcgtatggcgaggaagacgccttccgccgcacccttgagaccggcaccacgattctcgacgtggccgtcaacaaggccaagagcgattccgccgagcccgtcgtggccggcgaggacgccttcaagctgcacgacacctacggcttcccgattgagctgaccctcgagatggccgccgaacagggcgtgaaggtggacgaggccaagttccgcgaactcatggccgagcagaagtcccgcgcccgcgccgacgccctcaagaagcgtcacaacgtggatctttccgtttacgacgacttcaagaagacgctcgtcagcccgatcgacttcctcggctacaccgacatgtccgcccgcgccaaggtgatcggcatcatgcaggaaggcaagggttccgtgcccgccgtgaccggcccggccaacgtcgaggtcatcctcgaccgcaccccgttctacgcggaggccggcggccagctcgccgaccagggcgagatcctgtccgacgacggcgccgtgctcgaagtcgacgatgtgcagaagcccatcaaggacctcatcgtccaccagtgccgtctgaccgaaggcacgctggtcgtcggcgccgaagtcaacgccaacatcgacctggcccgccgtggcgccatcgcccgctcgcacaccgccacgcacatggtgcacaaggcgctgcgtgaggagctgggcccgcaggccacccagcgcggctccgaagacgccccgaaccgtctgcgcttcgacttccagtggtccaaggccccggccaagtccgtgatctccgcagtcgaggagcgcgtcaacgacaagctgcgcgacaacctcgccgtgaccaccaaggaaatgaagttcgacgacgccatcgccctcggtgccatgcacctgttcggcgagaagtacggcgacatcgtacgcgtggtctccatcggcgaagacggctggagccgcgagctgtgtggtggtacccacgtggaccacgttggcaagatcggcatggtcaacatcctgtccgaagcctccatcggctccggcgtgcgtcgtgtcgacgccgtcgtgggccagggtgcctatgacttcaacgctcgtgagcacgcgctggtctcccagctgtccgacaagctcaacgctcgtccggacgagctcgccgagcgtgtgaacgccctgctcgccaagctcaaggaatccgatcgtcgcttggcctccatgtacgagtcccagctggccgcctcggttccggcgctggttgctgacaccaagaactccgcggccccggtcaaggtggccgtcaagaacgtgggccactttggcgcggtcgatgccctgcgcaagaccgtactcgacgtgcgcgcccagctcggtgaagacgcccccgtggtggtggcccttgccggcgtgaacgaggatgacaagccgatggtcgccgtggccaccaacgaggccgcccgcaaggccggcatcaaggccggtgatctggtgcgtggcgcagccaaggtcctcggcggcggtggcggcggcaagccggacttcgcccagggtggcggtgtcgatgcctccaagatcgacgaggccctcgaagcgctcaagcacgaggcgcagaaagcctgattccgccagtggtgtggttaggcgttgatttgggtaatgcccgggtcggactggcactgtccgacccggagcttacctttgcacatcctgctggcaacattcatgttgccggcgactatttctttgctattgacgaggtcctgaacgtcatcgaagacgaacatgtggaccatgtaatcgtcggactgcccctgcagatggacggtacagaaggcaaaagcgccaaaaaagcgcgcaggtgggcggccaatctggagaagaggctgcaagcagagagtgaagacagtgattctacggagtatcagattccgcaggtatcattgatagatgagagattgacaacagtcagtgcgcatcgtcagctgttcgaggcccataaagcttcgaacaagcacaggccggtggttgaccagcagtcggcagtggtgattttgcagacggcactcgaccgtacccgggagcagtgaggtatcggttatgaccgatgattttaacgagttctttgatgacaacacgcattgggtcgaacaggggtcagaaccaatgcgcggggctgagccgccagaaccgccgaaatcccgcaaggagatgcgcaagcgacgtgcacagcgcaggcgcaagcgtatcagtggcattatcatcgctatcgccatcgtcgccctgcttatcggcggcggctatttcggcgtaaccaagctcatcgcatggcgcgacagccggagcaaccagtcgacggccatcgcggactatccgggaccgggctatggcgaggtcgaattcaccgtgagcgagggccaaggcgcggcggagatcgccgataatctgctcaaggccgaagtcatcaagtctactgccgcgttcaccagcgtggtcaacgccaatagcgcgacactctatccgggaacgttcacattgaagaagcatatggccgcaatcgatgtgatcgccgttctctccgacaccaaccaggcggcgggcttcctcgaggttcgtcccggtgaacgtgccaccgatgtgttcgccaacgccgcgaagctttccggcattgcccaaagcgaattcgacacgattatcaagaacaagggtaaggatattctgcccaatgaagcgggcggtagctttgagggatggctggagccgggaacctacaacgtcaagagcatgaagagcgcttcagaaatcctcaaggccatggtcgatgagcgtatcgccaagttggatgaattgggcgtgccgaccggcagtgaccgcgaacgggtgatgatcatcgcctctatcgccgaggccgaggtcaacaaagccgattactacggcaaagtgacgcaagtcatcgagaaccgtttggagcagggcatgtcgttgggcatggattccaccgtggcctatggcaataacgtcaagcccgcgcaggtgaccaccgagatgacccaagacgagtccaacccgtacaacacgtacaagatctccggcctgccgcctacgccgatcagcaatcccggcgataacgccattcaagcggcactgcaccccgaaagcggcaattggctgtacttctgcacggtcaatctggacaccggcgaaaccaagttcgccgcaaccgccgatgaacatgaccagaacgtggccgaactacgcaagtggcaagccgaaaatcagtagtcatcccgttagcttccttcgcttggggaagctgatcggacgttagtctcttcattggctccctcgccgaggggagctgtccgcaaaagcggactgaggggagcactgcagggaatgtaacgctcaacttaagcccggggctcccgcgaagcggatggaagaaatctaggacaacaccccaacagccaccgccacaatcgcgcccgccaatatcaccggcacatacggcaccttgcccgcatgtgccggtgatgtgcgttgtgggtcgaatcgcgtccacaaggcaatccatgtgatgccggcaacacccatcgccagccaccagaccaccacaggcaacaggccaaacagtccgacagacaatcccataggtatcaaggcggtcacatcgccgaatcccaatgaccgaggcaccagcaacgccaacgcgaactggatcaggcaacatagcacggtgaacaacagcgcctgcaacagcacgaacaggtcgttcaccaccactccatacgcgaaatcggcggccagctgaagcaacgcgcccgcagccacccacgcgatcggcacccgccgatgacgaacatcctcaatggacagtgcaagcccacatagcagaccgggtagcgtgaacaggtatggcatggcttaacattaacccctagctagacgtacacatagacgtacacacatgaaacgagggaagttatgctgcattggcagacggcaggggagtctcacggagaagcattggtggccatgattgaagggttgccggccggcgtgcgtattagcacggacgatatcgtttccgcactggcacgccgtcgacttggatatggtcgcggtgcccgcatgaagttcgagcaagacaaggtccgtctgctgaccggtgtacgccacggcctgaccctcggctcgccggtggccatcgaaatcgccaacaccgaatggccgaagtggaccgaggtcatgagcgccgatgcactcgaccatgacctgccgcgcgaaggccgcaatgcgccgctgagccgcccgcgcccgggccacgccgatctgaccggcatgcgcaagtatggttttgacgacgcccgcccggtactggagcgctccagcgcccgtgagaccgcctcccgtgtggccttgggcgaggtggccaagcagttcctggatcaggcgttcggcatccgcaccgtagcccacgtggtggcgctcggtggcgtgcagaccaaccccgacctgcccctgcccacccccgacgatctggaagcgcttgacgcctcgcctgtccgtacgctggacaaagaggccgaagcccgcatcatcgaacgcatcaacgaggccaagaaggcctccgatacgttgggcggcgtgattgaagtgctggcttacggtgtgcctgccggcatcggcacgtatgtggagtccgaccgccgactggacgcggctctggcctccgcgatcatgggcattcaggcgttcaagggtgtggagatcggcgacggcttcctggaagcctcccgccccggttcgcaggcgcacgatgagatcgtggtcaacgccgacggccgcatcgaccgtctgtccaaccgcgcaggcggcattgaaggcggtatgtccaatggccaggtgattcgcgtacgcggtgccatgaagccgattccgtccatccccaaggccctgcgtacggtcgacgtgctgaccggcgaatccgcacaagccatcaaccagcgttccgacagcaccgccgtgcctgcggcatccgtggtggccgaggccatggtgcgtctgactttggcgaagtacgcgctggataagttcggtggagacagtgttgccgaaacacggcgcaaccttgagtcgtatctcgcctcgtggccggagcacatgcgctgaacgaagggcgtatggtttcgtgacgactgccgcggaaccatcagcaactgtactcaccaatcgtcgagaggattcgtagattatgaccgcacgcccccgcgccgtcatcatcggcatgatgggagccggcaaaacacgtgtcggtaaggaagtggcacatatgttgcgtctgccgttcgccgatgccgatgtggagatcgaacgtgaagtgggcatgaagattccctcctacttcgaggaatacggtgagccggcattccgcgaggtcgaggccgatctcatcgccgatatgcttgaggatttcgacggtatcttttcgctgggcggtggcgctcccatgacgccatccacccagcatgccctcgcctcctacatcgaccatggcggtcgtgtggtctaccttgatgccgatccggcggaagccatggaacgcgcgaaccgtgggggaggccggcccatgctcaatggcaacgccaactcccgttggaaaaaactgttcaagcagcgtgacccagtattccgcgaggtcgccaacgttcatgtccatacccgggggcttacgcctcagggcgcagcgaagaaagtgattgacatggtatctgagcgagcagtgcatgttaccggagcggcaattgagccgtatgatgtggtcattggcgaaggtgccatgaaccatctggtcgacgtgctgggacccaaacccgccaaaatcgcgcttatccacactcagccggtgcagcgacactccgatcgtgcccgcgccctgttgcgtcagggcggctatgaggtttccgacatcgtgattccggatgccgaacccggcaagaccattaccgtggccaacggcatttgggaacgccttggcaacgaaggtttcacccgatccgatgccgtggtggggcttggcggcggtgccgcaaccgatttggccggtttcgtggctgccacgtggatgcgcggcgtgcgctatgtaaactgcccgacctcgctgctggccatggtcgatgcctccaccggtggcaaaaccggcatcaacaccccgcagggcaagaacctcgtcggctcgttctacacgcctgccggtgtgctggccgacaccaagacgctggctacgctgcccaatgacatcttcatcgagggtctcggcgaagtcgccaaatccggtttcatccgcgaccccgaaatcctgcatatcctcgaagaccacgcagctgaactgcgcgctttcgacggctctacattcctcggctcgccgctcgaagacgtggttgccgagctcattgagcgcacggtaaaggtcaaggcctaccacgtctcctccgatttgaaggagaagggtctgcgtgaattcctcaactacgggcacacgatgggtcatgccatcgaaaagctcgagcacttccgctggaggcatggcaatgcggtggccgtcggtatggtgtatgccgccgagctggcccatctgatcggttacatcgatcaggatctggttgactatcaccgctcgttgctcgcttcgatgggtctgccgacgtcgtggaatggcggctcgttcgacgacgtactcgcattgatgcatcgcgacaagaaagcccgtggcaacgaactgcgcttcgtggtcctcgacgagattggtcacgtcgtacacctcgacaacccgcccgccgaagccgtagaagaagcattccgtcgtatccagcagtaattgaacggccgtaggccgtgccgttcgccatcccctcagaaaaaagtacttggctcccctctaacggaggtgccccggagtcggatctaccttctacctccctctgatgagggaggtgccccgaaggggcggagggagagaagcacaaacaaaaggagtcccaatgaccaaagtcatcgttgtcaatggccctaacctcggacgtctcggcgtccgccagcccgacgtctacggtcgtcaagacctcgacaccctgcgcaagctctgcgccgaatggggcaaggacctcggcctcgaagtcgaggtgcgccagaccgacgacgaagccgaaatggtgcactggatgcaccaagccgccgacgagaaaaccccggtggtcatgaaccccgccgccttcacgcactattcgtatgctctcgccgacgccgcgcacatggtcattgacgagaacctgccgcttatggaagtccatatttccaacccgtccgcccgcgacgagttccgcaagcgttccgtaatcagccctgtggccaccggcaccatcaccggcatgggtttctacggctacaagctcgcgctcgatgctgtggcgcacttgctgagtgaatagaaccaagccctccagccaatcccgggtagcagtcgacgttgcgcccgggattcctgttacctgaggaaaccataagcgtccaagtaaaggaagccatgactctcaccgccacggaacgtgatctcgtcgatgccgcgtcacgctggtttgacgcccaccgcgcacagttcgtcgatgagctgtgtgagctgctgcgctacccgtcggtttccgacgaatcggacccgaatcctcgtccgggcgcgccttatggacccgaagtacgccgtgtattcgaccatatgctggccaaggcaggacgagacgggctgcctacgcgcgactacaccggccacgtcatggaagtcgtttatccacaggagaacgtggagaccgaccgtgacatcgccttcgtcgaccacctcgacgtagtccccgccgacgacggttggacgcacgatgccttcgatccgcaggttattggcgatattgttatcggtcgcggctcattggacaataaaggcgtcgcgctgaccagctatttcctactccgtttcttcaaggaacacgaccaccgtttccgccaccgcgtacgtatactgttcggcggctccgaagagatcgcgctcaacgacatcaaatggttcgtcgccaacatcggcgcgccgtaccaggccatcgtcaccgatggtcccttcccggtgaacaatatccaaaaagggctgctcgatgtggatgtcgaactgccggtcgggccgcaattgcgcggttggcatgccggcaccgccactaacacggttcccggggccgccgcaatcaccctcaccggcgtcgacgaatctaccgtgcggcaagcattctgccagagcggcaacatcgctccagatatcgccgagcgattgcatatcaacgcaacagcgcaaggcgtcacgattgaggccaccggtgtcgccggtcatgcctgccagccgtccggtaccgtaaacgctatagcggtgctcactacggcgcttgcccggtccggtctgctcgaaggccgtgacctcactgcagcgcaggcgattgcccaatggacaaaagactcatatggcactggcttgggtatcgattgcgagaatgcggaaagcggaccgactaccgccaatggtggtctgattataccggcgaatgagttcgctgaagcagacaaggtattaggcgcggtatcaggtgagacttctgaagatgccatcgtattgcacttcgacatccgttatgcggtaggccaggcacacgaacaaatcatcgagcgtattcaagcacaagccgaagcggcgggcggccgcattgtcgacatccttaacgatgacccatactacgtgcaggctgacgacccgcgtgtccagttgctcaccgcaacctacaacgacgtgctcggttgcgaggctcgacccgtggctgtcggcgacggcacccacgcccgctttatcccgcgcgcactcaacttcggtcccgaattccatgccgaccatgtgccggcggtcgacggcatcgacctggagaccccgccattcatcgcaccaggtgccggcaacgcgcacggcgccgatgaatgggcctcgctgaaaaacctgaaaacagcgtttgtcctatatgcgttaggcctagtgcgtctcgaccaatacctgcaatagctggcggataagacgtttgacgtgattatgaccttgcgtatgctttttgacgagcctactattcgtattgttcaagtacgccatgtcggggccgacgcgtctggtgaacacgccgggtcatacacggatgatagagtgaaattccatggttagaagaacacatggtaattctcaagaacacgtcaccaagcatattttcgtcactggcggcgttgtctcctctctcggcaagggcctgaccgcatcttcgctcggtcgtttgctgcgcagccgcggtatccatgttctgcagcaaaagctcgatccgtacatcaacgtcgacccgggcaccatgaacccgttccagcatggtgaggtctacgtgaccgaagacggtgccgaaaccgatctcgacatcggccactacgagcgtttcctcgacgtcttcctgagccagaaggccaacgtcaccaccggtcagatctatcaggaagtgctgcgcaaggagcgcgccggcgaatacctcggccagtgcgtgcaggtcatcccgcacatcaccaacgaaatcaagtctcgtatgcgcgcccaggcttccgatgacgtggacgtgatcatcaccgaaatcggtggtaccgtcggcgacatcgagtcccagcccttccttgaggccgcccgcgaagtgcgccgcgatctcggcccggacaactgcatgttcgtgcacgtttccctggtgccgtacatttccgccgcccacgagctcaagaccaagcccacccagcactccgtgatgatgctgcgccagctcggcatttccccggacgcccttgtgctgcgctccgaccgcccgctcaatcagtccatcaaggacaagatctccctgatgtgcgatgtcgatgccgaaggcgtggtcaactgcgtggatgcgccgagcatctacgatgtgccgaagatcctgttcgaggagggcctcgacgcctatgtggtgcgtgagctcggcctgccgttccatgacgtcgattgggacgaatgggccgacctgctggagcgtgtgcaccaccccaagcacgaggtcaacatcgccatcgtcggcaagtacatcgatctgccggacgcctacctgtctgtcaccgaggccatcaaggccggcggctttgccaactgggccaaggtcaacgtcaagtgggttgcggccgatcgttgcgaaaccaccgaaggtgcggccgccgctctcgacaacgtcgacggcatcgtgatccccggcggcttcggcatccgcggcatcgacggcaagatcggcgctctgaagttcgcccgtgaaaccaagctgcctgccctcggcctgtgcctgggcctgcagtccatggtcatcgaatactcccgccacgtgctgggcattgaagacgcgaactcttccgagttcgagcccgattgcgccaacccggtgatcgccaccatggaagagcagaaggacatcgtggccggcaagggcgacatgggccacaccatgcgtcttggctcctacccggctgagctggaggaaggctcgctggtcgccgaactgtacggcaccacgcatgtcaccgagcgtcaccgccaccgttacgaagtcaacgtggcctacaaggatcgtctgcgcgaaggcggcctgcgcatctccggccagagcccggacggcgagctcaccgagttcgtggaactgccgcaggacgtgcacccgttctatgtggccacccaggctcacccggagttcaagtctcgcccgaccaagccgcacccgctgttcgccggcctggtcaaggccgcgctcgaccatcaggcggcgcgctgacgcactttcgtgccgtgcataatatcgtggcatgatgtgctggctgccgtcatcggcgtagtgcaagacatacggtaaagacgtggtggcgaaatatctaatgatgtttcgccaccacgtcttttttgttgtatgagcagcatgcagcatgatgtattggaaggcgacggtaaaaaattaccgtttctatggtgtgttggtagtatgcagataacgcttagtaggccatcgcagaaagaccgaccatgaccgaacaccttgatgactcgacccagcagtttgcgcctctgtttggtgcgaataatgccgtcagcggcactgtggcagacagtgtggatgctgctgcatcagattccattcagggcgatgagatgaggaggcgccgcatctggccgtgggtggtgattgcttgtctgctggttgccttgggggctgcctgtggcggcggtgtttggttcttccaagatcacgtgctgcctggcacaacgctatggggaaattcagttaccggcaaaaccgagcaggagattgtcgacctaatcaacgaccaggtcgacaacaccgcggtacgagcgaaataccaggggcagtcggcgacgttcacgctgaaagatctcggcatcgaagttgatggtgaagcaatcgcatccgatgtcatcaatgcccaacgcggtgacgcatggtggcaacagtatgcgttctggattacgcatgatgtggccccgcaaatcaatcccgagctcgctgatggcagtgtggtagataaggcgctgaacattgatgcacaagaacctgttgacgcgcaagtcgcattgaacgataacaacagtggcttcaacgttattgcgggagaaaatggccagggagccaacgccaccagcattgcgaagcaagccatttccacagtggagtcattgggcagtgtccagccacagaccgttcgggtggaactcgacgtaaccgaaccgacgattaccaatgcaattgccgatgaggcgaaaaccacgctggaaaccctagtgaacaatgccgtggccatcaaggtggcggataaagacatcgccaccgtgaatgcgtccatgctgggttcggccatgcgcatcgacgccaaccagcagtcaaagctgaaagacaatgaagtacgtaatggctacgtggtctttgatgccgataagctgcagcaatactatgacgagcaaatcaagccgaatctcaaattggaacgtgaagacaagaaggtcgtcgtcaataatgctggcgaggtgctgagcactgaaacagaaggccatgatggcattgtgattgccgatggcgcggatacggaggttggtgctcgcttggctcaggtgctggccacgggaactggctcagtgaatgtggacggcaaggtagatcccaaacaggaagtcaaggtcactcatcgcgtggcgattgacctgtccgaccgtaagctctatgcctatgagaatgacacggtggtcaagacattgaatgtcgtggtcgcggagggcaacgacaacgtcaccggcgaatgcgttggcatgatgtgtacgccgacaggtgacttcaacgtatggcaaaagttgcccagtcaagatatgagcggcacgctgaatcttgccgatggcacggtggaaacatgggatgtcaaagacgtgggcttcgtcaactacttctcctccggttgcgcaatccaccgtattgccggcggatatgtagcggatgccgtaatgccctccattgccaacggatctcatggttgcgtgggtatcggatgggatgtcgccgaatggttctacaactggtgcaatatgggcacgagcgtgcatatccaagtgtgatatgcaacagtgtgatatgtaacaaatacggcatgcagtggtgcgacacataatgccgcatacgcgatgttcggtgtgcatgggacaagcttgcccggctccaatatcgctgtatcgcattcgtgtaatcaagcccacagccaatatgcgtcagggcagctagtgtttgcacttgggttctgctaggttttcataggattaagtgtgatacaaggaaggcaggatggtgaccgaaaacacagcaccaaacgccgccgctgacgtggagatgagccagtatgtggctgatcgtacccgcgtcaacgaggacaagatcaagaaggatgacgagatcatcagccagttcggcgactacaactatggttggcatgattctgatgccgccggcgaagccgcaaaacgaggcattgatgagaacgtcgtacgcgcgatcagcgccgacaaaggcgagccgcagtggatgctcgacatgcgtctgcgtggattcaaggcgttcctcgaaaagcccatgcccgattggggtgtggatctctccggcttcaacgcagacgacttcaagtactacgtcaagccaatcgacaagcaggcgaaaagctgggacgaactgcctgacgacatccgcaacacctacgaccgtctcggcatcccggaggcggagaagaaccgcctcgtctccggcgtggccgcccagtacgagtcggaggtcatctacaactccatccaggaggacctgaagaagcagggcgtcatcttcgtcgacacggacaccgctgtgcgcgaataccctgaactcgtcaagaagtacttcggcaccgtcgtgcctccggaagacaacaagttcggtgccctcaacaccgcggcatggtccggcggctcgttcgtatacgtgccgaagggcgtgcatgtggacatcccgttgcaggcgtacttccgcatcaacaccccggccatgggtcagttcgagcgcacgctcatcatcgcggacgaaggctcctacgtgcactacgtggaaggctgcaccgccccgatctggtccgaggactcgctgcacgccgccatcgtcgagatcatcgtcgaaaagcacgcccgcgtgcgttacaccaccgtgcagaactggtcgaacaacgtctacaacctcgtcacccagcgtgcctacgtgcgcgagggcggcacgatggaatgggtcgacggcaacatcggttccaaggccaccatgaagtacccggcctgcatcctcgccgaaccgtacgccaaggcatccaccatgtccctcggcttcgccggcaagggccagtaccaggacacgggcgcgaagatgattcacctcgccccgcacaccagctccaccatcgtcgccaagtccatttcccgtggtggtggccgctccgcctaccgcggtctggtcaaaatcgtcaagggcgcgtacggttcgtccaactcgaccgtgtgcgatgccctgctggtcgacgacttctcccgctccgatacctacccgcatgtcgacgttcgcgaagacgacgtttcgatggcccacgaagccaccgtttccaagatttccgaagaccagctcttctacctgatgagccgaggtctcacggaggaagaggcgcgaggcatgatcgtgcgcggcttcgtcgaaccgatcagccgtgagctgccgatggaatacgcgcttgaactcaacagacttgtggaacttcagatggaaggatcggtgggctgattccgatgaccgacaacacaacacccgtcaaggaaatcaagattccggtcgccgaccccaacgacccgtacgcgattccggccgctatgccgtcctccgtggaccatgccgtgcgctcgttcaacgcaggcgactacccggagcccagccgcaagcaggacgaatggcgctacacgcctatcgagcgcatcaacgagttcttcaccgtgttcaagccttccggcgaaacgcagatcgaagtctccatgattgacggctcgccgttggccgaaggcgtgaagctcagccagatcaagctcggtgagggcctgtccggcactgtgtccaagcccaacgaccgcgtctccgcagtcgaatgggaatccggccgcaccgcaaccattctggaactgtccggtgagatcgcccagcccgtgctcgtcaaggtgcacggcgcgggggaggacctcgacgctttccatctggtgatcgccgccgccgacaaggctcatgcggacgtcgtcgtggaacacgacggtgacgcacgactggccgaaggcgtggaaatcaccaccggcaaggactcgcacgtctccaccacgttcgttcaggaatgggccaaaaccgccaagcatgtggccaaccaccgcatccacgtcggcgaaggcgcatccctgcgccactccgtcgtgaccttgggcggcgacatcgtccgcatccgcatggatcaggacttcggcggcgaacagggcgacctcaacatgctcggcatctacttcgtggaccccggcgagcacatcgaacaccgcacgatggtggtacacaaccacctcgactgcaagtcccgcgtggtctacaagggcgcgcttgacggcaagggcgcgcactccacttgggtgggcaacgcgctcatccagcccaccgcccccggcaccgactcctacgagctcaaccgcaacctggtcctgaccccgggcgccatcgccgattccgagccgaacctcgaaatcgaaaacggcaacatcatcggtgccggtcacgcctcttcggtgggccgcttcgacgacgaggaactgttctacctcgaatcccgcggcatccccgaaaccgacgcccgcaagctcgtggtgcgcggcttcttcggcgaactcgtcgaggagatcggcattcccgccatctccgaacatctgatgaccgtgattgaccgccgactggcccgtggtgaaaacgacgccatggcacaggtcctcgaagacaagtaagaacagcatttttaggagcacaacaatgtcaacactcgaaatcaaggacctgcacgtccacgtcgaaaccaaggaaggcatcaagccgatcctgaagggtgccaccctgaccgtccactccggcgaaacccacgccatcatgggccccaacggttccggcaagtccactctcgcctacacgttggccggccaccccaagtacgtggtcgactccggcgaggccctcctcgacggcaaggacatcctcaagatgactccggacgagcgcgccaaggccggcctgttcctggccatgcagtacccggtcgaaataccgggcgtgtccatgaccaacttcttgcgcaccgccaagaccgaaatcgacggcgaggctcccggtattcgccagtgggccaaggacctgtccgcagccatgaagcgcctcaagatggacccgaagttcgcctcccgttccgtgaacgaaggcttctccggcggtgaaaagaagcgcgccgaagtgctgcagctcgaactgctgaaaccgaagttcgccatccttgacgaaaccgactccggcttggacgtggacgccctgcgcatcgtgtccgaaggcgtgaaccgcgccaaggaagccaaccagttcggcatcctcatggtcacgcactacacccgtatcttgaagtacatcaagccggacatcgtgcacgtgttcgccgacggccacttcgtcaagaccggcggccctgagctggccgacgaactcgaagagaacggctacgaccagtacctgcccgaaggcgccgactccgagtccgcactggcctgagtccgtgaccgtgggagtctgacatgccctattctcgacacgctccgggccgcttaggccaggtctttacggtcgcgaacaggccatgtcagactcccactcgtttcgtacaattgttacgtaagtagggggaacataatggttgattttaaggcgattcgggcgcagttcccgattctggatcaggagattcacgggcacccgctcgtgtacctggattctgcggccacctcgcagaagccgaatgcggtgatcgacgccgaggcgaacttctaccgtacaattaacgccggcgtgcaccgtggtgcgcacgagctggccgcccgtagcaccatggcctttgaggaggcccgagccaaggtggccaagctggtcggcgcgaatgcggccgaaggtgaagaggaggtcgtcgtcaccggtggtgccacggccggactgaacctgctcgccaccgcattcggcaatgcatcgctggggcgtgggggagaagccgccaagcgttttgccctgaagccgggcgatgagatcgtcgtctcgcgtgcggaacatcattcggtgctgctgccgttccaggagctgtcctaccgtaccggcgccaccttcaagtggatcgacctgaccgaggacggccgtgtgcgtacggacaacctcgacgaagtcatcaccgagcgtaccaaggtcgtggccgtcacccacgtgggcaacgccacgggtgccatcaccaacatcgccccgatcatcaagcgtgcgcatgaagtaggttcgatcttcatcttggacgcttgccagtccgtaccgcacctcaaggtcgatttccacgcgcttgatgtggacttcgccgcctggagcgcgcacaagatgtacggtcctaccggcgtcggtttcctgtacggtaagcgcgacctgctcgaagccctgccgccggccaacttcggcggctccatggtcgagctcgcctacatggaccacgaggcccaatacatggcccctccggcccgcttcgaggccggcacccagccggtcgcccaagtggtggccgcaggcgtcgccgccgaatggatgatgaacatcgggctcgagaacatcgaagcccatgagaagaccatcgccgccgaactgctcaagctcggcgacgtcgatggcattcgcatccttgggccgcgcgaaaacgtggaccgcatcggcaccgtggcgttcgacgtggccggcgtgcatccgcacgatgtgggccagttcatcgacgcccagggcatcgcgattcgcgtgggacaccactgcgcccagccggtacaccgccacttcggcctatacgcatccaaccgtgcctcctccggtgtctacaattcggtcgaagatgcccaagcgttggtcgaagcggccaagggcatccgtaagttctttggagtggagtaaaacagaacaccatgaacgaattcggtatgagcggggatgacctcgaacagatgtaccaagaggtcatcctcgaggcgtcgaaacatccgcatggcaaggaatcctttgcgcccaacgcagcggtcgaacagtccgcggacgcagcggccaatgtcaccgtacaagccagccacgaatactgcacgcccggtgaatcgcaccagttcaacccgacctgcggcgacgaggcgaccatccatgtcgaagtctccgatgacgaaccgcacaccatcaagcgattggtgtgggacggccacggctgctccatttcgcaggccagcctgtcggtgatggtcgatctggtggacggcaaaaccgttgacgaggccatggatctggaacagacattccacaagctgatggaatcgcgcggtgccggtctggacgacgagaacctggaagaaaagctcggcgacgccgtggtattccaaggcgtgtcgaaataccctatgcgcatcaaatgcgctctgctaggctgggaagggctgaaggactccatcgccaaagccctcgctgcaaagaactgaggaaatatgtccaacgataatttggttcccgaaccacagccgtccgttttcgatgctgtcaacggcgtcctgcaggacgaggaggccgctcgccgcgtgatggccaacccggccttggccaagggcttcccgaacggacgcccgatcgagcactctgctgcgtccggcgatgacacctgtgcgtgtggcggtcaccacggcaaatgcggttgccaggatgacgaacagtccgatggcagcgagattccgatcaaggcgattgacgatatcggccgcgccactgccgaagacgtgcgcgaggcactgcatcaggtgattgatccggagcttggcatcgacgtgatcgatttgggtctggtctacggcattgagatcgatgagctaggccgcgccattattacgatgacgctgaccacgccggcctgcccgctgaccgaccttatcgaggacgaatgcgcatccacgctggccggtctggtcgaggagttccgcatcgactggacgtgggatccgcgctggaccatggagcgcatcacgcccgaaggccgcgaccagctcgccgccctaggcttcagcttcgacaatatgccaaagtactgatagcgcttagtaagttccctcatcagagggagctctatacgagaaaagccccgcatgatgcggggcttttccatgtctggactggtcaatcagtcatcgacgatggtgttcttcgggacaaccgtgatgccatccggcgtgacggtgaagccacgggccagatcgtgctcggtatcgatgccgacagtggagttctcggtgagcaccacgttcttgtcaagaatcgccttgtacacgcgggcgcggcggttgatgactacaccgtcgaacagcacggaatcgacaatctgtgcccacgagtggatacgcacattgggggagagcacggagtggtgcacttcaccgccggagacgatcacaccgggggagacgatcgaatcggtggcgtggcccagacggtcgcggccggcgtgcacgaacttggccggcggcaggttgccggacatcgtgtaaatcggccaatcctggttgtacaggttgaactcgggcacataggcgatcagatccatgtgcgcatcgtagaactgcttaatcgtaccgacgtcgcgccagtaagcgtgatcagtggccgtggagcccggaatctcgttcgagttgaagtcgtagacgccggcttcgttgcgggaagcgaagtacggggcgatgtcgccgcccatgtcgtgcttggtgtcggcagccttctcatcgagagccagagcctcgaacagggccttggtgttggcgacgtagttacccatggaggccagaatctggttcggattgtccggcagaccggtggtggtgggcggcttctcctggaagttcttgatcatgttcgggtgatcgggatcgacctcaatcacaccgaactggttcgattcctcgatgggctggcggataccggccacggtgaactcggcgccggactcgatgtgctgctgtaccatctgttcgaagtccatgcggtagacgtgatcggcacccacgatcaccacgatgtccggctggacatcctcgatgatgttgatggtctggtagatggcgtcggcggagccgagataccagtgcttgccgagacgctgctgcgcgggcacaggggagacgtacgagccaagcagcggggagaaacgccagacctgggagatgtggcggtcaagcgagtgagacttgtactgggtgagcaccacgacctgacggtacccggagttcaccaggttgctcaacgggaaatcgatcagacgatacacaccaccgaagggaacggcgggcttcgcgcgatcacgggttaacggcatcaggcgggtcccctcaccacctgcaagcacaatcgacagaatcttgggattcttggtcatcgtaactgtcctctctgttactgagcgtctttcgacaccgcactgccgggccggatgcttccttgcattcggtttacatagttaataattgcagaaaaaaacgaacatgcaaggctttcgcccccgcgtgccgtgaacttgcgatgaacagtttcgtagatttgttaaggatccggccttttcggagcgcgtgcgattccttagcgtgtcgcgtagaacgccactgcgctggatgccgccacgttcaggctatccacgccgtggctcatcggaatcttcacggtcaaatcggcgcgggcaatcgtatggtgggacaggccgtcgccctcggtaccgaagatcagcgcgagcttgtcgatatgcgtcggatcttcggcaggcgcgtgcagacggcgtgtcagttcgtccaacgaaatcgaacgatcctccaatgccatggccacggtggtgaagcccagcgacttcaactcgtcgatgccctggaacggccagtaatgcttgttttcggtgccgtcgtcgttgaacccggtgatacgggtccacggaatctggaacacggtgcccatcgacacgcgggcggcgcgtcggtacagcggatcaccgcaggagggtgtgaccagcacggcatccacatcgagcgcggccgccgaacgcatcagtgcgcccacattggtgtggtccacgatgttttccattactgccacgcggcgggcgctcttgcagacctcggctacggagggcaacggccagcgtcgcatcgcgcatagggcgccgcgatgcaaacggtagccggtcagacgcttgagctgctcaggtgaggccacgtagacgggaatatccgcgccccagcgcccgtcgatgaagtcgaaggtgtctttcatgccctccagccaaggttcctcgaccagcagtgacagcggttcgcggtcagcggccagcgcgcggtcgataaccttgggggactcggcgatgaacacgcccttggctggttccaagcgattacgcaactgcatttcggtgaggctcacatacgcttcgacgcgcgggtcgtcgacggtgtccagcgtgatgaactgcattggtggcctttcgtgtgtgcagataacgaaaaaccccttgcaatgcaaggggtttatctgtgcccgagacgggacttgaacccgtacgcctgtataaaataggcactagcacctcaagctagcgcgtctaccattccgccacccgggcaggtgtcgtttggacaacgagtagatagcttagcatgaaattacagggatgcaattcgcgcgtgtgcccggcgtgtcgcgtgtagccttgaagtcatgactgatgccctttttcttttcgacccgcaggtcgacgacgtcccggtgaacagcgacgaactccacgccggctggaagctaaccctgcccgctcacatcaagcgccatgccgtgcaggccatgcgactcaaggcaggggacagcctgcaactttccgacggcaacggcttgagaatccaggcagtgatggccgatcctgaagccggactggctgaagtcgtggaagtggggcgcgaacccgagccgctcacccgtttggcgctgattcaggcattggcgaaaaccggccatgatgagcaggccatcgatatggctactcagattggcgtcgaccaagtggtgccatggcaggcggaccgatccattgccaagtggaaggtcggccgtacagacaagaagtggaattcggtactggatgccgccaccgagcagtcgcggcgcgcctttaagccgcaactggaggcgtgcgcgtccagcaaggaggtcgtggccatctgccgcagggcctgcgtgcatggcgatgtggtgattgtgctgcatcaggatgctaccgatacgtggtccggcgtggaggagaaggttgcgcagttggtggaacgcacgctccaggacggccggccgcggactgtcagtgtggtggtcgggcctgagggcggcatcagtgagcaggaggtagctgatttcgtcaaggccggagcggtgagctgcgtactggggcgcaatattctgagagccgcgacggccggtcctgtagcgttgtcgctgttgtctcgggtgttgggacgttacgagtaacgcccacgcgctaagctggtgcgtagcaacatcaaaccaaggagcatgatgagcgaatccgacgattgcctgttctgcaagatcatcgcagggcagattcccagcagcaaggtctacgaggacgagacgacctacgcattcaacgacatcaatcccaaggccaaggtccacgtgctcgtggtgcccaagaagcactacgccaacgtcgccgaacttgccgccggtgacccgaccgagctggcccacatcgtctccattgcgcagaacatcgccgacaaggaatttcacggcgcctaccgactggtgttcaacaccggtctcgacgccggccagaccgtcttccacgtgcacgcgcacgtgatgaccggcgaaaagctcgacgagtagtaggggaatatccgcttcgtggcaacgactacacgtaccatcaccatcccgccccaacttgaccccgtcgccgtgctcggcccggttgacgaggtcattcgcgaggtggagcgcgcctttccggacctgacgattatcgtgcgcggcaaccgcgtggcgatcgtctcccgctccaagcagaccgaagcccaggccgcacaggccgaggatttggtcaataccatcatccaagccgcctacaccgcgcctatggacgccgacaccgtgcgtcgcatgctcgaccagaacgtgctcaagaaccacgtgcgcctcgaacatcccggtcacggcccggtgcgtgacaaactggcgcaatcgacctcaaacgaacgcgcccatgcacgttctgccggctcccacgacccgacgtaccgcaagcccacggttcccggcgtcatcacctttgctgccggcgtgccggtccgtgcgaaaaccgccggacaagtggcctacgtgaacgccatcgaatcgcacaccatcaccttcggcattggccccgcaggcaccggcaagacgtatctggccgtggccaaggctgtgcgtgccttccaggacaagcagattcgccgcatcatcctcacgcgcccggccgtggaggccggcgaaagcctcggctttctgcccggcacgctgaatgacaaggttgacccgtatctgcgcccgctgtacgacgcgcttggcgacatgcttggcgccgaccagctcaagcggtacatggacgacggctccatcgaagtggcgccgctcgcctacatgcgcggccgtacgctgaacgacgcgttcgtgatcctcgacgaggctcagaacaccaccgaacagcagatgaagatgttcctgacccgtctgggcttcaacaccacgatggtcatcaccggcgatatctcgcaggtggacctgaccgtgcctcgctcgggactggccaccatcgaacgcatcctgggcggcatcaacgacatcgcattcgtgcatctcaaaaccgaggacgtggtacgtcaccagctggtcggacagatcgtggccgcctacgaccgtcactccgccatcgccggcgaccaccgcgacatcgaacgcaagggccgccgcaaccataccgacttcgatgcccgccagcaagcggattcaaccaaccaaagcgagacagacgatgagcgttgacgtcaccaatgaaacccagtgggtcatcgaccccaaggtcttctccgatttgggtatttgggtactcgaccagatgcgcgtgagcacccagtccgacctgaccatcatgttcgtggatcccgatcccatcgccgaactgcacatgcgttggatgaacctcgaaggcccgaccgacgtgatgagcttcccgatggacgagctgcgccccggcgacggcaaaaccgtgatggaaggagtgctcggcgacatcgtcatctgcccgtgggtcgctgcccaacaggctgccgcagccgggcacagcaccatgcaggagatgctattgctcaccatccacggcatcctgcacctgctcggctacgaccacgtgacccccgagcaggagcgccagatgttcggcctgcagcgacagctgctgctcaccttcttcgccctacgccacgatgccaacgtgcaggccacgctgcccgccggcacacccgacgcgctggccctgtacgacgccgcgcacggtgccggccgcgacctcgattccaaataagctcccaaatcaatcacaccaaatccggattattcgataccgttcaaggacattcaaggacaccgaaaaatcattatggagtattccagtaccacgccgatcgccatcaccgtcattcttgtactcgtggcggccctgttcgtctggctctcgctgaccatggccgccgctgaaggcgccgtggcccgcgtaacgcgagccagccttaacaatctcatcctcgaggtgcagaccgactccgaagcaagccagtttctcaagatgaagaagatcgacaagattcatcgcgtgcaatggctcatcgccgaccgttacgccaccgccggcagctgtgcgttcttccgcatcgcctgcaatgtgctcgacggcgtactggtgtcttccatcgcatccctgtggggtgcggaactgtggattgaactgctctccggattcctgttcgcgattatcgtagccgtggtctccgtactggtccgcccgcgcaccgccggcatggccaagccggtcggcatcatgatttccaactcgcgcatcgtgtcgttggccaccaagctcacgccgttcgcacgcatcggtggcgacaagtccggttccaaggggccgggccgccgctccaaggactccgatctgtccgacgacgaggagcttgagaagattcagctcgagcagggcaaggccgccatcgaccgactggtggagtccaacgacttcgatccggaagtctccgaaatgttgcgcaacgtgctcaccctgtctgatacgttgactcgcgagatcatggtgccgcgcaccgatatgatctgcatggagcgcgactccacactgtcttccgcgctgaaactgttctcccgctccggtttctcccgcgtgccggtgatcggtgaggatgtggatgacctgatcggcgtggcctatttgaaggacgccgtgcgtgccaccgccttcaacccggcggccatggagcgcgcggtcgaatccatcgtccggcagccgctgcttgttcccgaatccaagccggtggacgacctgttccatgagatgcagcgttcccgccagcatgtggccgtggtggtcgatgagtacggcggcatcgccggcatggtgactatcgaggatgccatcgaacagatcgtcggcgagctggaagacgagcacgaccgcacccagcgtactgagccggagaaaatcggagacaacaagtggaagatgcccgcccgtacgccgattgccgatctggaggagatcttcgagatcgacattgatgaggacgatgtcgataccgtgtacggcctgctgaccaagattctgggccgcgtgccgattgtcggtgcctcggccgtgacgcgcggtctgcgactgaccgccgtggactccgccggacgccgcaagaaggtgtccaccatcgtcgtagaaccggcgcacgtcgagggcggcgaggaaaataacaagacccatgaggaaactgacggcgagcccgtcgaaggcgatgataccgccagcaaggagtgatatgaccgaccagaacaacagcacgaacgacgtcgatgacattgacgttaccgatgcttccgatgttgccggcgttgccgaagtcgacgcgaccggtgagacggagaacgtgaccaagcaggacgtgccgtatcgctccggattcgtggccgtggtgggccgcccgaacgtcggcaaatccacgttgatcaacgcgttgatcggcaagcagattgccatcgcatcctctcgcccggaaaccacccgtaaggcgattcgcggcatcctgaccgccgaccacgcgcagctcgtgctcgtggacacgcccggtattcaccgtccgcgtacgttgctcggccagcgtctgaacgacgtggtcgacgaatctctggccgatgtggacgtggtggccttcctgctgcccgccgatcaggaaatcggccccggcgacaagcgtattctctcccgactgcgtaccgacttcgccaccaagcgtgaggacggtacgttcaagtggcgcatcccgctgattgccatcgtcaccaagatcgacgagcttggccgtcagcaactcatcaacaagctcatcgaaatcaacgatttcgccgatttctcggacatcgtgccggtgagcgccctgaagcacgacaatctggctgaagtgaagaacgtgctcattgagcacacgcccgaggggccgcagatgtacccggacgatcagatcagcgaggagcgtccggaagacaccatcgccgaactcgtgcgcggtgcgttccttgagaccctggacgacgagctgccgcattcgctggccgtggtggttgattccatcgactatccggaagacaacgagaccggtcagggctatgacggcaaggcgcaggtcaacgtgtccatttacgtggagcgtgactcccagaagccgatcatcatcggcaagggcgcctcgaacctcacctacgtcaagaagaagctgcgcaccccggtcaaccgcatcgtcggccaaaaagccaagctcgacctccacgtcaaggtagccaaaggctggcagtccgaccccaagcagctggagcgcctgggcttctaaggcttatagacgaaaaaagctccctcgtcagagggagcttttgctatacggtttacttccgcttcgtgtacatctgggtgttgaggagggtggagtagcgcttgatgaccttgggacgaatcaccttcatggaagcggtcatcaggccgttttcctgagtgaactcctcgggcaggatgatgaacttgcgcacggactcggcgcgggagacgccctcgttggcctgatcgacccacttctgcacttcggcgcgcacggcggcgttcttggcggcatcctccagcggcatgttctcgtccaggcccttggcggccagccacgggcgcagcgactcctcgtccagcgtcaccaatgcggagatgaacggacgcttatcacccagcaccagcgcctgggagacgaactcgcaacgctgaatgacttcctcgatcgggccgggggagacgttcttaccacctgcagtgataatcagatccttcttacgaccggtgatgtacaggaagccatcgttgtcgatacggcccaagtcgccggtgacataccagccatcttcggtgaacgacagctcagtggcctcgtcgttcttgtgatagcgcgggaacacggcacgacccttgacctgaatttcgccgtcctcggcgatgcgcagggagaatccggggaatgcgatgcccacggaaccagcgtggaacggcgtacccagcgggctgaacgcgcacggtgcggtggtctcggtcagaccatagccctcgtatacaggcacacccgcgccacggaagaaagccagcagttccgggtcaagcggggcaccgccggccacaatccacttggcgcgaccgccgagcacttcgcgcagcgaagagtagacaatcggatcgaaggcagcgcggcgagtgcgggtcagtgcacctgccttgccattggcggagacctccttcatatagttctgcgcggccaccacggcggaggcgaacaccacgcccttggggccgtggccggccttctgggacgcggcgttgtacaccttctccagcacgcgcggcaccacgatcatgagagtgggcttggccacctgcagatcgctgatcagcgtcttgatgccggtggcgatgtagatgcggacgttcgaggagacgacgatgtagttgatggcgcgggcgaaggaatgggcctgcggcaggaacagcaggatggtgttcctcttgtcgtgcagcagatcgggcatgtaggccggcagattcagcgcggtctggcagtagtgctcgtgggtcatctccacgcctttcggcgcggccgtggaaccggaggtgtacacgatggaacacaggtcggtcttcttgaccgaatcgatgcgctcgtccagctcctcgtccgagaccgtggtgccgtaggccttgatctcgtccaagccaccggtctcgatggtgatgatgtgctccagggacgggcactcttcgacggccccatccgccttcttacgcatgtccgtgtcctgcacgatcagcagtcgggcatcggagttgttgacgatattgcgaatctgctcggcggaatcggtgtcgtagatggtggcgagcacgccgccgcaggccatgatcgccgcgtcggtcaggtcccagtcgtaggaagttcggcacatgaatgccacggcatcgcccttcttcaggccgtaatgaatcaggcccttggccacggcacgcacgtcagccaggaactcgttggcggtgacggtcacccaatcgttgccggacttgtaggtgtacagcggctcatcgcccatacgttcggcgcggtccgcatacaggtcgtagatggacgtaccttcgtccagcggcggattgccttcggtggaggtggtgagcaggccggtggcggggtcgatgtcggtgacggtcaggtggccgtcgtcccaatcgtcgctgtgaggcaaagcgatattggtctcgaccggcacgtcggcgttggacaggtaatcgggctcgtccggggtgtcgtcgtggaccgggtggacgaagtcggatcccaacctgagcgccttacgggtgagattgatcgtgtgctgcgtgaaggaattgataaccgacaagtcttgctcctgtaaacctttcagtgtcgtccagccatgaggcgaacgcttctcaaagttcaaattgtaatcgcccaaaccgaactcgtcaccttacgcaaccgtaggattctggcgggttaggggagtgcgtggcaaaatattgcacaggtcccgatattgttgagtaaccgtgagctgcgaaacggcgattgtcgataattattgagcggttggttgctgatcgatgccgggtgattgttggacggcttccgagcaattcatccgcaatgcacatggacacattcgtatttcttactaatttcgggttcgtttctatttcgattggcggaatctcaagtcatggtctttacctttcgactacacttaccatgcggataaccatgtccattttgaagtagaacaagaaagggctctcatggcgcaaaacccagaagccaccgtggtgttcggcgttttgaacgaaacgtccgaaacggaatcccgcgtcgcgctgacgccggatatcgtcacccggctgaagaggagcggtgtctcctcactgattgaagcaggtgccggcattgctgccgactacaccgatgaggattacgaaaaggccggtgcgaaggtgaccagccgtgacgaggtgctcgccgaagccgacgcgctcggttttgtggaccgaccgtccgccgagaccgtggccaagctcaaggccggccagtgggtcattggcatgctcggttccttcaccgatgccgattacgtggccgcgctcgagaaggccggtctggtgggcatcgccatcgaaaagctgccccgtaagctttccagcgcccagtccatggatgagatgacctctcagaactccgtgatgggctacaaggcagccatcaccgccgccgatgcttacggttccttcctgccgatgatgaccaccgccgccggcacgattcgcccggctaaggcgctggtgctcggtgccggcatcgccggcctgcaggccatcggtacgctgaagcgtcttggcgcggtcgtcaccgcgtacgacgtgcgtcccgcctcccagggcgaggtcgagtccctcggcgcgaagttccttgatctgggacttgacttctccaagggccagggcgagggcggttatgcccgcgcgctgagcgccgaagagcaggctcagcagcaggctgccgtcgacgaaaaggccgccggctttgacatcatcatcaccaccgccaaggtcccgggccgtaagcccccggtgctgctcaccgcagccggcgtcaagggtctcaagcgtggtgccgtgatcgtggactgcgcagcatccgacctcggcggcaacgtcgaaggctccgccgttggtgagcaggtcaccgagggcggtgtcaagctgatcggcgctccctacctggcctccggcgtcgccaccaccgcatccaacctgctttcgcgcaatgtggccgacatcctcgtgcacttcgtgcgtgacggcaagctcggccaggatctcaccgaagaactcgacgacgcgctggtggttgccggccgcgccgccgccccggcagctgctgccgatgccgagaagtccgagaagtaaggaagaaggaataccatgcctactctcgtcgtttccattaccctgttcgtcctcgcgctgctcatcggcatcgaggtcatcggcaaggtgcccgccaccctgcacacgccgcttatgtccggcgcgaactccatccacggcatcgtcatcgtcggcgttgtgatcgtggcagccgaagccaatagcccgctggcctacgtgttcatcttcctggccgctgtgctgggcaccatgaacgtcgttggtggctacgtggtcaccgaccgcatgcttgagatgttcaagtccagcaagaacgagaagaagggggagtcgaagtaatgacctccgcaaccgttggcgccatcgacatcgtcgcttggttcgtctacctgttctctgccgtcctgtttgtggtcggtctgcatttcatgaattcgccgaagaccgcccgcaagggtaaccagatctccgcgttcggcatggtcgtggccgtgctcatggcgttcatcgtgctcttcgccaagggcttcgtgaacattgtcgccgtggtggtgctggtcgtcggcatcctgatcggtgccgtggccggtgtcgtctccgccaagaaggtgaagatgaccgatatgccgcagctggtctccgtgttcaataccgtgggtggtggcgccgccgcactcgtggccctgaacgacatcctgaccaaggaaggcaccccggacatcgtggtgctcatcaccgctggtctcggtattctcatcggttctgtgaccttcaccggctcgctcatcgctgccggcaagctgcagggtatcaagtgggtcaagaagctgaacctgccgggcaagggcgtatggaacattctgttcgccgtgctgtccgtcgcctcgctggtcatgctgtgcgtccagcccgaacagcgtctgctgtggtcgattctgaccaccgtgttcgccctgtgctacggcttggtcttcgtgattccgatcggcggcgccgatatgccggtggtgatctccgtgctcaacgcctgcaccggtacggctgtggctatgtccggtctggcgattgacaacgttgccctgatcgtggccggcgcactcgtcggttccgcaggtgtgaccctgtccatcctcatggctcaggccatgaaccgcccgctgctctccgtcttggccggtggcttcggcggtggtgctgacgccgccgctgctggcgacggtccggaaggcaccatgaaggagaccacgccggacgatctggccgttcagctcgtctacgcgcagaaggtcatcttcgtgcccggcttcggtctggctcaggctcaggcccagcgcgagctcgccgacctcggcgaactgctcaagggccacggcgtggaagtctcctacgccatccacccggtcgcaggccgtatgcctggccacatgaacgtgctgctggccgaggccaacgtgccctacgaggagctcgtggatctcgatgagatcaacccgcagttcccgcaggccaacgtggctctggtcgtcggcgccaacgatgtgaccaacccggctgctcgccgttccggcaccccggtctccggcatgccgattctcgacgtcgacaagtcccagaacgtcgtggtcatgaagcgcggccgcggtatgggctacgccggcatccagaacgagctctacttcgaagacaacacccagatgctgttcggtgacgcgaagaagagtctgcagtccgtcatcgccgccgtcaaggaattgctcgcgtaaccattcttggctcccttctgtgaggggagctgtcgaacggagtgagactgaggggagtagcccatacacgggtgctcccctcagtcagcttcgctggcggctcccctcacagaggggagccgagctctatatctactacagcccaaacacccgcttaacaaagctgttaacgcgacgccaatagcggtccggatcggtgctggcgctcatcgtgtggtcggcgccgggaatcagcagcttctcgcggtcgatgctggcgcaggcgttgtaattgatgtccagatacttcggattgacaaaagtatccgctccaccatgaatgaacatcatcggaatagtcgcgtgccgtaatgccttcacacaggaggcgtcctcaaaccggtatccggccttgcgtttagacacatgactggccactttgaccagcagcgcggccaacgagtgcggcaaacggaacatctcctcggcattatccgtaaactgcgaaaccacggaactgtatccgcaatcggaaatcgcggcgatgacattgcgggggagtcgcgcatcgccggccgccatcatcaccgtggcggcgcccatcgaattgccatgcaacagaatgcgtgcatccggatcagctgcggtgataagcgaaacccagcccaacagatcgtcgctttccagcaatcccatacccacgtaacgcccttcgctcaactcatgggcgcgctgcgcgggtagcaggaccgtaaaaccgagttgcgcatagcgatgcgcccatttggccatttccgcgggctctccggcatagccatggcagcagatcgcgtatagatgcggctgtgggtcggaacaatccgggtccaacagccagccgtggagtttcaatccatcatggctgcgcagcgtgaccgattgcttggcctcctcgaaccaccgggcggcctcaagctgctcggacatgtcgaattcgatgcctttcggcgtctcctcgtgcggcatgttgaacatcgaacgtttggctttggtgtccagcgcgaacgtgaacatgacgttggcggccgcggctgtgacgccggctcctgtggcggctatcgcggcaagtgccgcagccatacccctgacaacgcgagtgtgtgtggcgatgacgtcatggccatcctcattgatgacgtcgtccgaacgagtcatatcaacctcccgatacggtactcaccatcgtacgttattttcgaaatcatccccaacttcgtgaaagaccgtacactgagtgtcgctgagcgtacgattttcacgaaatggcggacgatttcgtgaaaaccgtacgatgagaacgggtaagcgtacgttcttcacaaagttagggattatttcgcggaaaccgtacgatgacgtggctgggacggccgggatgcagtgtcatcgaagcatcaccgcgccaaagtccggagttggcgtatacttgacaattgttgctttggcgagggaagtgtgcgtgctgacacatgacacagcttccgttatcgactcggcgtatttcactccttgtagggtgtctttcggcgcgtcgtggcgtctgagcgagacagtacgaaacgaaactacaaggagtatccattatggctaccaccattaagcttgagggcgaggcccgttccgagttcggcaagggcgttgctcgtcgtctgcgcgttgccaacaagattccggccaccatctacgccggcggcgaagagcccgccttcgtgaccttgccgatgcgcgagaccaccctggccctgcgtcacaccaacgccctgttcaccatcgccttcgacggcaacaccaagatggccgtcgtcaaggacgtgcagaagaacccggtcaagcgcatcatcgagcacgttgacttccttgaggtcaaggccggcgagaagatcgacgtcgaggtgccggtcttcgttgaaggcaccccgaagggcgctgctgtggcattcgtcgacattcaggagctcaaggttcgcgctgacgtcgccaacttgcctgagaagatcgttgtgagcgtcgagggcctaaccgacggcaccaaggtgttcgctaaggacgttgttctgcctgaaggcgttgagctcgacgttgaggacccggaagagtccgtcgtcaccgttgaggtgccggaagatgcttctgagtccaccgccgctccggaagctgctgctccggctgccgacgctgctgctccggctgccgacgccaagtgagtcgatcgcttcgatagcgaacaattcagaacataactgaaacgtggaagcccgcagccgttgagaacggtgcgggcttcttcgtttttcaccatgtgaactctgccacacgagtaacacatgggtgtgcaaaagtatgcaacagagctcgcgccacaagcgcacagcacacaccccatatggtggctttcgggccgccaaagtcaagaagaagtagctagtaatgactgaaaacacgcaccacgatccggcagcgctcgacaagctcgccgaaccgttcaccgtactgccgaacgacaaccccgcatccgatgagaagcgtcagtccctcatcgacaagccggctttcggccaggtgttctccgacaacatgacccacatgacctggaccaagggcgaaggctggtccgaccgccgcgtcgaaccgtacgcaccgctcaagatggatccgggtgcttccgtgctgcactacgcacaggagtgcttcgagggcctcaaggcttaccgtcatgccgacggctccacctggctgttccgcccggatgcgaacgccgagcgtttccagaactccgccaagcgtctgtacctgcctgagctgccgattgacgacttcctcggttccgtggccgcgctggtcaagcgcgacgccaactgggtgccgtcccgccgcgagtacacgctgtacatgcgtccgttcatgttcgcttccgagccgttcctcggcgtgcgcgccccgcaggaggtcgactactgcgtgatcgcctccccgtccggcccgtacttcccgggcggcgtcaagccggtgagcatctgggttgaagacaagtggttccgcaccggccctggcggcactggtttcgccaagtgcggcggcaactacgccgcctctctgctcggcgagtacaagggtgttgagaatggctgcgagcaggtgtgcttcgtggacgccgccaccaagacctacctcgaagagctcggtggcatgaacatgatggccgtgcacaaggatggccacgtggagaccccgtccctgaccggtaacattctgccgggtgtgacccgtcgctccctgattcagctgctgcaggacaagggccacgacgtagtcgagaccatgattgccctcgaccagctgctcgaggacatcaagtccggcgaagtcaccgaggtgttcgcttgcggtaccgccgccatcatcaccccgatcggtcgcttcaagtccgagaagttcgatgtcaccgtcgccgacggcggctccggcaagctcacctgcgaactgcgcgacgagctgctcggcatccagctcggcgaagtcgaggacccgcacaactggatgtggaaggtgtgctgaactagcaccttttgtttctgactaagaccccttggaacagcaacaattccaaggggtcttggcgtgttggaaatgttcttggctagagagatacagatggatttagcaacattccgcaacaaataatatgatctaggtcttctgcacgttgcggggggtggttatggttcatccagatgagaacaggagcaaacctatgagcaagatgagtgacatgacggaataccatgcttcagcctaccgtttgccgtcaggcttcgaacactgctcgaaattgaagccggtggctgaggcagcgacggcgctggaccgggtcaaggccgtggtggatgtgctgtgttcgccgggcggctgcccgtgggacggcaagcagacgaacaagtcgctgctcaagaatctgctcgaggaaacctacgaatacgtcgacgcggtggagactcacgaccgtgacaacatgcgcgaggaactgggtgatgtgttgctgcaatccgtgtttcaggcgcgggtctgcgaatcggatactgaggacccgttcggtattgatgaggtcgccgatcggttggtgaacaagctcatcactcggcatccgcatgtgtttgcggctgatgatgccggcaattcctctgattcttctgatgcttttgatgctgacagtaacgacgggggagaagctgcccaacccgaatccccggaagctgtgctggctctatgggaaaagatgaaacagcaggaaaagcatcgtaaatccgtgcttgagggcatttcccgcgctcaaggtgcgttgcctcgcgcggccaaagtcgtttctcgcatctccaaatcgccgaatgctgatagattgttcgcggcgtttgatgagccggctgcggctgatgctcagcgagatgatgtacatcctcaagcggcgaaccaatccgaatcaagcggcgacaattccgctgaacgggagaaggccgatgcctacgccgatgaaatcctcgccgtcgtgcgcaaggcccgcgttgacggcatcgatatcgagtccgcactgcgcaatcgcttgcgtgatgtcgaagaaaaagtcgccttgattgaatcagaaatcaacaacgattaagtccatacatgttttttgattacagatcgtaaaacctagaggggctgagttgccaacgactaccggcaagctggcgtcattgccatcctattcacgtcttagtggccccttcctccccggccatactactcaggcaaggcctgttgtaggctcgggtacgacgggctgtagcgccgaataaggatgaacgggaacagaacgaagacggactgagacgaaccgaagcggtaccagaggggagtggctcatgcaggtggcgttggagaacaacatcgtttttgtggtcatcgagtatttagcaatcctgtgttggggattatcgggcggacttgccgccattcgcaagggctacgacatcttcaccatcatgctgtgcggatggcttaccgcactcggcggcggtcttgtgcgcgacgtgatgctcggtgccctgccgccggtcggcatcaccgacaaaggctatgtgctcaccacgctgttttccggcattatcgtggtggtggcccatccggagatcaccaaactcaaatggacgatgactgtcatcgatgctctgggcctcggactattcgcagtcagcggcaccgcaaaagctctggcctacggttcctcaggcatgacagccgtattccttggcatgttcacagcactggccggcggcctcattcgtgacatcttcattggcgacgtgccaatgattattcgagacaaacacctctatgctgtgccttcgttcatcggctgcatcctgaccgtgctggtatggcgcggcgtaggctacggctggttcgacatgcgctcggaaatgctgctcgacgtgctgatcgtcatcatcgtggtggcgctgcgactgctctcggtaggcttcaacgtcactctgcccggagccgtcgaacgtcatcgcgtctacctgcccagcgaaagccgatatctcaagcgcccggtcatccatccgcacgccgataccgtcgatcccggcgataccaccaaggacgaagaagacaagcctcaggatggttcaaggccgcctcagggctaactgtcttcaaagaggtacatctggccttctgcagaatgctaactgctttcaaagaggtacctgaagcacgaaacgctgagtataagtgttgcaatgatggcgtttatagttggtttttcccgtattcggtacctctctgaacggagatgtcatttcgcaagaccgccaatgtacctctttgaacggagatacaaaaagtcccgcaagccagatgacttgcgggactttctaaaaccttaagaggcttatgctcacagagcgttgatcgcaacagcgaggccggacttgcggttggcggcctggttcttgtggatcacgccagcgccagcagccttgtcgagcttctgggcggcaaccttgtaggcggcctcggcggcagccttgtcaccggcggcgatggcttcgcgggtggcgcggatggcggtcttcaggccggacttcacagccacgttgcgaaggtgcgccttctcattggtgagcacgcgcttcttctgcgacttaatgtttgccacgtttactccaaacgatgtgtgttataaggacatacaaaagttagaggatagcatgagccccggaaaaacccgcgcaatgccacgccgaatacagtccctcggctacactaggtgaagtttgagtatatgccaagaggaggaatgcgttggtcgtccaacacaatcagccgggttccacggatcagtcggtgattcgcaacttctgtatcatcgcacacatcgaccacggcaagtcgaccgtggccgaccgcatcttgcagttgagcggcattgtgcccgagcgagagatgcgcgatcgcttcctcgaccgtatggatatcgagcaggagcgtggcatcaccatcaaatcccaggccgtgcgcgtgccgtggacctttgacggcaccgaatacacgctcggtatgatcgacacccccggccacgtggacttcacctatgaggtgtcccgcgcactggccgcctgcgaaggcgcggtgctgctcgtcgacgccacccagggcatcgaggcgcagaccctgtccaatctgtatatggccatcgaccatgatctggccatcatccccgtgctcaacaaaatcgacctgccgtccgcagaaccggacaagcatgccgaggagatcgcaggtctgatcggctgcgagccgagcgacgtgctgcgcgtctccggcaaaaccggcgaaggcgtggccgacctgctcgaccagatcgtcatggacgtgcccgccccgcacggcgaccccgatgcccccgcccgcgcgctgatcttcgattccgtctacgactcctaccgcggcatcgtcacctacatccgtatggaggacggcgaactgcacgaccgcgaaaaggtccacatgatgggcattggcatgacccacgatcccattgaaatcggcgtgatcagccccgatatgacccgcaccaaggcactcggtgccggcgaggtcggctacatcatcaccggtgcgaaagatgtgagtcagtccaaggtgggcgacaccctgacttcggccgtccgcccggccgccgagccgttgcccggctatcgcgacccgaagccgatggtctacgccggtttgttcccgatcgacaacgcccagttccccgaactgcgtgatgcactcgacaagctcaagctcaacgacgccgccctgatctacacgccggaaacctccgtggccctaggcttcggcttccgctgcggcttcctgggtctgctgcacatggaaatcgtcaacgagcgactctcccgcgagttcggcctcgacctgatccagaccgccccgaacgtcacctacgacgtgaccgccgaggacggcagccagcatcatgtgaccaacccgagcgaattcccggacggcaaaatcaagaagattgtcgagccgatggttgccgccgacatcatcacgcccaaggaattcatcggtgcggtgatggatctgtgccaggaccaccgtggcattatgggcacgatggagtacatctccaccgatcgtgtcgagatgcactaccgcattccgctggcggaaatcgtgttcgacttcttcgaccagctcaagtcccgcaccaagggctacgcttcccttgattaccatgaggatggcgagcagtccgccgatttggtcaaggtggacatccttattcagggcgagaaggtcgatgcgttcagtgccatcgttcaccgcgataaggcgtattcgtacggtgtgatgatgaccaagaaactgcgtagtctgattccgcgtcagcagttcgagattccgattcaggctgcgattggttcgcgcatcatcgcacgtgagaacattcgtgcgttacgcaaggacgtgctcgccaagtgctacggcggcgacatcacccgtaagcgcaagttgctcgaaaagcagaaggctggcaagaagcgcatgaagatgctcggccatgtggaggtgccgcaggaggcgttcatcgcagccctgtccaccggcgaggactccaacgaccgcgacaccaaagacaagatccgcgccgctcagaagaccgagggctagtgttcgaggtctacatccacgtcccgttctgcttgcggcgctgcggttactgcgacttcaacacctacacggctacggatcttggtgcgggggcctcgcgcggcaactatgccaatatggtcattcgggaaatgaaattgaccaagcagtggcagctcgaccacggcatcgaggagccgccggtttccaccgtgttcttcggcggcggcacccccacaattctcgccgcccgcgatctggtcgccatgctcgatgccgtccgcaagatctggagcatcgcgcccgacgcggaaatcactaccgaagccaatccggacacggtcaacgagtattacatcaatgagctcgctgccggcggcttcacccgtgtttccttcggcatgcaatctgccgtgccgcacgtgctcaaaaccctcgaccgcacgcatacgccggccaacgtggccgtaggcgtcaatgcggcgaacaaggctgggctgcgctccagcgtggatctgatttacggcgctccgggggagagccttgacgattggcgcacctcggtcacgaccgccatcgatcttggcgtaaaccacatctccgcctacgcattgaccgtggaacccaccacgaaaatgggccgtcaaatcgcggccggcactctgcccaagcccaatgacgatgacgaggccgctaaatacgagatcgctgacgacctgttcgccgccgccggcctcgaatggtatgaggtctccaactgggctcgccccggatacgaaagccagcacaacctcggctactggcgcaacgttgattgggccggtctagggccaggtgcccactcccactacaacgcggtgaccgaggctgaccacccccagtcggcttcgctgacagcccccgctggcgggagcaagtccgaagccattgcctctgcctcagctgatggacaggccaacgccgaactaggtatgatcaacgcgcatgggaacaactcccaagaaattcatgcccccgctggcgggggttgtccggcggatgccggactgggggtggtttctgtctcacacggtctgcgcagctgggacatcgcgcacccgcgtttgtggggcacggccatcaacgagaaccgtgtgccgtgggccgatagcgagacgatcactcccgaggaaaacctcgaagagctcatcatgctcgggctgcgcctgcacgagggccttgacctcgaccgcatcaaccgcgccatcaacgatgcgggtatgagcagcacgccccagactctccgtaatgtttcccttgaccaactcgccccaatggtcagcgaaggcctgattaccgtatccgataatcatcgagtggtgcccactcgtcgtggccggttgctcaatgactcggtaatcgaacagttcttcgatttcgtcggtgtatgagtcggtggtatggtgcgcggcagtcgccattacctgttcgctagttgtggttacaccgtcagagggagctatttttgttttaccggcgggggagggaaccgcgtaggactacgtccggggcgctttgcacgtagatcaggcggttggcagtgccgccggtggcctccccgtcatcgcggttggacaggatgctgtccacggcggcctggcccatttcggccagcggcagatgcacggtggtcagtggcggaaacacgtcggcggagtaggggatgtcgccgaaaccggtgacgccgatttcccgacccggctcgatgccgttggcgcgcaacgcggtcatcgcaccgatggccatcacgtcgttgagcgcgatgattgaatcgatgcctttgccgtcgtacagtgcgccttcgcccggcttcagcagtccggatcgggccatttgcatgacggccgcatagccgtcggtacggctgaacttaccattcgccacggctttcggatccacggtgatgcctgcctcgtccaacacttccatcacgccggccagtcgttctttggaggagcgatgtgcgtcatcgcccttgagaatcgcagggcgcgtatacccggaatcgacgatcagctttgcgatggcgcgcgcgccgacatcgttcgccacgtccacggccgggaagggcaggttgcggttgagcacgaacacggcacgtccgccggatgcttcgtactgggtgagttccgtctgcaacgcctggcgttccggcgcgtcggtgtattcactttcggagatgatgatgccgcgcggcctggtggatacggacttacgcaccgcctccaactcttcgtgcggggtggctgccacgccgatggtcacggaaatgccgcgttcggccgccgccttgaccacgccttgcgatacggatgcgaagtagggatcggagatatcggagaccagcagcacgatgttcggtgcggtgcctttggccactgcctgagcataggcgttggggcgatagttgagcttggtggctgcttccatcaccttgacatacgattggttgcgtaccttgcgggtgctgccgttgagcacgcgggatgcggtggcgatggagacttgggcttctttggcgacatccatcaatgtcgctggcgattgcgccttatcgttctgtacagccacgatcgaatcgatccttttcttccctgaaacggaaaacgtgtctaaacgtttaccgcaacgatatcgcatttttgcttgcaatagtagcattgtggattggaaagcctgaattctgaacaaaaaaataatcacgcgaattacggaaaacgtttaccgtttcgtcgtgtcgtgcggtatgctcgaagcatgacgcgatacttatgcgcccctgactccttcaaagagagcctgaccgccatggaggcggcccgggcgatggctcaggggattgagaatgccgaccacgatgccgaggtccgttgccttcccatggccgacggcggtgaaggcaccgcacgcgcgcttgtcgacgccaccggcggatcgatgcgcgccgtgccggtccacgacccgctcggccggcctgtcgaaggccacttcggtctgctcgccgacggcacgaccgccgtggtcgagacagccgaagccagcggactggcactgcttgaagccaaagaacgcaacccgttgatcgcctcctcctacggcaccggcgaactcatgctcgccgccgtccgttccggagccaagcgcatcatcgtcgggctcggcggcagcgccaccaacgacgccggtgccggacttctgcaggccctcggcgttcgtcttctggacaagaacggtaacgacttggcacacgggggagcggccctcgccaatctgaccaccatcgatatcagcacgatggacccggctctcaagaacgtcgccatcaccgccgcctgcgacgtgaccaacccgctgaccggccccaccggcgccagcgccgtgttcggcccgcagaaaggtgcgtccaaagatgatgtcgccacattggacgccgccctcgcgcattttgcgcaggtaatcgacagccagctcggcgttgccgtgaacgacgtgccgggtgccggcgcggccggtggcatcggtgcagcgctgaagggcttcctaaacgccgaattccgcccgggcatcgccatcgtcatcgaacaatccggactcgatgcggccgcgcaatgggctgacgtggtgttcaccggcgaaggctccatcgacttccagaccaagttcggcaagacgccggccggcgtggccgaaaccgccaagcgccacggcaagccggtcatcgcagtagccgggcatattggcaccggcatcgatgagctgcatgaggtcggcatcgacgcggtattcggcatcgcgcccggagccgccagccttagtgagctgttggccgatgcggccgccaacgtgacccgcaccaccgaacaaatcgtacgaaccctacaactgtgagcaggctcccgctggcgggggctggcgggcttcgcccgactggggggcagcgctgagaaccaccctcagtctcgctatgcgagacagctcccgcagcgggagcgagtaccggaaaggaagacgtgcgcgccacactggaaaccgtgagctgcggcgaactgaccgccgtgtatcgcaaagatagcgacaccggcatcgtggaactggtatcatggatcgtcgacgcgagctcggtcttgtgacatgattggtggtgatggaatcaacgatgagtccaacaaaacggcaccgcctcccattgcgcaatatcgcgcgcaatattacgcagcgtattggctctccgaatgcgtgtctgctaaacctcgtgttgctctatcagcgagctttccgactgcgcagctcaggcaacatcacgacgaacaggatgaccgccacaatcgcggtcagcagatcggcgatggcctgcgcggcgattacaccctgatagccggccagccgggagccgacgaacagggtaatcgccagcatcacaccctgcctgctgatcgacagcacaaaggcgccgaccgccttgcctgcggactggaaggtgcaggtcgtgaccatcacgacggctacgcacaccaggctcagcagctgaacccgcagcatgccggcgcccagcgtgatgatggtggcgtcctcgatgaagaatcccatcagtagacggtcggacaggttgagcaccacggtcatcaccagggcgaacagggacaggaacaggtaggaaaaacgcagaatgccgcgcagtcgaggcatattgcgggcgccgtagttgtagccgatcagcggctgcgcgccgaacgcgaatcccacgaaaaccagcaccgcgatcatgatgactttcagcgcgatgcccatcgcggctaccgcgtcggtaccgtaggggagcaggaacaggttgatcatgacgatgccgacgctctgcgtgaggttcgtgatcgccgaggggatgccgatggcgaggatgctcccgacctcccgggccgtgaccgccagacgccggcgcgcgcggtcgatgacggtccgcgggtcgatggacaggttgctgctgtgacgcagcgtgaaccagacgaaataggcgtcggtgcagatgttggcgatcacggtggcaccggccgaacccgcagcaccccagccgaatccgtggatgaacaggggattgagcacgatgttgaccgccgtgccggccaccgaaccgatcatggactgcacggcgtggccttcggtgcgcagcaggttggacggcgtcatcgacacgatgatgaacggcgagccgacgatgatcagcgtgtagaagtcggaggcatactgccaagtgtcgtcagtggcgccgagcagcgcgagcatcgggtcgcggaacgccaggcccagcaccagaatcagcaggccggtggcgatggcggcatagaagcagaacgcgctgagtcgcttgccatcggcgaaccggtgttggccgaacaagcgcgagatgaccgaactgccgccgaggccgaagatgtcgccgagggcgatcatcacggtgaacactggcgcggtgagggagacgcccgccaccatatcggtgtttcccgtatgcgcgatgaaataggtgtcgaccatgttgtacaccaaggtgaccagcatgctgagcaccacgggcatcgccagcgagaaatacgcctccggaatcggagccttttcgaagagttcgttatccatttccgtcccttggtgtttcgttcttcagtcactgtgcaggatgccgttcggcgtgcatcacaggcattgtagaggcaacagtgtggacaacgggcgggggagtatctcatgatgcggtgagggcgttgatgatgacgcatcgtgtattggcggccgtgtgcatcgtatgtgaacctgtgctggcgcggcgtacgcacgatgggaaaagaaagaatatatggaccccgttgtcccggttattgttcagttttactgtgttgaattattgcgttattcaattattgtggtgtgccggccgattgcggcctgagggggattgccttcgtatgtgtcatgcaatctcatgaacgggattgttcgctagattcagcgagcgtccttgttggcggcgttgatgatgtcggcgaacatcttggagtcggcgtagccggcgcgggcgatggcatccataccggagagggcgagaccgcgaatcatggaatccttgagagacataatcattacctttcgtttgcgcatcgccgtgagcggctttgcgattgttgtttaagctttgttgttatggggtccgtggctaatctgattggattgccggaccggagccgatggttcagcgagcgttcttgttggctttgttgatcaggtcgacgagcgtgctgctgttggcgcgaccgcactggctcatggagctcaggccgtacacagccagaccgcgaatcatggaatccttgagagacatcatgtttcctttcgttggtcaaaaccttggggctttgagttttgtttatcggcttctttctgaaaccggtttcagaataacgcagtccgatgacaaacgcaaggggactattccgctctcggcgtttctggcggaatatcgccgttctttagataccattcggtagttaagaggttgtctagtcgaccttctgacggccttgttctgagcgtacggttttcacgaggtatggcctcatgtcgcggaaatcgtacgctgagtcgtcgtaagcgtacggttttcacgaaatggggtctcatctcgtgaagaacgtacgctgagtcgtcgtaagcgtacggttttcacgaaatggggcctatcttcaccggattttgggcacaccggccttgagcagcttggtctcaagattgatggggcgtagcagatcctcatagaacacatggacgatttcggtgacgccctgttcccggagatgccgatcacgtctgcggtcgtactccattttcgcctggaggcttgcgcgattcttgttgctgatgtcggcgtatttggccatgccgtcgtattctgccacgatgatgcggccgtctgcgagcttccaacagaaatcgacgcgatatgacattgcgggattgtcgggattcatgaactgcacctgcagcagggggatgccgaaagacaattcggtgatctggccacgcatcaatgattcgccgccgttttcgctcaggggatccgcgtacttcagcagcttggtcacggagacctcgtcgcagacgctttgaatcatcagcgactgcacctcttcgatggtcgtcagggactttctcagagccgaatcgtatatgggcagcgcctgtgggaatgggaatgccgcgcagtcgagcagcgttcgcgccggagtcgtcaggagaatgccgttatgcttccgcgtcggaatccgattgatatagatgcggttgagacgcgcctcgtctccgccgccgatgccggacttcgaggcgatgtgcactgtgccgtcgtgcagtgaatagttgtgctgcagtccgtatacgcacgccgcactcaaccccgcaaatacccactgagggtggattgcggacagcgcgcgtatgacctgcaatgactgttgctctctggtcatggtgttccaaagtgttcggtcggcgtacaggttcttatacggtgacaccagctccccggcatgcaggcgacgtttcagggcgcgtcgttgcgcatcactggtgccatagcagcagcgacgctcctgcttcgcctgctgcagcagtgcagaaacttccttgtgttctttcatatctcgacgctaagggtgattttgatcgttgcacaagctcaaccggcaaatgtggatactatgtcacgcgaattgttgctgtggataacttgaatcgacgtcgacggctttgccgacggtcttgtcggaggcgatattggcctaggataccttgctgcgccgccttccataccgaaaacagtcatcagtgacaccgagggcatcttcagcgtacgttcttcacgaaatcagctgccatttcgtgaaaaccgtacgctcagaatgactcagtgtacgttcttcacgagatgaggccccatttcgtgaaaaccgtacgttgacgacgattcagtgtacgtccttcacgaaattagggatgatttcgcggaaaccgtacactcaccgcaactcagcgtacggttttcacgaaattattgatttgggtataggttccccgtcatgaactacaatgaatcgcggcgaaaaacggagaaccgaagtcggagcgcggctgaacggatatgggtgtgactggatggctgtcatagtgatgccggttctctaacatacgcaataacaacaactgacaacaacaggggagacaaggatggcgagaagtgcgggccgcacccggccggtgatcaaggacgtggccaaactggccggagtctcggcaccgaccgtctcccggtatctcaacggcaccgtcaatgtcaccgaagacaagcgtgaacgcatcgccaaggccatcaaggcgctgggctacgagccgagcattgtggcgcgcgctctgtcgaaccgggagatggactccgtggtggtgttcgcggccaatccttccgccttctccacgtccgaaacgaaccatggggtggaggccgccgcccgtaaacgtcggttcctgctcaatattgtttctttggacgagtccgacatggactccgtcaaggctcgcgtgcgcatgggtttgtcgatcaggccggcgggcgtgatcgtctacgagtacgaccgggccggcattgccgcactggaatacattcccaaagatatgccgatggtcgtggtgggtggcagcttcggcgacggcgaataccaggtcatcaacgccgaaagggatggcggccgttggatgaccatgcatctgctggatctcggccatcacaccgtgttccatgtggggcgtccggaaggtccgaccgataacacccgcaccaatgggtggcgtgacgcgctcaaggagcgcggcgtcacggcacctgacccaatcatcgttcccgacgatgatttggaggagtcggtcaaggctgggcgcaccttgggccgtcgtggtgatgtgactgcgattttcgccggcaacgacgagaccgccatcgctgtgatccggggtctaagggaggttggtcgacgcgtgcctgctgacgtgagcgtcgtaggctttgacgaccgcaacttcggtgccatgtggaatccggcgctgaccagttacacccagaacttcctggacatgggggagcgatccttccgaatgctgttcgaacagatccaggccaagcgcgccggcgatgacgcgccgccctcgcaggtcgaggtggtgcaaggcaagccgtgtctgcgagcctccgaacgcgcgtacggcgacggcgaaatcgcgtagtcgatggggacgtgcgtatcaatcgatagtgactgtagcgcatccatatcgtgatgaggagtctctcatgccgaactgtaagcgcttaccttaagtagtttgtaatatggtttacgtcataaaaaaagatattctaaatcatagtgttttgcaagggcttttgcggaaaatggctatttatcaacagtttttgaaaagtccgcatgacgggcgactgtgagcacgctttatggaaccgctttccgtagtgttatcgttacagtatgacttttgaacaatcggcaactctgaagactcagcctcagacctcgggcactatctcagcggcagacgccgcgatgcaataggcccgcgacgaacgcatccccggcaaactcatctgtgcgatcatggccgtggtcattgttatcgtgttcgtcgccatgctccacgccctacgtaaccggaagtaggttgtaggcgggattggtctgactggtatccgccacagccgggttcggtagagcggctaccaatcggccagtgcctctatggcatcgagtcctgttctgcgatgttgttcgtcaaggttgttccggtaaggtgattcatcggtgagcatgtcgtacaggagcttgatacgtctgcgatccgtgtggctatgtagtcgttgagtttcggcgtcagggtcgctgatgagggatgcgggcattgcggcatcgtacagatgtctatctccatatccggcgtggtctgcttggtatgcggcgctcttaagaatcagcgcgccaaacagatccgcgtcggtagtgggacgcacgtcgagaccgcccatgatggcgtgcaactgcaccatgagaccgccggtgagcagtcatgattcggtaatgcgcccggccaccatgtatacgatattccacggctgagcgccgctggggattgcaatgcgggaaatcattgtccattttccttgttgtatgccgtgatgagttctgtaagggtttcgagccctgcgcgtcgttctctcgggtcgttggattcggccagatcagcggcgcatacgccgatgggcatgggcccctgcccggcgggcagaaaattagcgatatgccgtgattcggcgggaggtctcgtactggccccagcccttctgctcggtagtggtaccgctacaccgactctccccgacactccagtgccgccgatatcagtgaatgcccagcctgatgtcggtagagtaaaggctattggcttggtctcgacggtgagacttctccaatggccaatatgcactgttgcaaaggagtatgcggtatgcaaccaatcaaagccattcaatacggctgcggcaaaatggcgaagtacacgattcgctatatgcacgagaaaggcattcaaatcgtcggtgccatcgacgtgaacccggaagtcgtgggcatggatgccggtgtgtttgcaggcatcggccccatcaatgtgccgattcgcgccgatgccgaggctgtactcaacgagtgcgacgcggatatcgcggtagtcacgctattcagcttcgagaacgaaatcgccaccatgtgcgagcagtgcttggctcgcggcatcagcgtgatcaccacctgcgaggaatgcatctacccgtggaccaccgatccggccaccacgaaccgtctcgacatcatcgccaaggaagccggtgccaccatggtcggctccggcatgcaggacatctactgggtgaacatggtctccaccgtcgccgccggatgccacagcatcaagaagatcaccggtgcggtgagctacaacgtcgaggattacggcctggctttggccaaagcgcacggctgcggtctgaccgccgaggagttcgaggccgagctcgcgcatcccgaaaccgtggtgccctcgtatgtatggaattccaatgaagcgctggcccagaagcttgggcttaccatcgcatcgcagacccaggccagtgtgccgtatttcagcgatgtcgacgtgtattccgaaacgatgggcgagacgattccggtcggcaaatgcatcggcatgtccgccgtggtaaccaccgaaactaatcagggcatcacgttggaaactgcctgtatcggcaaggtgtacgggccggatgatggcgatatgtgcgattggaagatcgagggtgaaccggacgtggagttccacgtggtcaagccggcgaccgtcgaacatacgtgcgccacaatcgtcaaccgcattccggacgtgctcaacgcgccagccggatatgtgacggtcgatcagctcgatgagatttcgtatcttacgtatcccgccgcgctgtacgtggcatagccttcatattttcaaggatgaaggccggcactcataagggtgccggtcggtatcaggcggacagagtcgacgtgcgtggcatcacctggaactggatatggtcatgggtgatgtcatcgggccgttcatgccgtaggttcgactcgttcagcgtcaccatgcgatcgataaccgtacgagccattgcggggacgtccatcgccacagtgctgatgggtgggttggtgcaggcggagaaggggataccgtcgaatcccatgagccgtacgtcgtcgggcgcgtggatgccatgttcggtgagttcgcggagcgcgccgatcgctatggtgtcagacatgcacagttctcatgttcccgctggcgggagctgtcatgcgaagcatgactgagggtggtccacagccgccaatccgtaacatcacccaacgcagcatttcacgatacggacgtttccgtatcgtattttcgtgtggtcaaatagacatttcgagcgaaaaagttcgaaatacccccataactggccataaaaaaattgcttgagaatcactattgacttttatggcgactcggtatatggacacatgaaacgtaaatgacatggagcgacggtactgtgtcaacagcaatgaacgaagaggcatgattttcttacgtgcccacaaccaattgaggtgatttcggtgacattcaaagccccgctcgatctcacggtccacgctccggacggtatgtatgatcccgccaacgagcatgacgcctgtggtgtgggtatggtcaccactttgaacaagcgtcctgagcgcaagatcgtcaccgacgccattgaggtgctggtcaaccttgatcaccgtggtgccgtgggtgccgaggagaacacaggtgacggcgccggcattctgatgagcatgccggatgagttcatgcgtgccaccgtgcccgccgaactgccggaagccggtcactatgcggcaggcatcgccttccttgaccgcgacatcgaaacctccggtcagcaggaacaggccattgccaagatcgtgcgcgaggagggactcgaagtcctcgcatggcgcgtggtgcccaccaacccggacggccttggcctgcaggcccttgccgccatgccaggattcaagactctcgtggtcgcctctccggacggtgctctggccggcgtggacttggatcgcaagaccttccgcatccgcaagcgcgtcgagcatgaggtgggcgtctacttcgcatccctgtccgcccgtaccatcacgtacaagggcatgctcaccaccatgcagctcacccacttcttcgaggatctgaacgacgagcgcatgaaggccaccatcgccatcgtccactcccgcttctccaccaacaccttcccgagctggccgctggcccagccgttccgtctgctggcccacaatggcgagatcaacaccatccagggcaaccgcaactggctctccgcccgtgaaggccgcctgagcagcgaactgctcggtgaattcgagccgctgctgccgatcaccaccccgggctactccgattccggcaccttcgacgagtgcctcgaactgctgcacctcgccggccgctccctgccgcacgccatctgcatgatgctgccgccggcttgggagaagaacccggatctcgatccggacgtgcgcgccttctacgagtacaacaacacgcttatcgagccgtgggatggcccggccgacatcgtcttcaccgacggcacccaggtcggcgccctgctcgaccgcaacggcttccgtcccggccgctggcagctcaccgatgacggctacatcgttctggcctccgaggccggcgttctgccggagatcgcgcaggaacacatcgtgtccaagggtcgtcttgagcccggcgagatgttcttggtcgacaccgccgaaggccgcatcattcccgatgaagaggtcaagaggaacctcgctgcccagcacccgtaccgcaagtgggtggaaggcaactccgttgaaatgagcgacctgccccgccgcgagcacgtcagccactccggccagtccgtccagcgccgtcagcgcgccttcggctacaccgaagaggatctgaagctcctgctcacgccgatggccaacaccggcaaggaaccgctcggttccatgggtaacgatgcgcctatgcctgcgctttccagccgcagccgcatgctgttcgactacttcacccagaagttcgcacaggtcaccaacccgccgctggactgggagcgtgaggagatcgtcacctcgctcgaatccgccatcggccccgagccgaacctgctggccgattccgagctgcacgccaagaagatcctcatcccgctgcccgtggtcaactctgatgagatggcccagctcaagcgccttgacaaggcccgcatcctcggcggctactaccgcccgtacgtggtcaagggcctctaccaggtcgccggcggcggcaaggccctcgaagagcgacttgacgagatcttcgccgaaatcgacgaggccatcgccaacggcaagaacttcatcgtgctctccgaccgtgagtccaaccatacgtggggtccgatcccgtccctgctgctgacttccgccgtgcagcaccacctgctgcgccgccacacccgtacgcagatctccgtggccgtcgaggccggtgacgtgcgcgagattcaccatgtcgcgctgctgatcgcttacggtgccgcctgcgtgaacccgtacctggcattcgaatccgtggaagatctggcccgcaacggctacctcaaggtcgacgcggacaccgccgtgaagaacctcaccaaggccctctccaccggcgtgctcaagatcatgtccaagatgggcgtctccaccatcatgagctaccgtggcgcgcagctgttcgaggctgtgggcctgagccaagaagtcatcgacgaatacttcaccggcaccacctcccgtgtgggcggcgtgagccttgaagaaatcgccgaagaagtggccatccgccaccgcgtggcctacccgaaccagtggagcgcgtccccgcaccgcaacctgcgcaccggcggcgactacaagtggcgtcgcaccggcgaggaccacctcaacgatcccgaggccatcttcctgcttcagcagtccacccagcgtggcgactaccagatgttcaagaagtattcgcaccacatcaacgacacgtcgaaccgactcatgaccctgcgtggcctgatgaagttcaacaccaaccgcaagcccatcgacatcgccgaagtcgagccggcctccgagatcgtcaagcgcttctccaccggtgccatgagctacggctccatctcgcaggaagcacacgagacgctcgccatcgccatgaactcgattggcgcacgctccaactccggtgagggcggcgaatccgacgaccgtatcaatgatccgcagcgctacagccgcatcaagcagattgcgtccgcccgcttcggcgtgacctccgattacctcgtgcacgccaccgatttgcagatcaagctcgcccagggcgccaagcctggtgagggtggccacctgcccggagccaaggtcccgccgtggatcgccaaggtccgtcacgccaccccgggcgtggagcttatctccccgccgccgcaccacgacatctactccatcgaggatctgaagcagctgatcaacgatgcgaagatggccaacccgaaggcacgtatccacgtcaagctcgtttccgagttcggcgtcggcaccatcgccgcaggtgtggccaagtgccatgccgacgtggtgcttatctccggctatgacggcggtacgggtgcagccccgctcaacgccatcaagcacgccggcaccccgtgggagatcggcctgtccgaaacccagcagacgctgatcctgaacggcctgcgctcccgcatcgtcgtccagtgcgacggcgagctcaagaccggtcgtgacgtggtcatcgccgccctgcttggtgccgaggaattcggcttcgctaccgcagccctgatcgtggaaggctgcgtcatgatgcgcgcctgccagaagaacacctgcccgcagggcattgccacccaggatcctgagctgcgcgcccgctttaagggcaagcccgagtacgtggtcaacttcttcatgttcatcgctgaggaggtgcgcgagatcctcgcccagctcggcttcaggactcttgaggaggccatcggccacgttgagtgcttggatcaggacgaggccatcaagcgctggaagtccagcggcatcgacctgtccaacgtgctcaagcaggccggcccggtacccggcacgatcctgcaccagaccatcgagcagaaccacgagctggagaaggcgctggacaacaagctcatcgaacttgcccagccggccctcgaacacaaggaacccgtgcgcatcgaaatgccgattcgcaacgtcaaccgtacggtcggcaccatggtcggctacgagatcacccgccgttacggcgaggaaggtctgccggacgacaccatcgacatgaccctgcacggttccggaggccagtccatcggtgcgttcatcccgcgcggcgagaccatgcgcatctacggcgaagtcaacgactacgccggcaagggcctgtccggcggtcgcatgatcgtgcgcccggaagataacgtcaccttcgacaagcacagcaacgtcatcgccggcaacgtcaccggtttcggcgccacttccggccagatgttcgtggccggacgcgccggcgaacgtttcggcgttcgtaacggcggtgccacgtttgtggtcgaaggcgtgggcgaccacggctgcgagtacatgaccggcggcactgttgtggtgctcggccccaccggacgcaatttcggtgcaggcttctccggcggtaacacttatgtgcttgacctcgatatgaagaaggtcaacccgggtgccatcaagtccggtgcactgctcttcaagtcgcttgatgccgaaacctccaagctggtgtacgcactggtcaagcagcatgccgaagagaccggttctcagttcgctgcggctttgctggaggactggaacgagaccgtcaagcggttcactcacgtggtgccgaagcagttcgtggccatgacgaaggccatggaagaggccaaggccaacaatgtagatttcaatgcgcccggcgcctgggaaaaggtgtacgagcaggttatggaaggagcgcgctgacatgggcgacccgagaggatttctgaaggtccgtacccgccgagagctggctgaacgccccgttgaggaacgtatcaaggactggttcgacgttcacgccgaaaccggcctgcaaccgtggacccaagcgcaggcggcccgctgcatggattgcggcaccccgttctgtatgaccggatgtccgctgggcaacctgattcctgagtggaacgatctggtccgtcagggcaagtgggaggacgcgtacaaccgtctgtccatgaccaacaacttccctgaagtcaccggtcgtatctgcccggctctgtgcgagcaggcctgcgtgctcggcatccaccagccgccgaccatgatcaggcttgacgagcagaccatcattgaccaggcatgggatttggactacgtcaagccgctgccgccgcagcgtctgaccgaccagacggtcgccgtcgtcggctctggccctgccggcctcgccgccgcacagcagctcacccgcgccggccacaccgtcgtcgtctacgagaaggacgacgccatcggtggtctgatgcgttacggcatcccgaacttcaagcttgagaagggtctgcttgaccgccgtgtcaagcagatggaggccgaaggcacccgcttccgcaccaacgtggaaatcggcaaggacatcacgtgggatgacctgcgtgaccgttacgacgccgtcgtagtggccatcggctcccgcgtgccgcgcgatatgaagattccgggccgcgagctcgacggcatccacttcgccctcgacttcctgcccgacgccacgcgccgtatcttcggcgtcaagccggtgcacgacatcaccgccaaggacaagcacgtcatcgtcatcggcggtggcgacaccggttccgactgcctcggcacctcgatccgtcagggtgcgaaggacgtcaccgtgctacagatcatgccgaaagagccgtcaagccgtccggacaacagcccgtggccgaccttcgcccgcacctaccagaagacctcctccatggaagagggcggcgagtacatctactccaccgactccgtgaacttcgagggcaccgaagaggagaaggccaaggtcaccattgataactcgaccaccgccgaaggcttcgtggccgatgagcgtggtcatgtcaccggcttgaaggtcgtctccgtggctcccggcgaaaatggtccgttcactcgccagcctggcactgagcgcgtgctgcccgccgatctggtcctcatctccgtgggcttcctgcacccggacaccgagaccatcctcgaccagctgcccgtcgaactcgacaagcgtggcaacatcgctcgcaatgacaagttcgccacctcccaggatggcgtgttcgtgtgcggcgatgccggccgtggccagagcctcgtggtctgggccatcgccgaaggccgctcctgcgccgcagccgtggacgagtacctctccaaggaaaagagcgagctgccggccccgatcaaggccagccagcgtccgatgatgctgcctcgctgaatctctccgttgtggttccctttcacgaggaaacttacatacaacactagatagtcctcatggcccctcatctgaggggccgttttctatttagcagcggctcccccttcgactttctggcataagccggaagctgagtcgataatgccctctaagcaccatccggcaagattgcgtttcaactcggtagtgcccagcactgacaattcggtgtcggtaagcatcatgcgctcaaacgacaacgagtgttcccgccattgcatcagatgtttgttgccaagagccccgccaatgatgtgcacgtactcttgtgtcggtgcttccttgcgtatgagtgccagcataccggcggcgaagagttgctcggtggtataggagagttggaaggcgctcataccaaacactgcaatatccgtatatcatgtgggcggctatgtgcaccgtccacatgatatacctactcttcttgctgggtgagtcctctccgaaggaatctttctattgacgagatttcagggatgtggaatcttcaccaatcggtacagattaagaatctgtgctagttgttgggatgattaatccagtaggcgatttcgcttactgaatcttcggatggcacgatgctgacctgaccctcagaggcaccttccgttcgtatggtcagtgtttcttgcgcaatgtcgtccgtacaggagacggtgcaatcctcgtactgttctccgatggagaatgacgcgttgagcgtcccgctgcccatgcagtacaccgtgagctggtaggtgccggcatcccatggcgaactgtcagtatcaagaatggccatggtttttcgtttaccggtctcatcagtctgatagctgggacgtgcgttgaacgacgcgcggaacgattcgcgattgagctctacggcatcctgtacggcgttatcgagttttgtcacggagcgtttgtcgagaacatgctcggaaacgggtgccttagcaggttgcttcgaagccgcagaatcattgctactgccatgtggagtcatcatccatatgatgccgatggtaagagccaataggctgatcgcggcagcgatgattgcggcctttgtttttgttgccagtcgagtgttcataatggcctagctttcccaatatcggtaaccccatacgttcgcactgggcacgattgcgcttccagaagcgagcacttggacattgcatggagcgacaatggtggcttttttacgtttacctgggcaccgtagttgccatactgcatgttcccataacgaccaggagatatactccgcgaatacttgtaggaggtcgatctggaagaagatgttgagttggaaaatccggcggagattgaagccttaacaatctgcccagtcgtaatactggcagatacgttggatgtgactcccactgtgtaggtggctgtggttgaggcagtgattgtaccgcccggacctgatcggaagatttgtcctacgccgatatggtaattgttattaacaatagtggcgcttaccgaggtctgtccgacctctggacatgcacgcaactctgtgttgccattttttctatggagaaggcttgcggagcaatagatatagagagaagtaccaccataagcgaagcgaacatttttttggcggttctcatgataatccctttcagggggagaaagcgtcggctgattgtggtcacgaatatcgtcagttcgaaccgaacgtggacgacaacgttgtcgttggagaagtcttcaagaaatatgttgatacttaatagattacattgcatgaaccttttgcgcttcattgcaactcatacgaatggacagtgtttgcgatttctccttacaaaggtggtcctacttgttcggatgtagccaatttcagtgacttggttctgaaaatgtcgttagccgtcgttgtgagtaccgtcaccattcgtgtaacgtcctcgcaaattctccgtagccgcgtccccgaggatgtagaaactgattaattattccaaaaatacttgtaatgtctatatttcgagaatattgcatatatagttaatatgaagctcctatggtgtctttcgtcgccaaaaagatgacgccagaatatttgggagagattcatgaacacacgccatgtcacttcactggtcgcggccggtgcggcaatcgtcatgctgctcagcggctgcggatcgaccggtacctccaattccagcaatgcttcagattccaatatcatttccgtgtacggcagtgagccggcacacccactattccccggcaacaccactgaggccggtggcggcaaggttgtagaccagctgttcgcaggtctggtgacctacgatgcgaagggcggcatccacaacgaggtagcagacagcatcacctccagcgacaacgccacgcattacgtcatcaagctcaagagcggatggaagttcaccgacggcactccggtgaccgcgcactccttcgtaaacgcatggaattacaccgccaacagtgccaacaagcaggccagcgccagcttcttcagcacaatcgaaggctatgatgatctgcaaaagccggacgtggaccccaaggccacgctgagcggcctgaccgtcgttgacgacaacaccatcgatgtcaagctcagccagcccgactcggcattcccggtcaaggccggcagccacgcctacatgccgttgcccgaatccgcgttcaaggacccgaagaagttcggtcagcacccagtgagcaacggcccatacaagttcgtgtcctggcagcacaaccacagcatcgaaatggtgaagaaccctgactacaagggcaatcgtgtcgccaagaacgatggcctgaacttcaagatctatacctcgcctgattcggcatacgccgacctacgcggtggcaacctggacttcacgaacacgattcctgacaccgcacttacctccttccaatccgacaagtcgctgaaggcatacaacgagcccggtggcaatacgctcaccttcaccattcctgaatggctggaacacttcggccagaacgaggaaggcaacctgcgtcgtcaggccatttccatgtccatcgaccgcaagaccgtcgccgagaagatcttccacggcaccgccacgcccgccgtcgacttccttgcagccccaatcagcgcctactccaaggaactcaagggaaatgaagtactgaagtacaacccgtccaaggccaaggaactgtgggccaaggccaacgccatctccccgtggagcggtgagttcggcattgcatacaatgctgatggcactgcgaagaactgggttgaggcaatctgcaactacatcaagaacacgctggatatcgatgccaagagcatcccgatgtccacttccgacgaattcctgtccaatgtggattcaggcaagatgacctccgcataccgtagcggttggggccctgattatccatccgcggacaactatctggtacagctgtacgattccagttcggccgacggcaagggcggcaacagcggcaactacaagaaccccgagttcgatgccatgatggacaaggctctttccgccccgtccaccgaggaagccgacaagtattatcagcaaggtgaggagattctgctgcaggaccttccggctatcccgttgtggaaccagaatgccaccgcagccagcacctccgcaatctccggcgtcgcattcgactacggcggcggcccagtgttcaccgcactgaccaagaagcagtaagcagtaagtaataaacagacagcgctagccccccgctggcgggggctgtcggcaaagccgactggggggtggtctcaaacagcagaccacccctaatcttgttatatgagcgagctcccgtaagcgggagcaatcgagaacatacaggagcacattaactatggaattcaccgtatccggcactaccgtgcgattcgatgaacgaacgatgcagttcgcttttacgcgcgacggtgccgaatggaatacctgcgctgatttcaagccgaccctgcaatgcgcgcaaggcaccttcgcgttcgcggatgccacttccatcacccatgagcagcgtgaaaccggcacgggaaccggcattcgcagcatcttcaccggctttgggcacagcgcatactcctttgaaacctatgtatgggtggagcgtgcctcaggcgatgtgctcttcgaatggattccgctcaatgagcaaggcctgaacatcaccaatgtgacgtggcccgcagccatggacttcgattgcgccgacgaccatgacacgacactcatcacccatgagcaaggtgtgatgatccccaacacatggcctaccgccgtgagcaccaaagacatcgccttcgacggccgcttcgaaacggctggcggttacatgccgtggttcgcgcagctccgcgcagacggacacgggtatatcgccatctgcgaaactccatggaatgccggttacggcatcgaccatcccagcaatggcccgtacacccatatcaatacttggtttgagccaagcctcggcacaatgaattatcgccgcgtggtacgctaccagttcctcgaccacgccgatcacacggcggtgtgcaaggcctatcgttcgtacgtcaacgaacgaggtcgcctgcgtacgctcgccgaaaaggcggcgcgcaatccctccgtgcgtgacctgattggtcgctcgtgggtgcacatcggcatcaaaaccaaagtgcagcccgactcgtactactacgataaggaccaccccgagaaaaacgagtcgctggtcaccttcgcacagcgcgaaaagcaaatgcgaacactgcacggcatgggtgcaggccgactgtacatgcacttggatggttgggcacagcccggatacgacaacgcacaccccgactatctgccggcctgtcaggaggcaggcggctgggaaggcatgaagtcgctggtcgacgcctgccatgagcaaggcgatattttcggcacgcatgaccagtaccgcgattactacttcaccgcgcaaacctttgatgccaacaatgcgattcggctggcagacggtacgatgcccgaacacgcacgctgggcgggcggccgccagacctacctgtgcgccgagctcgcaccggactacgtgcgccgcaatttcgccgaaatcgccgcacacggcatcaagctcgactgtgcatacttggatgtcttcacctgcaacgaaggcgacgaatgctcgaaccccgaacaccgcatgacccgccgcgaatgctttgaccgccgcgccgaatgcttcgaatatctgctctcgcacggcatcctctcctcgtccgaagaggtatcggactgggcagtgccaagcctgatattctgccattacgcgccatacgacttccagatgcgctcacccaacgagccgcgccaaggtgtgccggtgccgctgtataacctcgtctaccatgattgcgttatcgagccgtggatgatggagcgtgtggtggacggcgacgattacatgctgtacgccttgctcaacggcggagctccatacctgattcgcgatgccgcatacatcggcgttgacggcgacatggacgacgaacagcgcgctcgcacggaaaacgacatcgaacgctgccatacggtcgctgcattccatgagcgggtcggcatgcaggaactggttcgtcacgagttcgtggatgatgatccgctggtgcagcgttcggtattcgcggacggcactgcggtcacttgcgacttccatacgcaaacctatcgcatcaccgactgcccgcatcactgactgaaaatacaatgacacacagtgggttccgatggactggtggcaaattgccgccgataagcgagtaatatagccaacagtgtcaccgtcgaaacaggagtagtgaaatgccgaatcgtgcagaacgccgtgcccaagccaaagcaggccgcaggggagtgccgtcgcagtatgaccagacccgtggccgtggccgttcgggaatgattgacgaataccagctgcagcagaagtcacagcgtctgcaggacggcaccgacggcaccgaatggaagcccagcggcggtacgattgcggacaccgaaaccctgctgaccactaacccgaactacacgaatccgaagatgttcaaggcaccgcattcgctgcgtcagtggttccgtgtgggcagctggacgctgatcgccatcgcgattatcgcgttcttcgtggttatgtggctgccaagccatccgatgtggctgatcatcaccgtttccgcggtgttcattgtgggtgtgctgagcctgttctttacggctggcgattccaagcataatccgaatttggatcagaacggcacggccgtctgatttttttgcctggtaaatccggcttgaaaagcaaaacgcacgacggaagttgtgcgttttcttgtatgcggtgccctaaagtaagaagtgcttgagtttctttctgacgcacgaaggagaggcagtccgatgaaagttgatattctaacccgcgaatacccgccgcatgtctatggtggggccggtgtacacgccgaggaactgtccaaggtgcttgccgagcgcatcgacgtaaccgttcgtgcgtttgatggcaagcgcaccgaggcggacattcctgctatcccgaatgctgccgatgctaagggcagcttgaaggtcgtcggctatgacacgccttctgagctggctgatgccaaccccgcattgaagaccttcggcgttgatttgcagatcgccaatgatgtggacgccgacatcatccacgcgcacacctggtatgcctgcttggcgggctacatggccaagatgctgcacggcactccattggttattaccgcgcactctctggagccgttccgcccgtggaagcgtgagcagctcggcggcggctacaatctgagctcctgggctgagaaggatgcttacgagcacgccgatcgtgtgatcgccgtgtccggtggcatgcgcaaggatattctgactgcttacccgaacctcgatccgaacaaggtggttgtggtgtacaacggcatcaccatggccgacttcgctaccccggcaccagacgatccgggttggaaggtgttcgagcgttaccacatcgaccgttcgaagcccaccctgctgttcgtgggccgtatcacccgccagaagggcctgccatacctgctcaaggcactgcacctgatttccaaggacattcaggtggtgctgtgcgcgggagcgcctgacaccccggaaatcgccgaagaggtcaagatcgcgttcgccaagctggatgaggaacgcggcaacatcgtctggattgaagaaatgctgccgaagcctgagctgaatgctttggaacacggctgtgatgccttcatctgcccgagcatctacgagccgctgggcatcgtgaaccttgaggccatggcctgcggtctgccggtcgtcgcatccgccaccggcggtattccggaagtcgtggtcgacggcgaaaccggctatctggttccgatcgaccagttgcacgacggcaccggcactcccaccgatccggacaagtttgtacacgatatggccgccgctatcgacaaaatcatggctgaccccgaactcgccaagaagatgggccaggccggctacgaacgcgcccgcgacgtgttcagctgggagaccatcgccgacaagaccgtggaagtctaccagtccgtgctcgacgagcagaagaagtaagtagcgctgcaacgagtgcccccctcagtccggctgcgccggccagctcccctcaggtaccggtttcttggctcccctctttgaggggagctgttaccgcaggtgactgaggggagtcgtcagaccgcgaatcataggtagtatttcactcatgaccaacaccgtcctccaactcgacaacgtcgaattccggcgcaaccgtcgtgtcatcatcaccgacgtgaacctcaccatcaacgcgggggagcgttgggtgctgttcggtccgaacggcatcggcaaatccaccgcggtcggcatgctggccacccgcaccttcccctcagagggccgcgtattcatcctcggccatcaactcggcaaatacgacgtattcaaactgcgcacccgcatcggtctcgcctcggccgacctgggccggcagttccccgagttcgaggacccgctggacgccgtggtcaccggcctgtccgccgtgaccgggcgctggcgcgacacctacacgcaagaggaatacgcccgcgcccgccagctgctgcgcgattttcacgtctcctatctggaaggcaaggagatgtggcgactgtccgaaggcgaacgcacccgcgtgttgatcgcccgtgcgctgatgggagatcctgagctgctcatcatggatgagccgaccaccggccttgacctgggcggccgcgagcaggtgatgcgcacattgagccgaatcggcgaagagaactccgagcgtgccgtggtgctggtcacccatcgcttggaggagattccggctggtttcgaccacatcgccattatgggacgcaagccgattcctgctgaggatgccaccgaagcgggcgtggattcaatgggtaatcccggtgctggcaccatcgtctacaccggttcgttggagaatggcctgaccgacgaacgcttgtcggaattgttcggtatgcccatcgaagtccagcacacccacggccgctgggccgcctacgccgtgtgatgcttgtaggtttttaggcgggattttcttcgccccctctggaggagctgtcagcgtaagctgactgggggaggtccaaccagttacgaaggtaaccatgacaaccaatagcaaactcgtattcatcgatatcgacggcaccctagccgacgaaaaccacgtcgtacccgaatctgccaaaatcgcttgcaaacaagcccaggccaacggccacaagctcttcatctgcaccgggcgttccgtgccgaaaatcgaacgcagcatcctcgacctcggtttcgatggcgtggtttccgtggcgggcgctcaggcgaatatcggagacaggctgctgttccagcatctcgtccctcctgaagcggtcgatgcggcgatggcgtattttgccaagcatcatatcgagagctaccaatggcaaggtgcggatggcatgtacatctcggaaggctaccgtcaacatctggaatcgaaaggcaagacctggaatcgtggcgaattcgcgcgattctggcacctgttggatgaggtggaggtgccggctggctcgactttgggacagacgattcgtgtgagcaaggggtcatacttcacctcgccgaatcctgacgtgactttcgaggagactcaacatgatttgagcccatggtttgagctcgtgcatggttcatatgacaagatttccccgaacaatggcgagttgctgattaatggcatcgacaaaggtaccgctgtgcgcgacgtggcttctttgctgggctatgccattgccgacaccatcgccatcggagactccgacaacgacaccgccatgctcaaggccgccggcacatccgtagccatgggcaacgccattcacggcatccaagccttctgtgacttcaccaccaccgacattcacgaggacggcctggccaacgccttcaaaacgttgggactggtgtgaggctatgtcgtttgctctcagacggaggaccctttcgtgctgtagtattgcgacgcggcacaacgtatgctgcgccgagcatagagaattatgaattcaaaatggtttgttcatcatgcgaagatagtggtcatctgtccgtcgcggttgcgcaatttacggtggcggaggaaccggaacggaatctggagatcatcgacggattcgcgcgtgatgcggcggcgggcgatagggaagccgatctcattactgctgagctgagtcgtgagtgtcttgattccgcgcgtcgaacattgccggtgttgcagaatcgccgttttgccgatccgcagttgtgtgactgacctctgaataactttactagcgctgttgataagggttctatgatgggaatcatgaccactactgttgatagctctgattcaatgccggaacgtctgcaagaggggagcgtggcgcccgatttcactctgccggcggttatacctgggtttacagagagcggatcaatcaacctgtctgacgtgcttgatgccggccgcagggttgtactgtacttctacccggccgcgatgacgcccggttgcaccaccgaggcctgcgatttccgcgacaatctcgcccgattggcgtcgaagaatgtcacagtgctcggtgtctccaaggactcgcgtgacaaactgcgcaagtttgcacagcgcgatcatctcacgttcccgttgctgtctgatcccgacctgaccgtgcacaagctgtacggcgcatacggcgaaaagaagctctacggcaaggtgcacgtaggcgtgatccgctcgacgctcgtcatcaatcccgatggttccgtggcgattgcgcgctacaacgtgcgtgccaaaggacatgtcgattcgctattaaaggcactggaaaagttggagaagctggagaagtagcgcgttctcgttgttcggacacagtggttcgtgcatagcagttccgtgcggtacgtgccgtatgaaccactgccgcatgagccaccggttgacttctcggactcaccggcaaatagtgagaccgtgggcgcgcagtacgtctatggctggcatgtaatcgagcgatgttgcggtgggattgagcatcagttcgcggatggcggcggatgctgaggactcgctcgtcttcgaggattctgcggccgggaagagagcgtcggcgattagggagatgatacgggaacgtgcatcgccggcattggcattgttgctgctgctgccggcgtcggtagtggcggagttgccaatagtagcggagctgttttgtagagtcgtatccaacgctgtgacaagcggctccaggttgttctttgtcgcctcggcaatgtcatcgagctgatcgaataaggcgaacagccatgcacgacttcgctcctcatcgttgccggtcgcaagcctttcattggtgacgcgcacgagttcgtcaatcggtactgctggcgtctttgccggatcgcgatgctcacggttgtcttcgatatcgcccataagatgctggatttcgcactcgtcctgcaatacggtggtctcggcaaatgcggtggcgatggcgtccgcatcgatgaacttgccaccttcggactggaagcgcacgcgcttgggctcactgtaataatgcgacatgccgaatgtgatgtactgaggcatctcatcctgcaattgcttgaccgcttcggccaccttgcgcatatctgccagatgttggtgcatcacgatgaaagcgagcactgctttggtgtcggtaagagtgagcggctgaccgatgctggctccatgatggtgctcatgatgcgcaaacatgttcttcagcgaatcaaacaatcccataatgtcctccttcggactggggcacagtagcttcatatctgtcgcttactgtagtcccgaatatgtgggaatggtccatggaacgccgaaggtgaatgctggttccgggcgatgctcgcagcaattgaaaatatcgcaggacatgacaaaaagcgggtgacaagcgttatcctgaaatacatagggcaaggaggccgtatgacagcagaagtggatgacggtttctttcaattgtttgaacgcaggatttttgtgcgtggagaagcttattacgatgccggcaaggttgatccgccggtcatgattgctgagaatctttggcataccgtggttcgcgggaatgacgactatcaagtggacattcgtttgcgccatggcaaagtgatttctgccgcctgcacatgccaatattcccaacgtgcaacgtactgcaagcatgtggctgcggtgcttatcttcatgcgtgagagccgacgtcgggaattagatgaatcgcaagaccaagtttcagagtttcctcatgaagcattgaattgtgtgagatggtatacgatgtatgaattcccgaaatatcgcggattgacagagggagattggcatgctgtcaagcgaatatttgaggtgttgtactgtatccccgaccttgatactacatatacacatgaggtaatggataccgtttggtgacatccatctcgtaggtaaacagttcgctgtggccaagacgctgagtctcagggatattctcgtccgcaccgagtcccactgcaatcacacgccaaccccgcacagcgagcatccgcgcagtcgccttgccgatgccgctcgtgccgccggtggtgaccaatgccaccggccgtccgtcatccttgattggttccatgtgtaccattatcgcgtggtggtgtcggaatcacggcatggtgatagcagccgcatggaacaagctacttgctaggcgaggcttgagcgtcgtcatccgtcttgcgagcattcagatgccggtgctcgtattcctcgaagtcatcacggacggctgccgcgggatacttgctcttggtctttgcgagcttgcccatgacgatgtcatccatatccacaccaagcgcatcggccatcatgatgcaatacgtaagcacatccgctagttcttccctgacatgtccctcatccacggatggcgactgcggcgtccactggtagcattccagcaattccgacgcctcgatgctgatggacttcgccaggttctcaggagtgtggtattggccccagccacgctccgccacaaaatcacgaatcgactgaatggtactgtcactgatcatgactgacattctaggacttgctgaatgttggtcatgtaccagagctcatgatggaccataatatgactatgaacagtgagagcttggcgccgtttgtcatcaacctgccatatggccaatacagtagggaagcttttgaaaaggcttttgacgaatccctcgagaagcagatggggcgcagtgttaatgattccgagctggaacatttcatgctgcgatatgtgttggcatatccaacggtttatgtcgtgtattcaggaaagaccaatcgctattcgatgaagaacgaatatacggtgtacgtcggtgagaccaacgatatacggcatcgtacattccagcatcttgaaagagatgctaaagaacgcgaggactggaaagctgtagctgatgctgtctcgcggaatgatgatgcatatcggcaatatgttatttcacatcccaaattcaataagtcgttaaccctggatgtcgaaaaccgtcttatgcactatatgtccagtaccgattcggtgaaaaggctcaacaatcgacggaccaatgcgcaaggcgattattacaccgcagaccagtttgatcggattttctcgcaaatctggttgagattacacaaggaagattctgacctgttcccggcggaggagatcatccgagattccgcgttgttcaaggcatcgccttttcataaactcagcgatagccagctcgaagccgaagaatctattttggtgcaacttgccgccttggttgccgatagccggcaacagaagaaagccgatgagcaatctttagaccgccatccgaaattaatctttgttcaaggcgctgcaggtacaggcaaaacggtcctgttaagccacctgttctacagaatcgcggctgaaatcggcatccaaggcgacacctattccgaagacgaagattatcctgagctgccacgaacggcgaatggccggctttcctcatacattcttgtcaatcataaggaacaggtgcacgtatataatcagattgccacgaaactgggtttgcagaaggaatctggtgaagtggtcatgctgcccagtcagttcatcaatcgattcagcttacgcaacgagcatggtcgaggcattccagaccagccgcaaggcctggcggacatcgtgctcatcgacgaggcccatttgttgatgacacaaggaaatcaggggtattccgggaagaaccatctgtatgacattctgcgcagagcccgggtggtgattgcggtctttgatcacaatcagattatgcagtccagccagcagtgggacccagcggtgctggaaaaacttcagctggactctgattcgactcagaccgcatgcgcgaccgggaaaatcggcgcattcaaagcggttgatttgggcgccgaatatcatctgccgtccatttccgtggacgttgcgcatgtccatttgaaaaagcaattccgtattgccgcgagtaagtcgatgattcagtggattgaccgattcgcttcggggaaaggtatcggtcctttgcccgttgatacgggcgagtatgccgcagatggtgaagtgattcgagaaccttatgacgttaaggtgttcgactcgccggttgatttgtttaatgccattcacgcgaaggcccagctgaagcccgatggttgggatggggctggactgtcccgtttgttggccacctatgactggaagtattcggcgaaatctgagaatcagaatgatccgcatggcttttggaatgtggaactgcatcgcgatacttccggcgtatggcgtatgggacttgcggatgaccatggattcgatcattccgcaataagttctgaccaattctgcaagccttggaacaatcagctcgaagattccgctccgaagagcaggaaaggcatcgacaaagaactggcttgggcggagaagccgtacaccatagatgagattggctccatcttcaccatccaagggtttgatttgaactatgccggtgtgatcattggaccctcggcgacgtatcgtaacggggaaatcgtgttcgatgcaaaggccagccaaaactatctggcaaccaataagcgcaaagatttaggagattttgccgaagaaaacttgaagcatgagttgaatgtcctgctcaagcgcggcgtccacggtctgtaccttttcgcggtggacgaaggcctgcagcagcgtttgaaggagtgctgcatccattaaggtatgtgacggaattactgtgctgaaaatgcacgcgaagcgcacgcaaatgatgttgaatgcgctgaaaatgcactcaacatgccgggtgtcgtcgttcgctgaatatttgacttgctgagcacgttggttattctggttcggcactgttattgagttgtctggttattgttattcggcactgcggttattgcggttcggcactgtgcgggttaggctcctttcatccatgcgatggtcacgtggacgaaaggagtgccaacgatggtacgcaggatcaaggcgaagctcgtgcccgggcttcgtgaccaagggctgtcccggaacacgatagccatgggctacggcatgtcgaagcacagcgtgatcaatgtgttcgacgccgccgaccggctcggtgtctcctacggtggtgtggaggacaaaaaccgatgacgaggtgtatgccctgctgtttcccggcaggggtgcgatcgagagtgcccacgagcagcccgactgggcgcgcgtgcacggcgaattgggacgtgtgggcgtcacgttgaagcagttcggggcatccgggcgcaccgcctttgacggcgagggattcgatgagctcggccatcatgccccgtcccttgcgccggtcctcgtgcgtgtaacaggagatgatcttctggtacacgccgtgctgtattgcttcaatgtttgttgggcgggttcggcagtgtttttccgcagtgaaaaaaatcagtgacgaaacacgaaacaccgacttgactaaatacaccttgttgtgtgaactccacggggttcatgtatccgagggtcgagtggagccgctggtggttgtaccaccatacgtaccggttggcgtccgagcgcagtcgttccacgctcgtgtagacgttgtcgcatatgggttccttcttgacgagcctgttggtggattcgaccaccgcgtcgtcgtaggggctgccgggattcgacaggaaacgcgtgatgccgaacacgtcgagcattcgttcgatgcgttccccggtgaactcgccgccccggtcggtgtggagcacctcgatgtcgcctgacgggaagcgcagcatggcgaatgcggccggcacgagatccgcgtcgcgccgcgtcccgacggcgtggcccgcgatctcgcggttcgcgagctcgccgggcaggcatatgcacgcccatgaactgccgaccccccacgtaggccgggttggcggcgatgtgcgtgtgcgggggcgtagccatcgaattcgcggccgaggatgttcggggccggatcgtcgttcggttttg

SEQ ID NO: 22 - DNA, 117113 bp, Bifidobacterium longum
tacgcaggaatattcaattttcatcccgtccggagttacccgttcaggtgagctcctgcggctgggcttgaaccagcgaccgtccgattaacagtcggatgctctgccaactgagctacgcaggaatattcaattttcatcccgtccggagttacccgttcaggtgagctcctgcggctgggcttgaaccagcgaccgtccgattaacagtcggatgctctgccaactgagctacgcaggaatgtctgctgtgtttgagatttctctcgcgcacaagtcacatatcttacatgcctgccacgaaaaagcaaattacatgcgtgtagggcatgtcgcgctgaattccgcagaatcggactcatcggatactatctcatacagccaaaaaccgaacgcggatatacactagcgactaacggtagaggagctggtgtctgcttggcaaatactggaatcggtgaaacggaacaaccgtctgagtatgcgaacccagtgggaacaatcacaagagttctgatgttccgctgtcactgcatggcagcggttgtgacatggatcggccgcggctgaaggtcgaacaacatgacgatgcggcgatactgtcacgcgaaatttcattgtggataacttcggaagctagaaccacataggtcgttttggctggacatcctgtttcggacccctcaaggtgggtatcaccggcaaagaagccggaatcacatcacactcacactatggggaggaatctcatgaatgcaccactgttgtttgattggcgtcgcgacgaagcccgacgtgccagccggcggcgtcagcaggcgcgtcagcgggctcaggaacggcaacggcgtatggatgccataatcgcgttggccgccgttatcggcctgctgcttgccttgggagtagggctggcatccacgcctcagcatgttgcgcatgcggatactgtggtgaccggagatgcggcatacacggtggaggatttcaccgatatgtctgatttggcgtggcgcaatggcaatcagtgcgaatcccgattcgactggccggtcgacgatccacaggtcgaacaacagttcgagcggccgatcaacccgtgggcaccaggtcatcgtggagtggatcttgttgcggagcaaggtaccgtaattctgtcaccacaggcagggaccgtgagttttgctggcaaagtagctggcaaagatgtggtgagtgtacggcatcgtggaggtgtcacgtcgacattcgaaccggccgttaccgagctctcagtgggggatgcgatctcccgcagacagcccgtaggcatcgttgaaggtagctcggaccattgcgaagaccgttgcctgcattggggcctcaagcgaggaacggccgattatcttgatccacagcaatatgcggggagtcgaaaaatcgtactgaaaccgtcatgatttaacggtgattgtcggccggaacagggccgtacggaagagacatcgcaggcggctagcggcgtgacgagtatgaatcacagaccggcatcggccaaggaaatatatccggggtcggtcagcgcggacttgagattgctggcgctgacagccagcaacggttcgctgatggtcgggatcttcttcacgccgcctacctcggagttcctgattgaaggcatggaattcagcgcttcgtccttgttgagcttggcgcaggcctgagcgatatccgtggcgatggtctgtctgtcttccatgccggtcatccattgcttgccattgacgatggatgggatgttcgagacatacgcgccgtatccggttactagaggccactgcgagtcacggtccttgtcggaagcggaggtgtcctcgtccgcatcgtcatcggaactggatgagtcgtttgcgttgtcgttttcaggggatttgatcgggtccggcacggcgtcacggctgagatccttcttgccggtgatattgccgacaatgcccgagatggtgatctgcggattgatatcggcggcagagccggtgtatcccagatcgtccaattccttgacgacctcggaggcgatgtagtcgttcatcgtgatgatgccgtcaatacgggtgagtgtggactgtccgtcggtttttgccagacgcttgtcaagcactttcgcagtggagccttcctcagcggcatcgtaggccacggcttgccaatcgttttccgtggatttgccgtccaaggtgcctgaagggctttccacaacgcccttctgatagtaggagcccagtacctgccagataccacggaacgcctcttgggcgaacgcggaatcgttggcgttgcctttttcgtccacggcggtgtatggcagcagcacctcaatgtatttggggttgtctttactggccttatccaacttgagtttggacaccatcttttccgcctgtagcttgccgatggtctgggcgtccgagaacttgacgaaggcgtccggcttatatccctcgatactgttgccgagcaataccacatgcatgccggactccttggccagtttgagcgatgagaccagccggtccacggcctgcgcctgctcgtccgatgcagtgctgtcgctctcagtgttggacgaatcgtctttggacgagtcgtctttggaagattcaccgtcagaagtagctccctcatccgtggcatcgttggtgctcaggttctggctgatgtaatcgccgtattggcgagtggaagcgtcggcctcgactactggagccacgagcaatgtcatgttgtcgggcgcgatggcaatgccggaatcgtccgtggtgttattcgaaagatgatcgaccacaaagtcttggatggcgcggctttgcttggccaacgagtcggacgtcgtatgatcgatatcgcctttcttgaaaccggcgtcggccagagccttggctaggtcaggcaccagcttcgcccacttgttcagtggcgtctgctggttcagcgtaatgccgtccgaaggtgtgaacacggccacgccgccggcagaattggacgtcaccgtggtttgaccatctacaacggtcttattgtctgaggtgcacgcggtcagtgacagcaccatcgcgcaggatgcgataatggcggcgagcagggtggttgagcggcgtgcgaacaccataagcggcgaaacctcctcaagcgggcgtgaaaacaagctgaatcacgattctagtaggccgtatacgaaaaagtcccggaccagtggacaaatcgccacatatccgggaacaattagaggtattacgtgcgtgcatcgaacaactgtcatgattatcgtgctgaggaacattccagatgaagcacgacaatcatgacagtttgcgacatgacatgacccatgtaggtccgcacgatgtgttcgatgatttactcggccagagccttggccaggttctcgtccagcgcgttcatgaagccgtcggtgtcgagccacggttcgtccgggccgatgagcatggccagatccttggtcatctgaccgccttcaacggtgtcgacgatgaccttctccagcgtcttggcgaagtgacggacttcgggcgtgccgtccagatcggcgcggtgcttaaggccgccggtccacgcgaagatggaggcgatcgggttggtggaggtcttctcgcccttctgccagcggcggtagtgacgggtcacggtgccgtgcgccgcttcggcctcgacggtctggccgtccggggtcatgagcacggaggtcatgaggcccagcgaaccgaagccctgggccacggagtcggactgcacatcgccatcgtagttcttgcaggcccagatgtaaccgccgtgccacttcagggagctggccaccatgtcgtcgatcaggcggtgctcgtaagtcaggccggcctcggcgtacttgtccttgtattcggtctcgaacacctcggcaaagatgtccttgaactggccgtcgtaggccttcaaaatcgtgttcttggtggacaagtacaccgggtaatgacgcatcaggccgtagttgaagcaggcgcgagcgaaaccgcggatcgaatcgttgacgttgtactgcacctgggccacgccgccgtcttcgccgtagttgtagaccacgtgctgaatcggctcggagccatcgtccggagtgaaggtgacggtcagctggccggctcccggaaccttgaaatcggtggccttgtactggtcgccgaatgcgtgacgggctacgacgatcggcttggtccagccgggcaccagacgaggcacgttgctcatcacaatcggctcgcggaagatcgtgccgcccaggatgttgcggatggtgccgttgggggacttccacatcttcttgagaccgaattccttgactcgggcctcatcgggggtgatggtggcgcacttgacaccgacatggtgcttctggatggcgtgggcggcgtcgatggtcacctggtcatcggtctcgtcgcggtgctcgatgcccagatcgtagtagtcgaggttcacgtcgaggtacggcaggatcagacgatccttgatgtccttccagatcacgcgggtcatctcgtcgccgtcgagttcgacgacagtgccttcgaccttgattttggccatgcttcctcctgatagatggtgtgaagatgatttagtcatagcgcatgtttgtaacgacttgaagcaatcgtccggtccgtgggaaacggccttgttggcgtcccacccgggcaataggctggaaaccatgtctcaggaaattgaaatcggtttgggcaaaaaaggccgtctcggctacgcactcgacgatgtggcgatcgtcccctcccgtcgcacccgcgaccccgaggacgtctccacctcttggcagatcgacgcctatgagttcgatgtgccggtgatcggcgcccccatggattcggtgaccagcccggccaccgccatcgccatgggcaagatgggtgcgctcggcgtgctcgatctggaaggtctgtggacccgttacgaggatccgaccccgctgttggacgaaatcgccggactgccggccgatcaggccaccgagcgtatccagcagatctatgccgagccggtcaagccggagctcatcacgcaacgtctgcacgagattcgcgccgccggtgtcaccgtggccggcgcgctctccccgcagcgcacccagcagttctactccaccgtggtggacgcgggcgtggacctgttcgtgatccgcggcactgtggtctccgccgagcacgtctcctccggccaggaaccgctgaacctcaagaagttcatctacgaccttgacgtgcctgtcatcgtcggcggcgcatccaactacaccgctgccctgcacctgatgcgcaccggcgcggccggcgtgctcgtcggcttcggcggcggcgcggtctccgccacccgccagaccatcggcgtgcaggccccgatggccaccgccatcgccgacgtggccgaggcccgccgcgactacatggacgaatccggcggccgctacgtgcaggtcatcgccgacggcggcatgggcgactccggcagcttcgtcaaggccctggccctcggcgccgacgcggtcatgctcggcgcgccgctggcccgcgccaccgaggcccccggcaagggcacccactggggttccgaagcccgccaccagacgctgccgcgtggctaccgcaccacggtcggcacggtcggcccgctcgaacaggtgctgttcggaccgagccaccaggcggacggcaagaccaacttcatcggcgccctcaagcgcgcgatggcctccaccggctacgtcgacgtgaagaacttccagcgttgcggcatggtggtcaacccgtattccgcacgataatcccgattgccccctgaaaatggggggtttgccctccatgcaggaggcttaacttgcccgaaggcgcgctcaagtagtttgacttggcgcgcctttcgtgatgttgtagtacagacgctcgccgatgatggtgagttgcaagggggcttgaagggggtcatcatggagtattcgggatttttccacggcacatatcagtacgggccgttgccgagttatgacggattcatcgttgtggagctgtcggatcgcccggtgcggtatcacatccaacccacattcataggcgggctgaatgcgaaggaatgtcattccatggccatggctgcatgccgcatcgcctgcacatcggcggacgcgatacgtggcaaactcagcgtcgcacatctcaacagagccatgacaaaaccatgcctggaccggctgcaaaccatgcaatacctgctcggcacccacatggtcactcatccggagctcaaagcgaaattctgctatctgcccactgtccccacattgatcgacggcatgatcaccggcaaggacacgctggaaatggcggtattcatgaccatcggccaggaaaatctgcgagtcaacctcaaactgaagtacatcggttctcgatggatgtgcatctatgccgatttgggctgaccagacggccccgcccgcacaccgattcctacgctggtagcggaagacggttctgccgtgtcataggctggttcgcctatagtagtgaccatgcgtgaacatgtagaagaacccagatatgtcaccaccgatgacgacaccgtctactcgctgctgtccaaacgagcagctcgcacgccggatgacatcatcgcggaatggcaggatgacaacacccaccaatggcgcagcgccacagctactgaaatgctgtcccgcgtacgcgaggtggccaagggcctgttgggacttggcgtcaaagccggcaccatggtgctgatttactcgcctacctgctatgagtggggtgtggctgatttcgcttgcgcggcaatcggcgctgtggttgtgcccgtctatgagaccgattccgcccgtcagaccgcgggcatcgtcgaggaagtcgatcccgccatcgcctttgccggcgacttccagcgcgcacagacgcttgagcagatccgtgtcaatcatccgggcatgaaatacgtgttcaatttcaaggccgatggccttgacgctgtcgctgacttcgggcatggcgtatccgatgagacgttggatgcggctatcgctcgtatcaaagccgatgatctgctcaccgtggtctacacctccggttccaccggcaagcccaagggcgcgatgctctccaaccgcaattacacgcacatcgtgcttaacggctacgagattctgcgtggcatgctgtacgacgacaaccgtctgctgctgttcctgccgctggcgcactgcttcgcccgctacatccagtacgtgtgcatcggtggctgcggcgtggtcggatacattcccgacgccaagcgactgctcgccgatatccgcagtttcaagcccacctacctgctgggcgtgccacgtgtgttcgagaaggtgtataacgcggcctcgcagaaggctggtgccggcatccaggggcatatcttcgcccagtcggtcaagcacttcgtcaagtggagcaaggatgagcaggccggtcgcggccattcgttcatcgagcgcatgcgccattcgttctacatggccacggtgggcaaatccattcgttccgctctcggaccgaacctcaaatggctggcctgcggtggtgcgccgctcaacgtggatttggcccactttttcaacggcatgaatgacatcaccttcatccagggttatggcatgaccgaaaccgccgctccgatgctcgtcaattgggaggacgacaacgaggtcggttcggtcggcaagcctgggcctggcatgggcgtgcgtcttggcgaagacgatgaaattgagctgaccggcccgaacgtgttccttggctactacaagcagcccgaactcactgcacagacgatgactgccgacggctggatcaaaaccggcgatctgggtcgtatcgacgaccgcggcttcaccttcattaccggacgcaagaaggacatcatcatcaccgccggcggcaagaacatcagccccgccccgatggaggatgccatcgacacctgcccgatcgtggctcatgcagtagtagtcggcgacggcaagccgttcgtgtccgcacttatcgagctcgaccccgaaatgctgcattcctggctggaaggtcagggcctcaatgccgacatgacactcgccgaggccagcgacaacgacgcggtgcgcgcctttatccagcagtacatcgaccaggccaacgccaatgtctcccgcgctgagtccgtgcgcaaattcgcggtgctggatgaggaattcagtcaggagcacggcacactcaccctgagcatgaaagtggtgcgtcccaaggtattgcagcgctacgccaccgtcatcgaagaggatctgtacgcgcccaagccatccaacaagccgctgcccgccactgccaagatcatcgacagcacgctggagaccgtcaagaaatcctccgaatcggtcaagcaggcgtccgaacaggtcaaacaggcctcggaacagatgaaaaccagcgtgtctgattcgattgctagcgtgtcggagaagatcaagaagtcgaaggccgaacccgaagagggcgagaccggcgattccgccgacaatgccgctgacaccggcagcaagccggaccagccggctgacgagaagaatgaggagtaacgagaagtggccatccgtgagatcagggtcgtgcccgacccagtcctgcgcaccccctgcgatgagatcaaggaaatcaccccggccgtgcgccgcctggttgacgacctgttggaaaccgtggacgatccgggccgagcgggcctgtccgccaaccagatcggcgtgagcctgagggccttctcctacaacatcgacggcaaggtcggctacgttctgaaccccgtactcgaggagaagtccggcgagcagtatggcgatgaaggctgtctgtccgtgcccggcttgtggtacaagacccgtcgtgccgactacgctcgcgtgcgtggcatcgacttggacggcaacgaggtcgtgctcgagggctccgggctgatgggccgtatgcttcagcacgaatgcgaccacctcgacggccacgtgtatttggatcgcctggaaaaggaagaacgccgcgaagccctgcgctacatgcgcaatcgtcaggcgaagtagtccatactcggctcccactggctggagccgtcgaacgtagtgagactgagggtggttctgccggtaccgcccgtgactcccctcagtcgcctacggcgacagctcccctcagagaggggagcctgtttttttttagtaccggctccgtgctattctcgaaactcgtgtgccacccggcaacggacgcagtcgctggtgtccagagccacccaatattgtcaaccggcacacaacaaattcgcgtcatgctcgcgacggcttgtgtcggtcggctgcacaactcgtgaaaccgggggagcagctgcacgcaggtgcgcatggccaggcaagaaccgacaatgaaaggtagtaataccatggctcagatcactatgagcgatatgctgaaggctggcctgcacttcggccaccagacccgtcgttggaacccgaagatgaagcagttcatcctcacccagcgcaacggcatccacatcatcaacctgttcaagtcgctcgacatgatcgacaaggcgtacgacttcatcaagaccaccgtggcccacaacggcaccgtgctcttcgtcggcaccaagaagcaggctcaggaagctatcgccaaccaggccacccgcgtgaacatgccctacgtctccgagcgttggctcggcggcatgctgaccaacttccagaccgtctccaagcgcgtcaaccgcctcaaggaacttgaggaaatggacttcaccgacgtgcacggctccggcctgaccaagaaggagctcctcctgctcgagcgcgagaaggacaagctcaacaagcagctgggcggtatccgcaacatgaaccgcaccccgtccgcgatgttcgtcgtcgacatcaccaaggaagccctggctgttgaggaagctcacaagctgggtatcccggttgtcgccatcgtcgacaccaacgccgacccggacaccgttgagtacccgatcccggccaacgatgacgccatccgcggcatcgaactgctgaccagcctgatggctgacgccgtcgccgaaggtctgctggagcgctccggcgccaacaaggccgagggtgaagccgccgagcagccgatggccgcttgggagaaggaactcctgaccaacgaggctcctgccgaggcttccgctgaagccgccgctccggctgccgccgagggcgaaaccgccgaggcccccaaggccgagtgatgctctacgatgggaagtgcctgaatgagcgcttcccatcgttcatgggtaagcaaaatttctcaaggagaataatcaatggcagcaattaccgccgcactgatcaagcaggttcgtgaagacaccggcgccggcatgctcgacgtcaagaaggctctgaccgaagccgaaggcgacgtcgcccgcgccaaggaaatcatccgcgccaagggtatcgccgcagccggcaagcgtgaaggccgcaaggctcaggaaggcaccatcgcctccaaggtcgtcgagaccgccaatggcgagaccggctacgccgtcgagctgaactccgagaccgacttcgtggccaagaccccgaagttcgtcgagttcaccgaggaagttctcggctacgccgtggacgccgacgccaactccgctgacgagctgctcgaggccaaggctggcgacaccaccgtcaagctggctgtcgaagaggccgccgccctgttcggtgagcacgtcaaggtcggccagttcgccaagatctccggcgagcacgtcgaagtctacgctcacaagaagtccgccgagatgccgccgagcatcgtcgccatgatcgccaccgacaaggccggcgccgccgtggctcacgaagctgctctgcagatctccgccatgggcgccaagtggctgacccgcgaggacgttccggccgatgtggtcgagtccgagcgtcgcgtggccaccgagaagtccctggccgagggcaagccggagaagatcgttccgaagatcgtcgaaggccgtctcaacgctttcttcaaggaagtcgtgctgcttgagcagccgttcgtcaaggacccgtccaagaccgtcggcgacctgttcaaggaagtcggtggcaacgccaccgcattcgctcgtgtcgaggtcggcaagggcgaagaggagtgagcctaaggcttactccacgcgcttagcgtaatttcaacgaaacgccatccggttattcaataatcggatggcgtttcgctattccaagggtgtcgttgctagggggtgtcgtcgtaaaccgatacgcttgtctaaggataatttcgcactttcggttttgagaaaggcacaatatgactgatagcgacaatccgcgcagagttctgctcaagctgtccggcgaagcattcggtggtggcaaggtcggcatcgatacccaggtgattcgtcgcattgccgaggagatcgttccggccgtacaacagggtgtgcaggtggccatcgtggtcggcggcggcaacttcttccgcggtgccgaactgcagcaggccggtatcgatcgttcccgtggcgactacatgggtatgctcggcacggtgatgaactgcctcgctctacaggactttctggagcaggaggggcaggccacccgcgtgcagaccgccatcaccatgggacaggtcgccgagccgtatattccgctcaaggccatccgtcaccttgaaaagggtcgcgtggtgattttcggcgccggtgccggcatgccgtacttctccaccgacacggtttccatccagcgttccctcgaaatccactgcgacgaggtacttatgggtaagaacggcgtcgacggcgtctacaccgccgacccgcgcaaggacgagaacgccaagcgttttgaaaccctgagctacaatcgcgccctcgtggacaatctggccgtcatggacgcctccgcactgtccatggcccgcgacaacaagaagcgcatccgcgtcttcggcctcgaagagccgggcaacgtgacccgcgccctcgtcggcgatgaaatcggcacgctggtctccaccgccgaatcgcgcgtggccgagtaagccgcaaacgcccacaatcgaatcaagcgttcatagacgaacaacactgacgaacaccaacacacaaggagtgaatatgtctcttatcgaccaggccaaggaacagatggccaagaccgtggaaaacaccaaggaaaacttctccggcatccgcaccggtcgcgcaaacccggccctgctcaacggcatcaccgtggactactatggtgcccccaccccgattaaggccgtcgcctccatcggcgttcccgaaccgcgcaccctgtccgtcaccccgtttgacgcttcccaggccggtgccgtcgaaaaggccctgcgcaactccgatctcggcatcagcccgaaccgtgatggcaacgtcatccgtctgaccatgccggaactcaccgaggatcgtcgtaaggaatacgtcaagctcgccaagggcaaggccgaggatggcaaggtcgccgtgcgcaacattcgccgtaagaccaaggaaaccatcgacaaggccgtcaaggacggcgagatgggtgaggacgaaggcgatcgcctgctgaaggatcttgacaaggtcaccaagtccgttaccgacgagatcgatactctgctggagaccaagcagaaggagatcatggaggtctgattcagaccaggtccggagaattatggaacgcaacgaacaaccccatgaagaggccgaggagacgctcgaccagatcaacaagaagaccggccgcaacatgccgcaggccatcgccacaggcgcggcactggtcatccttattgtcgcgtgcctgctgctcagcgtcgacctcttcgtgctgctggtagtcgtgttcatgattctggcgctgtgggagctcagggtggacttcgccaccgtgggcctgcacctcccggtgtttatgctgtggctgtgctcgtccttcaccctcattgccacctactattccccgtaccatctcatcacgatgtcgctgagtatcatcgtgtcgattattctggtcgccatcgcggccagcgtaaaaatcagcgtcggcaaccgcctatctctggcggttgccggcaaactgtccaacacggatgccagcgcgcgcctcgaatcctcgtttaatcatgagggcggggaacagcatcattcccggctcagccatgtggctgtgtccgtgcttaccgtgttgtatattccgttgttggccagctgcgtcatcatctcactgacttttaatgggcatccgattgcacacgccatcatgctggtgttcctacccgccctatccgatacgggcggtttgtttgccggtgcctggctcggcaaacacaagctcagcccgcgcatctcgccgaagaagtccgttgagggccttgtcggctcgatgctcttcgccatggctggcgcatttgccgtattcgcatgcacgtatgatgcctcgaaatgggccactcgttggtgggtgccgatcgtggcgggtattctcatcggtgccgtgggcacgttcggtgatttgtgtgcttccatgctcaagcgcgatatcggtatcaaagacatgggccatctgctcaaggggcacggcggtgtgatggatcgtgtggattccattttgatgagtgcaccgttcacctgcgccttgctgtggatcaccggactgtgattcgcatgtctcgtgcatgaacaatgtggcatcgtgtgtatatcgcacggtgccacatgccatatatggggaaatcatcgttcaatatgcgttcgctatgggctaagacatgggccatctgattcgtatgcggcacgccgtatggtggattctgatattactattgcatgtttgactattttctgatattgagagcgaagcgaacccatcatgaccacacagcatcctgacactccggaaaccggcattactcccggcggcacatcaggtgccttccgtgacgtgctatccaaggaccatgcccgccgtggtaagccgccgctgcactttgtggatatgacgcccgagcagcgcgtcgagaaagcggccgaactcggattgccgaagttccgagtcaagcagctcgccaaccattactttggccatttcgatgtgaatgccgccgaattcactgattttccggcagccaagcgcagcgaggccgccgccgcgtttttcccgcagctcatcaccgaggtgacccgccaagtggcggacgaaggcaccaccatcaagaccttgtggaagctgttcgacggctccctcatcgaatcggtgcttatgcgatacccgacccgcaccacgctgtgcatctcctcgcaggtcggctgcggcatgggctgcccgttctgcgccaccggcaagcttggcctgacccgtaacatgtccaccggtgaaataatcgaacaggtgcgtgtggccgccaagatgatgcgcgacggcgaagtggccgggggagagggccgcctgagcaacatcgtgttcatgggcatgggcgagccgatgggcaactacaactccgtgctgtccgccgtacgacagatttccgccatgcctcccgaaggcttcggcatttccgcgcgcaacatcaccgtatccacggtgggcgtggtccccggcatcaagaagctcactgccgaaggcattcccgtgcgtctggccgtttccctgcatgcccccagcgacgaactgcgtgacgagctggtgccgatgaacaagcgtttcaataccaagcaggtgttggatgccgcgcacgattattggctggcctccaagcgccgcgtcagtatcgaatacgcgttgatgcgcggcatcaacgaccaggccgagcatgcgcagttgctggccaagaggcttaaccattacggcgacaactgggcccacgtcaacccgattccgctcaaccccatcgagggctcgaagtggaccgcctccaagccggaagacgaacagcggttcctggagatcctgcaccgagcgggcatcaccgccacactgcgtgacacccgcggtcaggatattgacggcgcctgcggccagctcgctgccaaggagcggtagctacttcagcgcatccttgattgcgcccacgaagtagtccagatcgtcgggcttgcgggacgtgatgagcttgaagccgttggcgtcgtccacgtgcagctgctcgtcgacgtaatggccgcccgcgttctcgatatcagcggcgatatagcggcagggcgcggcggtcttgccagtcaccagacccgcgttgaccagcgccgcgcgccatggcagatcgcggcgatcggcttaccttcgtgcgcgaactcctgcgccagcgtgatcgcatcctcattgacgcggatacgatccacattgcaggtgccgccgggcaccaccagcaggtcgtagtcggcagcctgcacgtcggacaggcgcgcgtccggggtcagcgtttcaccttcgtagcggtcgtgctgcaccgtctcacacgggtccaaggtagtggcggcaagcgtcaccttggcgccggcggccttgagatcgcgcagcgggcgcgtcagctcggtctcctcgataccccagttgttgacgatgatcagtaccgtgctgttttcgacagccatgccaatctccttgattcggcggacaacttccacgagccattctctcacgccgagcggctgccatgtcggtgctcaatatgatgattctcatattccagaaacaggtgcggcgcatgtaacgggcggtaggtagtctgaaggactgtaatgcaaagccgaacaggggagtgaagcatgtcgttggcggtacgagtcatcccgtgcctggacgttgacgccggtcgcgtggtgaagggtgtgcatttcgagaacctcaaggacgcgggtgacccggtggagctggcggccgaatactaccgtcagggagccgacgagatcaccttcctggatgtgaccgcatccagctcccaccgcaacacgatgattgacgtggtctcctgcaccgccgaacaggtgttcatcccaatgactgtgggcggcggcgtacgcacgcccgaggacgtcgactcgctgctgcgctgcggtgcagacaaggtcggtgtcaacacggcggccatcaacgacccgtcgcttatcagccgtgtggccgatcgtttcggcaaccaggtgctggtgctctccgtggatgcccgccgcgaaaagggtgagcagcatacgcagtccggttttgaggtcaccacgatgggcggccgcaaatccaccggtattgatgccatctggtgggtcaagcgcgccgagcagcttggcgccggcgagattctgcttaactcgatggacgccgacggcaccaaggaaggctttgacctcgagatgattcgcgccgtgcgcaaggaagtcaagattccgatcatcgcctccggcggtgccggcaaggtcgaggacttcccgcccgccatcgaagcaggtgccgacgcggtgctggctgcatccgtgttccattacggcatcctgactatcgccgatgtcaaggcggaactcaagaagcacggctacaccgttcgctaaacgaatacaccttgctcccgctgggcgaacaatccagtgaattgttcgtggcaatgcgctatgcgcacgtcgcacataatccgggagctgtcagcgaagctgactgagggtggtccacaaaaagaagataggtatgacagacactacatacgacaattccactgaactcgatccccgtattgccgcacgcctgaagcgtgacgccaaggggctggtcgccgccgtcatccagcagtacgacacacgcgaggtgctgatggtcggctacatgaacgacgaggcattacgccgtacgctgaccaccggccgcgtgaccttctggtcccggtcccgtcaggaatactggcgcaagggtgatacctccggccatgtgcaatacgtcaagggcgtgtccctggattgcgacggcgacgcactgctcgtcgaagtcgaccaagtcggtgccgcctgccacaccggcaagcgcagctgcttcctcgaaggcggccccctgcccgtggtcgaaggccatcgcccggccgatcagtagaacgggctttcctgactgggggaagccgagcgaccgcgtactatgaaacaagacatcgagttgtaagcaaaggagcgaatatgagcgaatgcagcgtcaaacacctgaagtggggcgccacctggcccagtcgcgaacagttccacgaactggccgacgccggataccgtgtgattccgattgtgcgccgtctgctcgccgactcgctcaccccggtcggcttctacgagcgtctcgccggcggccgatccggcaccttcatcctcgaatcggcggaatacggcggcacgtggagccgttacagttttatcggcgtcaactcgatggcccagctgcgctccaacaacggtcaggccgactggctgggcaaggtcccggtcggcgtgcccgtcaccggtgacgtagtcgaagtcgctcacgccacgttgaagactctgaaggccccgcatgtggaaggcctgccgaacctgaccagcggtctggtcggcacggtcggctgggatgccatccgccactgggaaccgaccctgcgcgccgaagctccggacgagaccggccagcctgagaccgtgcttgccctggccaccgatatcgccgtggtcgaccacgtatccggttcggtatggctcatcgccaatgcggtgaatgtggatgataaatccactcgcgccgacgctgcctacaacgaggccgtcgctcgactcgaccagatgcagcgcgatgccgccaccccggctccggacgagtctcgcgtcaacatcctggacgaaacggtcgcccaacccgagctgcgcttccgcaccgagaagagccactacgagcaggccgtcgaacgagccaagcagtacatcgtcgacggcgacgtgttccaggtggtcatctcccagcgcctcgacatcgattcgcctgctgacccgttcgacgtgtaccgtgtgttgcgcacgctgaacccgagcccgtacatgtatttcatggcgttgaccgacgctcagggccgcgacttcaacgtgatcggctccagcccggaaaccctcatcaaggtggacaacggccacgcgatgaccttcccgattgctggatcccgccctcgcggcgccacccctgaggaagacgagaaattcgccaaggagctgcttgccgatccgaaggaatgcagcgagcacatcatgctcgtcgacctgtctcgcaacgacctgagtaaggtgtgcgtgccgcagtccgtggaagtcgtgcagctcatggacatcaagcgtttcagccacatcatgcacatctgctcgacggtcaccggcaaggtcgacccctcgctgaccgcattcgatgtgttcaagtccgcgttcccggccggcacgctgtctggcgcgcctaagccgcgcgcagtcgaaatcatcgacgagttggaaccggccgaccgcggcatctacggcggcaccgtcggctacttcgatttctccggcaacatggacatggccatcgccatccgcaccgcgttcctgcgcgaccatgaggcgagcgtgcaggccggtgccggcattgtgctcgactccgtgcccgccaccgaatggcaggagacgcgcaacaaggccgaggccagcgtcgagtccatccagatcgccgcccagttgcgcgaactgtaacgttcaacgcatagcgatgcccccgctgacagaagttgtcggcgggggcatcgctgtctgtacgttagtgggtttcgcccatgatgtcggtggcgtcggtttcggtgctcacagcggcttcgatggcagcttcgataccgtgcgccatggtcgcgatcaccataccgggcgtcgcattcttcaccttgccgatcagttgcgcggctgcgtatggacgcatgagcgtcggctgagcccggtcggcatggtgttcgctatgatggacagtcggactttggtaagagacagtattcgtaacaggcaagtaggttattcatggctattgaggtgcagggacttgaaattcagatcggcgcgcgcacgctgcttcaccccaccaacttccatgtggccaagggagacaagatcggtctggtgggccgcaacggcgccggcaagaccacgctgacccgcgtgatcaccggcgacatgctgcccaccgccggcaaggtgcgcgtctccggcaagctcggctacctgccgcaggacacgcatgcctccgatcccacacagaccgcgctcgaccgcatgatgagcgcgcgcgacatcgccaccatcatcaaccgcatccgcaaggccgaaaaggatatgaccgacccggatccggacgtgatgagcaaggccatgacccggtacgacaaggccatgcaggacttcgacaaggccggcggctacgcggcccagtccgaggcgatttccatggccgcctcgctcggcctgccgcaggaggtcatggagcagcagctcggcacgctctccggtggccagcgccgccgcatcgagctggcgcgcatcctgttctccaatgccgacaccctgatcctcgacgagccgaccaaccacttggatgccgattccatcgaatggctgcgcggctacttgaagaagtacgagggcggcttcctggtcatctcccactccaccgaactgctggacgaagtggtgaacaaggtctggcatctggacgcgcagctcggccagatcgacatgtattcgcttggctggaaggcctacctgcaccagcgcgtggtggacgaggagcgccgccgccgcgaacgcgaagtggctgagaagaaggccgaccgtctcatgaagcaaggcattcgactgcacgccaaggccaccaaggccgtggcggcgcagaacatgatgcgccgtgccgaaaagctgctggaaaacacctccgaggcgcagaaggccgagaaggtggcggacatccgtttccccgagcccgcgccctgcggccgcacgccgatcatggccaaggatatttccaaggcctacggttccaacatcgtgttcgccggcgtgaacctggccatcgacaagggctcgcgtgtggtgatcctcggctacaacggtgccggcaagaccaccacgctgcgcctgctggcccacatcgaggagccggacaccggttccgtggaatacggtcacggctgcaagatcggctacttcgcgcaggagcacgacaccttggatctgaacgccaccgtgttggagaacctgcagcatgtggcgcccgagctcgataacacgcaggcccgttcgattctcggctcgttcctgttctccggtgacgacgcgatgaaaccggctcacgtgctttccggcggtgagaagacccgtctggctctggccacgctggtcacctcgcgagccaacgtgctgctgctcgacgagcccaccaacaacctcgaccccgcttcccgtgaggagattctgaaggccattgccaagtatgagggcgccatcgtgctcgtcacccacgatgagggcgccgtcgaggcgctcaaccccgagcgcgtgctcctcatgcccgacggcgacgaagacctctggaatgattcgtacctcgaactcgtagctgaagaatagtagtaaactcgtagccgaagaatagtagtaggagaggtctgccatgccaaccacaacaggtaagaaaatcgccatcgtcaccggcagcgcgctgggcctgggctacgagctcgccagccagctcatcgccaacggctggctggtggccggcgtcgacttcaatgccgaacgtcaggccgaactgaccgcgcagtggcccgatgactcctaccgcgccttcgtcggcgacatcaccgacgaagcgttcgtgaaagaatccgtggcggatatcgccacgctcggccacatcgatttgctcatcaacaacgccggccagccttcgttcaaggtgcccactgcctacgaggccgccgacgtcgacaaatgtctcaagggactcaaaggcatgattctgtggacggtggaaaccctcaaggcctgcggcgaacagaatgtgaaaatcgctcagattatgagtacggccgccacgcgcggcaacgcgaacgaaagcgtgtactgcgccaccaagtggggcgagaagggctataccaagagtctgcaggccgcatacaagggcaccagtgtcaaggtggtcgccgtctatccgggcggcattgataccgctttctaccgtgacagtcgcgactacgtctccgaggccaagcagcacaccttcatgcagcccggtccgctggccgaagtcatcctcttcaacctgatcaacgaggccaacctcaccgtcaccgacatcgagatcaaccgcaacagctgagcctgctagtctgagatttcagcgccttggtacatacttggtgccaaggcatttcgcgtgtggagagcgaatgcacatcagtgacgatgagtttgaacgggcaattgaacaggtgttggatgatttgcctgaacggtttgcgcgggtgctggagaatgtcggcatcgtcgttgcggacgaacccaatgagcgcgaactggctacaatgagcaatccgtgcggtgaactgctcggactgtatgagggcatacccgtcacgaagcgaactacgggctacagcggcgtgatgccggacgtcatcaccctgttcaaggggccgcatgaacgcgtatgctcaacgcaggccgagctgcgccaacggatccgcaaaaccgtgttgcacgagatcggccattttttcggcttcgatgacgagtatctgcactcgcacggctactgaagcgatgctagtttcactagcggggagccgccatactgccgtatgttgccaggtctactgcaagtggtgcaacgcacggatgatggcgcaacggtcctcgacggttccctcgttggcgcacatggtggcgtaccaacgcggattgcgcaaggtctcggtgccggtggcctcatccgtggcgacgagcgtgtgcagatcgttggcgtactggaaatgcaggtggctgagcagcccgccctcggcgaacgccttgcgcgaaggcagcggattgatggcaagcagccagcggaacgggctgtcttcggcggccggatcggtggtgtggaacacgaaggtgggggagccttcgagaccgtgctcgatgacatggtcgatggtgtattcgtaggtgtcgaggctggtgtcgtcctcggcgaaccattcgatggcgagcgcggcatcgtccgtggagccggattcggcggccggctcgttcacacgccagtagccgatatggatgatgttctccgggctggtggtggagcaagccatcgaccagaacgtcctgatgccgcgcgcggccatcggggccatcttcgggttggcgagcaccgcctgctcggcggcttcccaggtctgctggatggcggcgtcatccgaatcaatgtaatgctcgaagctttcccattcaccgagccagtcggtgatgtcgaaggccgtggaatccgtggtgttgctggcggtcattgcgcgttcctttcatgggtggatgtggtggcgaaattggtagaggcattagggttggggctgctggcatctgggttactggcatgcgagccgttgttcccggaatcgtcggcgccaagattgacaatgcggtcgcaccagccggcggcgagctcctcatcgtgggtgaccacgagaatcgccttgccttggctcgccagttgccgcagcagttcgccgacctgctccatgtggtagcggtcgagtccgctggtgggctcgtcaaggatgatgaggtccttgccgcacatcaatgccgagccgatggcaacccgctgcttctgcccgccggacaggctcatcggatgccgttcggcgaacgctgcaaggtcaagatcggccatgacctgattggcttgagcggtgatgccggcatccgtctcgtcgagtccgatgagcagttcctcgcgcacgctgtcggagaacagttggtagttgacatcttgcatgaccaggaatccggcgcgggtcaggtcgcgcggtttcgcgggcacgccgttgagctcgatgcggcccgaaacaggcttgatgagtccggtcaacgtgcgcacgagcgtggtcttgccgcagccgttgttgcccatgagcccggtgatttcgccggcacggaaccgcaggtccgggatggcgcgggtgaagccgtccttgcctttgtatccgatggtgaggttatgggtgccgagcaatgccgaagtgcactcatccgcggccgggcttgaagccagcgtcgcaatccggtgccgatacggttgcaggtccaacgcccgcaatcccatggcggccacgcagccgggggagagggacaggaattcatcggcctcgtaatcctgcacgatatgcccgccgtcgaataccacgtaccggtcggccacgccgttgagccatgcgagtcggtgttcggcgattacgatggtgagcccttcgtccttcatctgctcgatcatggcgcgcatgtccgcgatggcgttcgcgtcgagattgctggtcggctcatccaataccacgagcctgggccccagcatggtggccgccgccacggcgatgcgctgcttttggccgcctgacaggtggaagatgctgcgatgcagcagatgcccaatgccaaagcgctcagccacggccgtgatacgacgattgatgtcctcggccggcagccctatgttttcggccgggaaggcgagctcgtcggtgacgttcgcgttgaaatactgggttttcgggttttggaacacgctgccgaccagcggggtgagccggtcgatcggcacggtctccacatccagcccgcacgtggtctggttgccggcgaacgcaccatggaagaatgaggggatgagcccgttggcaacgcgcgtatagctggttttgccgcagccgctcgccccgcacagcacgatgcactcgcctgcgggcacggtcaacgtgatgtcgcgcaatgccggctctgcggcatggtcataggtaaaggagatgccacgggaggcgatggttcccgcagacgtgtcgagtgggccacccttgccggtcccaataatggcagttgcattcggctgcgattggttgccacccatcagatcacccccgcgatatcgagcgcgagcggcaaagtgaccacaatcatgaccagccagtcgaccacggtcatacggatcagcgtgcgcgaggtgtgctcgccctcacgcccgagccccttggtcagtgccgccaccgacaggtcctgtgccacattggtggcgttcatcagcagcggaatcagaatgtattccaacgattgggccgggtgacgaaccagcccccagccgccggaggcgatgccgcgcaacgccatcgcattgcgaatctgccggtaatcctcggcgatggtcgggaagaagcggatgaccaccacacagggaatcaccacggcctcaggcacgcgcatacgccgcatcgcgcagatgaacgcgctcgcggacgtggtggtgaacgtatacgcgccggtgatgaaacagggcagcatcatcgtgacgcccacggccagcgcggagaccacatgcagccacggcagtcccagggcatcggggtcgagcattcccagcgcggtgagtactgcataggtcacgccgaagttcaacgcggttcgccatcgggcggccgccagcaggggcagcaggaacagcacgaccatgacgatttgcgtggcgagccctacgtggaagaacagcatgaggttcgccaccagcagaaggtagagtttcgcgcgcggatcgagcgtccggcgggcaggattcatcaggcgataccggccttgatgaagtgcttcttcatcatgcgctggccgaaccagccgccgagaaccgcgcacaccagaatcgcgatcatcgagatgaagaacgtgccggtgttgatgttgacgaatacgccgtcgatgtaggctgcgtccttgccgcgcgcctgcaggctcgccacgtaggcgtccttcatgaaccacaggggcaggatcgggccggtcaggccgtaggagaacaccacgtagctgacgagcagtagcgccttgctcttatacttgccggcgcgcgcgatgaggtcggccgccaccgggaacacgatgctggcgatgaacgaaagcacgaaatgcccggagatgaacaggaacagtccgatgatcacgcccatgacggtgatgccgccgaatttgccgaggcgtgcggccagcagcatgtacacgcagccggagatgagggccgtgatggcgggcaggaagatggagccgaagccgccggtgaacagggtgctcaccagtgtggcgatgcacaccatcacgaagtacagggccgcaaacacgccgatggtgatgaggtcggagacctccagtttgccggatttggcgggcttgttgagctggtcagaggtttcggcgggcgtgttcggtgcggtcacgatgttttccgtttcgtatgcattgacaatattcctctcgccaatctaacgatgatttcccgcaaaggcaatagtctgtctgtgatttttagcatggcttggcgcccctccctgtggggggcgaaggacgtggcgcgggcggggtgtggttcgcggctatcggctagtatggtgcggtcacgacagagggaggcatgctgtggccgatgtgatgcgggagctggaacggctgcgaccggtgtatgagacgggcgtcctgcggttgctgttgcgccagaacgcgatgctgtacgtgtcgctgctgcgttccacgttcgacccgctcaccggcgagctgccgcgcgagaccgtggaggagcggttcgcgcaaagtctgaacgctctggccgacgccggcgaatatgcgccgcgcgaggaccagaccttcgccgaggccgctcatcagatcctcgccgacctgacccgtgaaggcgaaggcgactacgcctggctcgccaactcgcatgatgcggcctcacaccgattcctctaccgtttgacggcccgcgcccaccgcgccatcgaggcgctgagcaggctcgaagacgaatcacgcgccctgtccggcgcgcaggccaacagcatcatcatggaaatcgagcacgcgcgcatgcagctgaccgccgaccccggcgagcgcatcaaactcctcaaccgtgaaatcaaggaacgcaagcacgagatcaaacgcatccaacagggcaagcagcatgccacgctgagcgaagcccaggtggaggacgtgatcgccgtgatccacaacacgctgcgcggcgtgcccatcgacctgcgcgaactcgtgctcgacgagcgggacaacggcgacgccttgcgccggcgcatgcaggccggcgacatcagcgtggacgagaacctgacccgctaccacgatgaataccgccgctcgttcagcgaatcagacagcggccgccgcttcgaggacgccttccaggtgatcatcaccgacgagggccgccagcaaatcgacgaagccctgcgcgccatcgccaaaaccccgtatctggccggcgaatccggcgtgctgctcggccagatccgcgacgaactggcccgcatctacgacggcatcgaagccgtgcgccgccagatgcgcgtctccgacgaggcgatcagccggctcgtgcgccagcaaaccgacactcgctaccgtacgatgctcacccgcttgaaccgactgtacgcgcgcctcaacgcggatgcgaaaacccatatgggagacgcctcgcgcccgtacgacacggccacctcggacgcgctgttcgcgccattgccgatgcgcccggccaaatccatgacccgcgccaccgcacccggcctgagcgacctcgccgccgaagccccgcagtcgactccggtggccgatctgcgggacatggtcaacagcggcggcccccgactcctgcgcatggtcagcctcatccggcgcaacccggtgaccgttgacaggtccgatggcaggcccggcgcaaccctcgtggacatcgccgccagcttcaaccggctgcccgaaagcgaacgccgcgaaagcgagatcgtcggcttcctgggcgggctgggagccgtaagcggcaacgccatcgccgacgagccgtccactgacggcgtcggcgtcggggtcgacagcgacatcgccaccgagccggccccggcgcagcgcggcgatactgcgacctggcattgcgtatcgattgacggcgagccccggaactggatcactagaccggtgctggccgacatggacgagctgagcatcattgtggaggaaggatgaccgtggccgaggaacacgaggaacacgaggaacatatggacaacgccaacccgtacgccctgttcgaaggcgacaccggcgacatgccggccgaggcacgcatggccgccatcgccctcaaacgcgaccgctatatcagcgggcccacctacgacaccgtgctcgacaaccgcgacgccgtcgtacgctccctgaacaacgacctgctcgacttggtgatcaacgaacgctaccgcatcatgtacgccacgcccgtggccggcgacgacgtgaccctgcgctcgctcaaaacccgtgtcagcctcaaacgcgaggaggccgcgctgctcgccttcctgcgcatccgcgtcctcgaatacgagaacgtgcacgccgaccccgccgactggctcgtcagctttgaggagatccgcgccgcgctcgccaccggcgccggctatctggccgcccgcaacgacgaggaaggcgtggcaaagcagatcggcgccatcgtctccgcgatgatcacctacgggtatttggtgcgcctggacgacgaagccatgtaccagatcacgccgctcgtgcccgtggtgctcgaccgcgaactggccgacacctggctcgacgtcgcggaacacggcgacggcgacacggaagatgacgatgacgacgagaagggagccgaatgatgcaggcgacagacgtgcagatgatcgcggaccggtggatgctggaatcccgacgactcatcaactggggctcctatgagggctaccacgaattccgcccctccacggaccacaagctgccggtgaccctgctcgccggcgccagcgaatccggcaaatccacgctggtcgacgcgcagatctccctgctgtacccaaccggtacgccgttcaacaaggcctcgaactccggccgctccgaacgcagcgactacacctacctgcgcggcatggtcggcgtgggcagcaccgaaaccggcgacgagccgctctacctgcgcggccgcgacgagaacggcgcaccgcaacccgtgtggggcgccatcgtggacacctatcgcaaccagaccaccggccaggtgctctcctgcgccaaattcctctacctgatgcccggcgacggccgcggcgacgtgcgccgacagtacgtggtctggggcaagcccgtggaccccaggcgcatggaccaataccgtgacgccccgttcacgccggcccagctcaaagccacctaccccgactgcctcacattccccagcgccgaagcgttccacacacacatctggagcgcaatgggcctgagcgaggccgcctgtcgactgctgcacaagatccagtccgccgacgcgccctcccggctcgacgacatcttcaaacaaggcgtgctcggcgtgcccgaagccctggacctggcccgcaccacggtcgaggactacgaacgttacgacgagaacttccacgccatggacgagaagacccgccgcatggacacgctgcgcggcatccaacaggcctacggcgaatacgccgccgcacgcggcaaggcccgcgccttcgaaccggtcaagccggccgtcgacggcacggtgccggccgtgctgcgcgactgggcattggcccgcatgcgcggcgaagtcgccgtccaactgcccgccgaccgcgccgaacaacagaacagcgaggcggaagccaagctgctgcgccgccgaaccgaagacctgcgcacccgtctcgacatgatccgcggccagatgcagggtctggacggcggcaacctgacccgactcgaactcgaactcgaccaggcccgccgcaccctcgaagacgtgcaagccaaccgaacacgaatcgaacaaacgttcgcatccatcggcgagacgctgcccggcgacgaacaagcctggaacgaacgccgcatcaacgccgtgaacttcaaacgcgaatacaacaaacgagacggcgaatgcgaggaagccctcaccgccgccatcaacgcgcgggccggcgcacgcggcgacctcgaacgactgcaacgcgacttcgaccggcaacgctcccagcgcacccgcatctcccagcagatggacgaaacccgcgccatgctctgccgcgccaccggactcgcccccgccgaactgccgtacgtggccgaactcatggacgtgaacgaacacgaggaagactggcgtctcgccatgaacgtcgcctacgcgcccatcgcccagaccatcctcgtcgacaagcgccacgaacagggcttcgccgccaaagtcagcaccatcgacccgcgcaccatgccccgacgcacctggcagttcgtggacaccgcacgccactacgacgacaccggcgcgcacgcgaacatactcaccggagaacaggacggcgactggttgtccggcaaactgcgctaccgcgacgactcgcccttcgccgactggctgcgctcgcagacccaggacgaacgattcgacgccctatgcgtcaccgccatcgacgacaccgaccgcaccaaccgtcaggtgcaggccgacggtcagatcaaatccggcgcacgcggccagcacggcaccaaagaccgcgcccaggtcatcggattcgtcaacgaaacctacctcaacgcgctcgcagcgcaggtcgacgccgcccgcaacgcgctcagccaagccgacaccgactacacggccgccaaaacacagtccgataacctccaccgcgaactcgaactggccaaccagctcgcctacacgtcatgggaacgcatcgacatcgccggcgcgcaacggaccatcacggacacgcaggacgccatcgcatccatcaaaaacgatcccaaactcgccgaactcgccaaacagcgcgacgaactgaacgccgaactcgaccgtgtggaacgccagcgcatcgaatccgaccaggccgcggcccgcgccggcagcgccgtcgaagcggcgctcatctggctgcgcgaccatgccgacaccggcacgacggacgccgccggtgccaccgccgacaatgacgatgacgccgcgtccggcccgctgccggacgaagtcacggcggcgctcgccgaatcctacgacaaccgattcgccggactggcggacgccgccatgcgcgcgcacatgatcatcggcgcgggcgcggcaggaacgcaggcgccgggggagagcttccccgaacgcaccatcgccggcatcggcaaggacatggcctcccgcatcaacctgctgaacggccaggccgatgccgcacgcaccggcgtcgaatcgaaaatgagcacctacatcgcgctctacgcggccgacgatgattcgctgaccgccagcgtggaggactaccggtactatctcgacgaactcgccagcctcacccagctggccgcggttgccgccaccgacgccgaataccggcgctgcctcgaacagctgctcaggagcttcctgaccatcaaacgcgccatcgacacggatgccagcgacatccacgaccagcttgaccgcatcaacgccatgctcaaaggccagcagttcggtcccaagcacggcagcctgtccctgcacgcggacgtgcgccgtcccgagcgcaccttctgggcgcagttcatccgcgtcatcggcaccctgaacgattggaaatccgccgacgtcaacgattccgacgcctcgcgcaaggctttcgcggcctgcgcgccgatggtcgggctgctgcgcgccgaactcgcgcaggtcaaggacgcgaacggcgtgaaaagctacggcgcccgcaacctcgacccgcgttgccgctcgtccttctacgccatcgtgcatcatgccgacggcccggatgaacgcatcacctccaccggcggccgttcgggcggcgccttgcaggagctcacctcattcgtatacggcgcggcgctcatctacctgctcggcggcggcctgaccagcgagccctcgtacaccacgctgttcctcgacgaggcgctcatcaaggccgacggccgttacacgcagcgcgccctcacggtgctgccgcgcctcggattccaggtcatcgtctccgccccggaaagcaagaccggcgaaatcctcgaggtctccaccaaggcctacgtgacctacaaggaccccgacaccggcctcacctccctgcgcgaggccgtgctgcatcagaatgacatggacgatgaatcatcgtcggatatattgaaggatgacggggttgccgaatgagcagtcctggcgtcgccggtattaagacgattcggttcgactcgacgatgttcgaaagcaggtgatgggaactgtggccggcatgaaagacatcgctgcgatcaccacatgcgtgaagaaacatatgcgttcacatatgtacgacatcgaaccggcatggccatttcccgtgccggtgggattgccggaccaagcatttttggaaaccaatgcgattgcggtgcatgacaacaacaatgagatacggcaatgggcaagcaagaatggttgcgaaatcataaccaagcatcgcaccataggcacctctgtcgagctgatctccaaagtcgtcgttcctgacgaatcaatagccatgcgtgtggttggtcgtacgctggcggcggaatgtcgcgaagcgcgccgccgcatagcatgtctggttgctgcttgtgacgttgctccggaaacaatcgaatcggccgctcgcatgacaggccatgaacagcctgacgacttcgatctgcttgtcagcgcagttcgatatttcaggcatcatgacgtgaccggtatgacgccgcgacagattccattgacaggattcagcggcaaatggctgaatgagtcaaaaaccaatcgtcgtaaggccatttgccgactgctcggtgtcgaaacgttgggtctgtcaaaacggccgaccgaactgcggttccgttatctcgatccggtccgcgacgatgctgagctcgaacgcatcatatggtgtccgtgggaaggcgaagcgttatccggcattaaatatgctgtcatcgttgagaacaaagacacgtatcagactatgccgccgattgcgcagggcatctgcatatggggttctggtcgcgctgtaagcgatgctgtacctgcggttcctgcactgcgtgacatgcgtatcgtgtattggggtgatatggatgcggatggactggaaatactttcgacattacgtgaatcaggtatcgaatgcgactccatcctgatggattgcgatgcatacgatcggtaccacagatttggtaccgatcgtactgaacgcagcgcgaagattgctatgcgggagcctaagccgacgcccggccttcaatcggcggagcgacgtctttatgaacgactgtgtgctgacaaaacaatcgcttatcggcgtatcgaacaggaacgcattcccatgcgtgatgcagttgacgaattacgcaagcttggcatccccgtggagtccattgaaaatcaggatttgccgatttaggctgagtgattggggatgttgccaagagctagaacggcttagctttttctcgtctcacattatgccttccgattaataatgcaacggcattgcatagctgcaaggtccggcactgctatccgatactatcgaactgttgttttgcgttgcgcgagaagggacaaacatggcaaccgcttggggtgacgagagtgtgcggaaaaccggagttccctcgcctatgtacttgatgggcgcatgcgtatgtgatgatacggaaaccgaaacaaggcaaagattggcgttgcttaagcccaaaggagcaaggaaattgcactggcgagacatgcggccatcattgcgtggcaaagtcgttgatgccatggctgcaatggacattgatcatgtcattgtggctgcggtaccaatgagccagtggaataccgccgaacgcgctcgccgtaaatgtttggaacgtcttctgcctctgctggaaacagaatacaacgtggacacgcttgtgcttgaacggcgcgagatttcataggacaggaacgatatccgtttcatcgatggattgagaagccgcagatttatcgggccaattcgtgtcgaactctgtgcaggggagactgatgcaaggctatggctccctgatcagctgctaggagcgtacggtgatgcccaggccggtactggaagatacgatgaattcctcggccatgttcgaacagtgttcatcgacagtgattgatgtcctaaaaccgtgtatacttcatggtaagccaaccccgctggggaaatggaagtgagagccggacgccccgagtatcttgggggccggctcttgcgtttcggtccactgatggtccggaattttgcatactatggttcggttttccggcctgacacgccatcgaacaagcgttcgaatttggtcgtgtgttcgggtatccttgggacagatttggcgcgcgcatgaccgtgcgcgcgggaacggtgagatggaaggtggggcgtggctgtggcggcaacgcggactggcgcaaggcgcgcaacaagcgcaacgggcgcgaaaaccggcaagggcaagaacggtgaggtcatcgtcgaaaaggtgatgaccagcgactccttcctgagccgggagatcaaaaaggcgccgctgatcgaacacgatggttcgctggtagctgatatctcgcacatcccgaacgatctcaagatcacgattcagggtgcgcgcgaacacaacctcaagaatgtcgacctggcgattccgcgcaatcgcatggtcgtgttcacaggcctgtccggttcgggcaaatcctcgctcgcgtttgacaccctgttcgccgaaggccagcgacgctacgtcgaatccctatccgcctacgcccgccagttcctgggtcagatggacaagcccgacgttgacttcatcgagggcctgagcccggccgtctccatcgaccagaagaccaccaaccgcaacccgcgttctaccgtcggcaccatcaccgaaatctacgattacctgcgactgctcttcgcccgcaccggcatccctcactgccctgaatgcggcgagcccgtcgcctcccagaccccgcagcagatcgtcgacacgctgctcggctacccggagcgcactcgattccagattctctcgcccgtggtcaagggccgcaagggcgagttcgtggacatgatcgagctgctgcgctccgacggctacgcccgcgcgctcatcgacggcgagatgacacagctgtccgacgacatcaaactcaccaagcagaagaagcacaccatcgaggtcgtggtcgaccgactcgtggtcaaggacggtatccgccaacgtttgactgattcggtggaaaccgccctcaagctcgccaacggcagcatcgtcatcgacttcgtggacgaggaggaaggcagcccggcccgccgccagccgttctccgaacaccgcagctgcccgaacgggcacacgctcgaactcgatgaggtcgagccgcgcaccttctccttcaacgccccctacggtgcctgccccgcctgcaccggtctcggcttcaaactggaaatcgacccggacctcatcatctccgacccggacaagtcactggccgacggcgtcatcgaaccgtggagcggcaccaagatgacctcccagtactacggccacatcctcgaaggcttggccaaggaaatgggcttctccatgaagaccccttggaaggacctgccggacgatgtcaagcacgacatcctctacggccacgacttcaaggtcaacgtctcctaccgcaatcgctggggacgcctgcgtgaatactccaccggcttcgaaggcgtgatccgcacgctcatgcgacgccacgacgaaaccgattcgcagtccatgcgcgaatactacgagtcgtacatgcgcgaagtgccctgccaggtctgccacggacgtcgtctgaagcccgaagtgctcgctgtcaccgtggacggcaaatccatcttcgacgtgtgcgacatgcccgtcgtacgcgaactcgcctggatcaacggcctgaaactcgaaggctcggcacagctgatcgccggcgaagtgctcaaggagatcaaggcccgactcggcttcctgaacgacgtcggcctcgactacctgaccctctcgcgcgcggccgccaccctgtccggcggagaagcgcagcgcatccgactcgccacgcagatcggctccggcctggtcggcgtcatgtacgtgctcgacgagccgtccatcggcctgcaccagcgtgacaacgaacgcctcatcgaaactctgcaccacctgcgcgatctcggcaacacgctgatcgtcgtcgaacacgacgaggacacgatacgccgcgccgactgggtggtcgacatcggccccggcgccggcgaacacggcggcgaagtcatctactccggccccgccaagcacctcatcgaagccaagcgctccatcaccggcgactacatcgcccaccggcgagagatcgccgtgcccgccaagcgccgcaagatccacaagacccaggtgctcaaagtcgtgggtgcccgcgagaacaacctcaagaacatcgacgtgagcttcccgctcggcgtgctcaccgtggtcaccggcgtctccggctccggcaaatcctcgctggtcaacacgatcctctacccggtgctcgccgacaagctcaacggtgcacgcatcgtacccggccgccacacgcgcgtggaaggcgtggaccaggtgcgcaaggtgatccacgtcgaccagaacccgatcggccgcacgccgcgatccaaccccgccacctacaccggtgtgtgggacaagatccgcaccctgttcgccaagactcccgaagcccaggtgcgcggctacggccccggccgcttcagtttcaacgtcaaaggcggccgatgtgaggcctgccacggtgacggcacgctgaagatcgaaatgaacttcctgcccgacgtctacgtggactgcgaggtctgccacggcaaacgatacaaccgcgagaccctcgaagtcacgtacaacggcaagaccgtggccgacatcctcaacatgcccatcgaggaggccgccgacttcttcaaggcgtacaccggcatctcccgatacctgaagaccctcgtggacgtcggcctcggctacatccgactcggccagcccgcacccaccctgtccggcggtgaatcgcagcgcgtcaagcttgccaccgagctgcagcgccgatccgacggcaaaaccgtgtacatcctcgacgagccgaccaccggcctgcacttcgaagacgtgaacaagctgctcaaggtgctgcagtccctggtggacaagggcaatacggtcatcgtcatcgaacataatctggatgtgatcaaggaggccgactggctgatcgatctcggtccggagggcggcgacggaggcggcaccatcgtcacgcagggcacgcccgaacaggttgccgaatgcgaagcctcatggaccggcaagttcctgaaacccatgctttagccttccattgcagctgacctcgggtgggttggggtgtttgttgctggacatgctccgggccgctcaggtcaagtctttacggtccagcaacacacaccccaacccacccaatccctgatgattggttttgcttaatagcgaggaggattatgacgaacgatattgagcggcatagtccggatgagtggcggaagactgcggcggcgttaatgtcggaaagcatagctgtgggtgccggggaaacgacggcgaaggtgaatgcgaatggggcacctttgctgggggattctcgcgacctgttccgacccaagacctcggatattcccgccaaacccggtgtgtacaaatggcgcgacggggaagggcgcgtcatttatgtgggcaaggcaaagaacctgcgcaacaggctcaccaattatttccagccgctgtatctgctgcatccgcgcacgcagaccatggtgctgaccgcacgcagcctggagtggacggtcgtcgccaccgaactggaatcactgacgttggaatacacgtggatcaaggaattcgacccacggttcaacgtgcagttccgcgacgacaagacctatccgtatctcgcggtcagcacgggggagcgaattccgcgcgtgtgggtcacgcggtcgcgcaaacggcgggatacccggtatttcggcccctatgccaaagtgtgggaattgcggcacagtcttgaccggttgctgcgcacgttcccggtacgcacctgcaccaccaacgtgttccataaggcgcaactgaccggacggccatgcctgttcgcttccatcggcaaatgctccgcaccctgcgtgaaccgcattgaagcggacgaacaccggaggctgtgcgaacagctggtcggcgtgatgaccggacgactcggacggccatacatcgcccagttgacccgcgacatgaaagaggccagcgccgaactcgaattcgagaaagccgcccgactgcgcgaccagatccaaatgctggaaaccgtggtgcaacagaacgccgtcgtcttcgaccaggatgtggacgcggacgtgttcggcttcgccagcgacgagctcgaagcctccgtgcacgctttttatgtgcgcgccggctcgattcgcggcgaacgcaactggagcgtcgaacgagttgaggacatcgatgacgccgacttgatggccgaccttctggtgcaggtgtattcggacgccgccggggacaatcacccccagtcggccgcgaccatctccactaatcgcgaggccatcggctccacgcaaaccatcacggccacggacgctgtggcacgcgcccaggccacccgagaacgcaacacccgtcaggagaccaccgggcgcgcggacctgctggcacccatcgcaccggtaccgcgcgaaatcatcgtgcccgtcgaaccggcccgccgtgaggaactcgaaggctggctgaccaatctgcgcgggggagcggtgaccatccgtgtggcctcgcgaggcgacaagaagcagcttatggaccgcgccaacgagaacgccagccaagcactgcaacgcagcaagatgagccgcatctccgacatgggcgcacgcacccaggccatgaacgatgtggccaaggcattgggactcgcggaagccccgctgcgcatcgaatgctacgacatttcgaacactgtgggcggtgccttccaggtggcctccatggtggtgttcgaagacgcgatcgccaagaaatccgaataccgacgcttcgccatccgaggcaaggacggcaaaggcgcggtggatgatctgtccgcgctttacgagacgctcacccgccgcttcaagcacggcaacatcgccggcgactccggcgaaagcatcgacgcggaacagcgtgtggcctcggccgccggcaagatgaccactgccgtggcggcggagacaatcgctgcgaacggtaacgacaatggtgagggcggttccgacatcagtggcaaggggcacgcggtgccggtcggagtgcagaacgatgcgcgggagtccccgcccgacatcgtccagcagaacacaaaccggcatcactttgcctacaagccgaacctggtggtggtcgatggcggcaagccgcaggtcatggccgccgccaaggcgcttgaggactgtggcgtgaacgacgtggccgtctgcggactggccaaacgcttggaagaggtgtgggtgccggacgacgactatccgatcatcctcaaacgccagtccgaaggcatgtatctgctgcagcgtgtacgcgacgaatcccaccgcttcgccatcacctaccaccgccagcagcggcgcaaaggcgccctgcgcagcgcgctcgacgagattcccggcatcggcgaaagctaccagaagcggctgctcaaccacttcggctcggtcaaagccatgcgcgaagccagtgtcgaggacttcgagaaggtcaaaggcatcggccacgccaaagccgaagcgctgtacaacgcgctgcacgagcagtgagccggcccggtccagcagcccagagtaaattttcggttgcggggcctgtggttgacatattcgaagcaaagtgtcggctagcatgggaacagacatcaaggaggggatatggccaatcatcgttgcgctgtactcggcaaacccgtcgcacactcattgtcacccgtgcttcacaacgcggcctaccgttcgctgaaactcgacgattggctgtacgacaagcacgaggtgggggaagacgacctcgacgctttcctcaaaggccttgactcgacgtgggctggcctgagcctgaccatgccgttgaagaagaccatccaaccgtacggtgttccggaaaatttgtgggccaaggaactgaaggtggcgaataccgcggtattcgactggagcgtggctgccgatgatcccgcttggccgaacggcaagccgggcatcaagctatacaacaccgatgtcatcggcatccaactcgccttcgaccatgccaatcgcgaactcggcgaacaccacaccgcgtcgagaagcggcaccgcgctgatcatcggcaatggcaacaccgccacttcggcgttggccgcatgctgcatgatgcccgaaatcggccatatcgtcgtcgccgcccgccaccccggaaaaaacaccgggcttaaaccagtggccgaaaagttcgtcaacgtgcataacccgtacaacgaaatcgaattaggcgacgatcaggccctgcttgaggcagcccgcaacgccacctatgtcatcaacacgattcccggacacgcggccgacaacgtcgcggatgccctcgccgatgccggaaccgagccattctccggactgctgttggacgtgatctacgatccacgccccaccaagctcatggaagcctggcgcgctcatggcggtcacgccatcggcggcgaagaaatgctgctgtaccaagctctcgtacaggtattgctgatgaccggtatctgggatgacgacccgcccagcgatgccgaccagcgtctgcaggacaccaccaccgaagacgaccagctggagatcgcgatgcgcaaagctcttgaggaggcgctgtaatgaatcaacagacaacgaaccgcgataccggcgaggcggccgccacgaatgcgccggcgaattccgcgacatccacatcgactccggacaaccagccgaccccgcttgatgccttcgaagtgctgctcatcaccggtatgtccggcgcaggccgctctcatgccgctgactgcgtggaagacatgggatggtatgtggtcgacaacctgcctcccaaactgcttatcccgcttgtcgacatgatgaccacctccggttccggatcggagtcaggcgtccacaagcttgccgccgtcatcgacgtgcgctccagctatttcgacgagctggccgccgtgctcggccatctggatgatctcggcgtcaaaacccgtattctgttcctcgacgccagcaacgaagtgctcatcaagcgctatgaatccgtgcgccgcccgcacccgctgcagcacggcaaccgactgatcgacggcatccttgaggaacgtcacctgctggaagacctcaaggaacgagccgactgggtcatcgacaccagctccctgagcatccaccagctgtccaccaaactctacgaggcgatgctcggctccggccccaccaccgtggcagtacacatcttcagcttcggcttcaaatacggtatgcccatcgacgccgatttcgtggccgacgtgcgttttctgcccaacccgttctgggtgcccagcctgcgcgagcttaccgggcacgacaagccggtcgccgactacgtgctttccagcaagggagccaaggaatttctcgacgcttatgagaaagctatcgagattgcgttggaaggatacgcccaggaagacaagcactacgtaaccatcgccgtcggctgcaccggtggtcagcaccggtcggtggcgatgagcgaagagctggctcgccgcttacgcgcacatgggctcaacgtaaccgtttccgcgagagaacagcacaagcgtcactcatcgtaagcaggcgtcgagcggtcatcgggcaagtgttcggtgaccacactgcgagaaagcagggcccataatacgtatcaaacgggttcgcttgtccaccagattaggtatcacagaaagccgatggcttccgaccgtgtgacagcagatgacggcacgaagcgcctgaagcattgagaagaacgggactgtaggaggtagatcttggctcttctggacgatgtcaaaagcgagttggcagcctttgaaggcgattcgccagccgcgatcaaggcccaagctgcggccatgatccgttttggcggcggtcttcgaccggtacagaatacatacgttatccaagccgtattcacctcgcttgacgttgcagaatggctgaagaacacgttgaggaacacgttcgggcacgaagccgaggtcaatcacctcacacgtcagaccccgaacggccctgtcgagacctacgtggtgctcgtcacccgcaacgtagtggccttggctttgcagaccggactggtcgaccgccgcaagcagcaggtccgtggactgccgtctgaagtggtcaacggatccatcgcccaaatcaaagcggcatggcgcggcgccttcatggcccgtggcttcctgtccgatcccggtaaggccagcttcctggaaatcgcttgccccacggaagaggccgccatggccctgtgtggcgtggcccgtcgtctaggcatccaggccaagcatcgcacgctgcgtagctccgagcgcgtgacactcaaggatcccgacgccatcgaacgcatgctcaagctcatgggcgccacccgttcggctcgcgaatggaccggcaagcgttccgatggcgaggcccgcggcaaggccaaccgtctggccaacttcgatgacgccaatatgcgccgttccgccaaggccgccgccgaagccagcgaaaaagtgcagcatgctttcgaagtactcggcgataacattccggacaacctccgtcaggccggccagctgcgcatcgatcacgtggacaagagcctcgaggagctcggcaagatcgccgaaccgcaaatcaccaaggatgcgattgccggccgaattcgccgactgcttcaacttgccgagaagacggagaaggctcgcgcagccgaaggcaagtaacccgacaatccgatttgccatgcctattcggcaaaacgcgacaacgatgtgacaaaacaccgcattcagtcagtagacgaatgcggtgttttgttccggaatgcctgtaatatgcaaagtggcaaaattggccactttgacgtgcgattcgtcaaggaaaggatattcatgaagacactcaaggaccttggagatctcaagggcaagcgcgttctggttcgcgctgatttcaatgttccgctggacggcaccaccatcaccgatgacggtcgaatcaaggctgctctgccgaccatcaagaccctgcgcgaagaaggcgccaaggtcatcctcatggcccaccttggccgcccgaagggcaaggtcgttcctgagctgagcctggccccggttgccgcccgcctcggcgagctgctcggcgccaacgtgccgctggccaaggacacctacggcgaggacgctcaggccaaggtcgccgccatgaacgatggcgacgttgtgctgcttgagaacgttcgtttcaacccggaggagacctctaaggacgccgacgaacgcgccgcttacgccaagaagatcgccgccctcggcgaggccttcgtttccgatggcttcggcgtggtccaccgcgctcagggctccaactacgacgttgccgccgatctgccggccgccgcaggcctgctggtcgagaaggaagtcaaggccttgtccaaggccaccgagaacccggagcgtccgttcaccgtggtgcttggcggttccaaggtctccgacaagctcggcgtcatcgagaacctgctcgacaaggccaactgtctggtcatcggcggtggcatggtgttcaccttcctcaaggccaagggctacgaggtcggcacctccctgcttgaagaggaccagcttgagaaggtcaagggctacatcgagaccgccgagaagaacggcgttgagctcgtgctgccgaccgacgtcgtcgtgaacgccggcttcccggccggtgacaccccggttgctccggaagtcgttgccgccgacgccatcccggccgacaagatgggtctggacatcggcccggagtcccagaagctcttccacgacaagatcgtcgactccaagaccgtcgtgtggaacggcccgatgggcgtgttcgaggttcctgagttcgccgccggcaccaaggccgtggcccagggtctggtcgacgccaccgcagccggtgcgttcaccatcgtcggtggcggcgactccgcctccgccgtgcgcaacctcggcttcccggaggacggcttctcccacatctccaccggtggtggcgcttccctcgagttcctcgaaggcaaggagctccctggcctgaaggtgcttgagtaatccattttctagctcccctccttgaggggagctacgtttttttttagaagggaaacatatggcgtccaaacgcattccgttggtggccggcaactggaagatgaatttcgaccatcttgaagccacttacttcgtgcagaagctggtatggctgttgcgtgacgctcacttcgactttaaacgctgcgaagtcgcgcttttcccctcgttcacgtcattgcgcagcgtgcaggtgctggtcgaagccgacaagctccatgtcgcctacggcgcacaatccgtttccgtgaccacccaaggtgccttcaccggcgatgtgtccgcggacatgatcgcccatcttggctgctcatacgtcatcgtcggccactccgaacgccgcaaataccatcctgaagatgacgccaatatcgtcgatcaggtacgtgccgtgctcgccgccggcatgcagccgattttgtgcgtcggcgaaagcttcgaggaacgacgtcaaggcattgaactcgatttcgccgtgggccaggtacgagacgtcacccgcgatctcaacgaagaacaagccgccaaactcatcgtggcctacgaacctgtctgggccattggcaccggcatggtggccactccgcaatccgcccaggatgccgcaaacgccatccgcaacgatttgaagaccacttttggcacgaaggtatccgatagcgtacgtatcctgtacggcggatcggtcacctcgaaaaatgcggcggaactcatttcccagcccgacgttgacggcttcctgatcggaggggcggccctggacgttgaggaactcgccaaaatcgctcgactggcactgaaatccacgaaatcacggaactaataccacggttttcccgtgtgtgcgctatgctggtcaacagtccaatcaatccggaggtaccctgtgaccgctcttaagatcacgctgcaagtcatcgtcgtgctgctcagcttcgtgctgaccctgctcatccttatgcacaagggcaagggcggcggtttgtccgacatgttcggcggcggtctgacccagaacgccggtacttccggtgtcgccgaaaagaacctgaaccgttggaccgttatcatcgctctggtgtgggtggccttgatcatcggcctcgacatgatgaccaagttcaacctcggctgatcggcttgcacgccatatagacttgtcgctcgcgacccatgaccgttaccgtcggtcatgggtcgtatgcgttctatcgagtattacgaaaggacatcaccatggtcactatgaaccgcaacaaagtcgttatcgtcggcaccggccgggtcggtgccaccgccgccttcggcatcgtcacgcacggcctgtgcaatgagcttgtgctcatcgactgttccgccgccaaggccctgggggaggcccgcgacctcgatgatggcagcgaattccaggaccgccacgtcaaggtgcgcgccggcgactacgccgactgcaaggatgcggacatcgtcgtcatcaccgtgggccgcaagccgccggccaactccaaccgcatggccgaactcggcttcaccgtgggtcttgtgggcgaagtggtcgacaacgtcatggcctccggttttgacggcgtgatcgtcatggtctccaacccggtcgacgtgatggcttggtatgcctggaaacgttccggtctgcctcgcacccaggtgctcggtaccggcaccgcgctcgacacctcgcgtctcaagaccatcatcggcgaagagaccggccttgacccgcgcaacgtgggcggcttcgtgatgggcgagcacggcgactcccagttcaccgcatggtccaccgtctcgctcggcggcaagccattcgcccgcttcctggccgacaaccaagaccgtttcgcctccgtgtccaccaccgaaatcgaagagaagacccgcacccgtggcaatgagatcgtcgcggccaagggcggcaccaacttcggcatcgcctccaccgtggccggcatcgtacagaccatcctgtgggacgaacgccgcatcgtgcccgtctccaccctgctggacggcgaatacggcgaacatgacgtgttcctcggcgtccccactgaactgcgcgccaatggtgccaacgagatcgtcgaactcgatctgagcgaggacgagcgggccaaactgcaccattccgccgaactcgtgcgtgaacactgtgaggggctgctgtgattctcgacgccatcacgccgaaacaaccccgactgctggtcgccgacctcgacggcacgttgctgcacgacgccgaggtattcgagggccggttcattacccagcgcagcatcgacaccatcaaccgcgcgcacgatgccggaatgcaattcgccatcgccaccgcgcggccggtgagtaccggtctccagttcgccgaaaaactgccggtggacgccgtaatctatctgaacggcgccctcatcgatttcgacccggcccactccgacttcgacctgctcacctcaggtgccacgccggccgatgagaaccatttgatcaagattggcttctcctcacggcgtgcctgcgaagtctgtctgtccctgctcgatcgcatgcccggcctgaagctcggcatcgtgatgaacgacgtgcgctacaccaacttcgatgtgcgcgtgtattggaaaactcaggccttccaatacacgaacttccacgacgtgcccgaaggcgtggcggacaaaatcaccatcttccccgaacctgaacagtggaacgagctgcgtgcgctgattccgccggacttcgacatctccatcagcgaaggcgtgatgtggatgctcatgaacccgcaggccaacaaggagcacgcgctgcacctgctgtgcgagcgactggacgtgccgcttgaacagacagccgccttcggcgacgacctcatcgatatcaacatgatgagcgaatccggccggggcgtggccgtggccaacgcgaaccccaaggtgttgtccgtcgccgacgagatctgcccgtccaacaacgaggacggcgtcgcccaatggattgaagcgcagttgggttgaaccggtcgagactcgagaacacgccaaaattgaacttgtgttgaaccgggggtatgctttgaaccgttgttcaaagaaagaaattgaactcccggttggaggcataaggatatgagcgtatcggtgtttgcggaacgtctgcgcaatgcgatgaacagcaggggactgaagcaggtcgatctggtgcacgccgccgaacatcgtggcgtaaagatgggcaagagccacatcagccaatacgtggccggcaagaccatgccccgcgaggacgtgctcgaattcctggccagcgaactggatgtcgacacgaactggctgcgcggcgaggaatccaccacgcaattgaactcggacgcctccaacagtgtcacggacggcgaacacgccgccacaccgcttgccacgggtaccgccaagccccagacggacagcgagattcccgtgggccgccgccgcaccttcggcaaatcgcacaagctcgacaacgtgctctacgacgtgcgcggcccggtcgccgacgaggcgatgcgcatggaggccaacggcacccacatcctgaaattgaacatcggcaacccggcacccttcggcttccgcacgccggacgaagtcgtctacgacatggcccaccagctcaccgacaccgaaggctactcgccgtccaagggcctgttctccgcgcgcaaggccatcatgcagtacgcgcagctgaagaacatcccgaacgtcaccatcgacgacatctacaccggcaacggcgtcagcgagctcatcaacctgtccatgtccgcgctgctcgacaccggcgacgaagtgctcgtgccctccccggactacccgctgtggaccgcctgcgtgaacctggccggcggcaccgccgtgcactacctgtgcgacgaacagtccgaatggtatccggacatcgacgacatccgctccaagatcaccagcaacaccaaggcgattgtcatcatcaacccgaacaaccccaccggcgcactttacccaaaggaagtgctccagcagatcgtcgacatcgcgcgcgaacaccagctcatcatcttctccgacgaaatctacgatcgcctcgtcatggacggcctgcagcacatctccatcgcctcgatggccccggacctgttctgcgtgaccttctccggcctgtcgaaatcgcacatgatcgccggctaccgcatcggctggatgatcctgtccggcaacaagcgcattgccaaggactacatcgagggcctcaacatgctcgccaacatgcgcatgtgttcgaacgtgcccgcccagtccgtggtgcagaccgcgcttggcggccaccagagcgtcaacgactacatcgtgccgggcggccgcgtgcacgaccagcgcgacctcgtctacgacatgctcaaccagattcccggcatcaccgccgtcaagccgaaggccgcgttctacatcttcccgaagatcgacgtcaaacgcttcaacatccactcggacgagcagttcgcgctcgacctgctgcatgacaagcacatcctcatcagccacggcggcgcgttcaactggcatcgccccgaccacttccgcgtggtgtacctgccgcgcatgggcatgctgcgcgaaaccatgggggagatctccgacttcttcagctactactggcagagctgatccttggcgcaaacgaacacgctcgattgtttcgtgatatgaaggagatcttatgccggtggtgtcgcgtcgtgcgcaggaagcgctgtatcccagcgatcgcgcgaactgcggcatggtggtccgcgctatgccaaggtgaaggcgatgacgaaggccgtggcggacagtgcggttgccaggagcagatagcacacggcggctgaatttcgagagccatcggcattggcagcgttaccgccgttatttgcgttgcgtgcagccaacgtgatggccgtaatcgccgaaagcagggagaacaatggcagcacgcacaacacgacggtcagcagtcccaaagcttcatggccgatgcaataagcgacaagacctgcattgtcagttgccgatagcgctgggcagaaatcggtgtgtctaccagtgttgtagctgtaggtaaagaacgtgatacctgaccagaacagggcaacgggaacagagcaattgcgtatggcggatgcgttgatgctgatggtgtggaacaggtcgtgcaaggaggtagcccgtataccactgcgttctggcgtgattcgattactgttgttttgcgagtcgatggtaagagaggcgcattgcaccagcgcatatgccgcaagtccaagtccgcaagcgatggttgcgccgccgctgaagttgacctcgtcggatactgaatattcggtgacgaataccggcatcacgccaatctgccatacgaacaacagtcgcgcgattcgtatccaaccgttgctcagatatgaggtggctatggcgtgcaccagccacgtcaccgcatacatcgcccacaacgttacaatcttggtattcgcactcaacaccaatatgatcgcaacagccactgccgcaataagaacactaaacaccgaacagagccgatggcgcgaaaagccctgtactcccgcaacagtcagacagagaatcgcgacaacactcagcgcagtcaccgtcataaaccacagtggtgaggtgacgcaggctccataatcgtcagttgcttggcccgagagatagtaggtcattctgccaatcgccggacaattcggatgcaacatcatgccgccccaaatgcgctcatataatggcgcgaacgatacaccggcaccactgagcgtcgcaacaaccgccatcaccatggccggaatcagcccaagctcgcgattccggccggtttccgctatctgtctatcactggtgtccatgactcaccccaccttatgctgttatcgccgtcgtcgatgatgctagtataactatggcagatgggcggagaccagcggcatacaggaattctgtatgccgctttataggagggatactgcggcagccgccatcaccgaccgaccgccagactccggcacagaccgggaagaactaccgtcgcggagcatcggcgataccaatggcaacaccgaggatagccgggaccacccagccgagctggtattgctgcaaaggcagcatagccagcgccgcgtccagccagccgatggaaccgccgaagacggcgaccaaactggagatgcaggtggtgaaggatgcgatgcccaccagcagcacggtccagaagtagacgcgcgggaatcgcgcgccgagcgacttgtgggtcagcgtcagcagtaccagcacgatggcgatcggatacagtgcggacaacaccggcacggaaaccttgatgatcgcgcttagcccggcattggacacgatgaaactgaacacggtgaagatgacctgccaggtgcggtagctcaacgttcggccggcgacggtccggaaccgagtatggaagtaggtggcgcaggtgccgatcagtccggtgcatacgttgaggcaggcgatgacgaacacgatgccaaggaacgcggtaccgaacgtgccgaacagggatgaggtgaggttggtgagcacggtcgcgcccgtgtctttggtggggtcgatggtgacgatggctccggacaccacgcccacgtagcttagcgcgccgtaaatcacgatcagcagtacgccggtgccgagcccggcatacgcggtctccttctgcacttgcgattcgtcatcgacttgttgggcgcggatattcgcggagatcacgatgccgaagtagagcgcggcgagcaggtccatggtctggtagccgtcgaggaagccgcgtgcgatctggtttgtggagtagtcgcccatcgggttggccggggtgccgatgccgtggatcaggcaggcgatgaacaggacagcaatgagcaccagcagcaacggtcccatgaatcggccgagcactttggagagtttctcgggatgctgggcaaacaggaacgccagcgtgaagaacacgagcgagtagatgagttgggccagccagccataggaggacggtacgaaaggagccaccatcatttcgaatgaggtggtcgccgtacgcggaatcgcaaagcacgggccgatggtgagcatgatcgccacgccgaggaacaaggcgaatttgggggagacccggctggcgagtttgtcgaaaccgccggcgaaggtgaccgccagcacgccgagaatcggcaggccgactgcggagacgatgaaaccgatggccgccggtatggtcgcggaaccggcctgcgcgccgacgaacggcggaaaaatcagattgcccgctccgaagaacatcgaaaagaaggtgaaggtcatcaccaaccgctggcgtgcgacaagtttgttcattacgattcggcctttctctcatatgctcgtaccactgtagcaacaaacgaaagaagccccgaccgttggggtcggggcttctgtgagctaatcaactagtgcgctaaacacgcatcagtcgtcaaatctcaggcgttcacgcggtcgatgccggactggacgtcagacagcacggaatcccaggacttgatgaaggcagcgacaccgtcggcctccagcttgtcggtgacgtccttgaggttgatgccgagctcagccagcttgttgatgatggcgtgggactcttcgtaggtgccctcgatggacggagcgccgttgccgtggtcggccagagcgttcagggtcttctccggcatggtgttgacgatgtgcttggcaacgagctcgtcaacgtacttgcagtcggagtaggcggcgttcttggtgccggtggaagcccacagcggacgctgaaccttggcgcccttggcagccaggtcggcccaacgcggatcctcggcgaacttcttctcgaagagttcgtaagccaggcgagcgttggccacagcggccttgccctccagagccttggcctcgtcggagccgttggcttccagcagcttgtcgacagcggtgtccacgcgggacacgaagaaggaagcgacggagccgatgtgcttcaggtcgtggccgttggcggcagcctgagcgatgccctcgatgtaagcgtcgatgacctgctcgtagcgctcgagcgagaagatcagggtgacgttcacggagatacccttggccagggtggcggtgatggccggcaggccttcgagggttgccggaatcttgatcatggcgttcgggcggttgaccttctcccagagttccacagcctgcttggcggtgttctcggtgtcgtgggccagacgcgggtcgacctcgatggagacgcggccgtcgacgaagtcggtagcctcagcgatctcgcggaagatgtcggtggcgttgcgcacgtcggtggtggtgagctcgcggacagcggtctcaacgtcaaccttgccgagctccttgagctgagcgtcgtacgggccgacctggctcagggccttctggaagatggacgggttggtggtcacaccgacgacgttcttgttggcgatgaggtcctgcagggagccggactcgatgcgggagcgggacaggtcgtccagccagatggaaacgccgttgtcagacgtacgctgagttgcttcagtcatttatttttctccttatattccgtattggaacaaatctttaagtagaccccctctaacgagagggccgatcaggtggagtcttgagtacaagcctccctcgtcagagggaggctaggggactcacttggcggcttcgacttcggcgatggaggccttggcggcttccaccacgtgctcggcggtgatgccgaggtcgatcatgttctgagcgccgtcgccctgcaggccgaactgctcgatggagacgggcttgccgtaggagccgaggtacttgtaccacggcatggcaacgccggcctcgacggagacacgagccttgacagcggccggaagcacggcctccttgtactcggcgtcctgctcctcgaaccattccatggacggcacggacacgacgcgagccttgacgccctcgccggccagggtcttggcggcagccacagcccactggacctcggaaccggaagccatgaggatgacgtccggagtgccctcggtgtcgaccagaacgtaagcgcccttcttgacaccgtccttggccttggcggcggtctcggcaagaaccgggacaccctgacgggtcagaaccatggcaccaggcagggtgttcttcttctcgaagaagtaacggtaagcctcggcggtctcgaaggcgtcggccgggcgaatgacctcaagctgaggaatcgcgcggaaggaagcaaggtgctcaaccggctggtgggtcgggccatcctcgccgacggcgacggagtcgtgggaccagatgtacaggttcggaatctccatgagggcggccagacgaacggcggaacgctcgtagtcggagaacatgaagaaggtgccgccgaacggacgggtgtgggagcccagcaggatgccgttggtgatgcagcccatggtgaactcgcgcacgccgaagtgcagctggcgaccgaactcgttgcagttcggccactgcttggtggcgcactcggccggggcgaaggtggcagcgcccttgagatcggtcttgttggagccaccgaggtcggcggagccgccccagagttccggcatgacagcggcgatggcgttgagcacggagccggaggcgccacgagtggcgacacccttgccgacttcgaaggtggcctcaaggtcgtcaagagccttgtcgaagccttccggcagttcgccggccttcagacggtcgtacagggcagccttgtccgggttggccttgcgccaagcgtcgaacttctcgtcccattccttgtgggcttcgagaccgcgctcggcaaccttgcgagcgtgagccagagcctcttcgtcaacgtggaagttctcttccggatcgtagccgagggcttccttgaggccggcaacagcctcggtacccagcttggaaccgtgggaggacgggtcgttggtcttgcccggggtcggccaagcgatcagggagtgaaccttgatgagcttcggctggtccggagcggccttctcggccttggcgatgacgtcagccaagccctcgatgtcctccttgtaggagccgtcgggctggatgaagctgaactcgtcggtgtaccagccgtaggcctggaagcgcttgagcacgtcctcggccagcaccaggttggtgtcgccttcgatctggatgcggttggcgtcgaagatcacggtcaggttgccgagcttctggttggcggccagggaagcggcctcgccggagatgccctcctcgatgtcgccttcaccgcagatggcccagatcttgtggtagaacggggaatcttccttcggggtctccgggtcaagcagaccgcgctggaaacgctcgccgtaggcaaagccgatggcggaggcgaagccctggcccagagggccggtggtcatttcgatgcccggggtcaggccgtactccgggtggcccggggtgcgggtggcagcgccgccacggaagttcttaaggtcgtccagggtcacgccgtaaccggagaagtacagctggacgtactgggtgagggaggcgtggccaccggaaaggatgaagcgatcgcggccttcccagttgggatcattcggatcgtgcttgatgaagtgctggtacagcgtgtaggcgacgggcgccagggagatgggggagccggggtggccggagcctgccttctcaaccgcgtcagccgaaaggaccttcgccatcttgatggcgcgctcgtcgagctcggtctccttgaattcggtcatggattactttccttccaattggtcgggccgcgtatccggcttgtgccgggcgcttgacgccctcacattgcgattaccatgctagcgtcggtttgcgacgttgtggagcaattttggcgtgttttggtagtttgtgttctgttagcgttcacagtgaacattgctacgctgcaaacgaacgcattagcactcaagcctaaggagtgctaatacaatgttctaaggtgaagtgcgccacctgcacgtggcggagccaagaaagaggcaatatttctgggttcccgcgtgtcgcggcgtggcgaaccgaccgtcggggtacgccctgagtgaaccgtgactgatatgaatatgtatgcatatataaggaggcgcgcatgacgcaatcaagacgcatgctggtgctgcgcgccgtggtggaggattacatccgttctcaggagcccgtgggctccacttcgctgacgcgcgaccatgatctcggcgtcagttcggccaccatccgtaacgatatggccgctctggaggacgaaggctatctgattcagccgcacacttcggccggtcgcgtgcccaccgaaaagggctatcgatactttgtggaccgacttgctaccgtggtgccgctcagcgaggcgcaacgccgcggcatcaacagcttcctgtccggatcggtgagtctcaaggacgcgctgcaacgttcggcacgactgctgtccgaaatcaccggtcaagtggccgtagtcgcctcgccatcgctggccaaggccacattgcggcacgtggagatggtgcccgttgccatgaccacgttgctcgccgtggtgattaccgacacaggccgcgtggcccagcacggcctgaccatcgcatccatgcccgccgtggacgagatcaaccggctctccaacaccgtcaacgagcaatgcgacgggctgtccctatcgaaatccgcggagaccgtgcgatccatcgccgccagcgccggctacgagtcggtgcgtggcgtggccgacgcgctggccgacgccttcgaatcgatggcattggacgaacgcgcgaacgaactgtacatgtccggcacctcgcacctggcccactcccggtccctggccgatctggccccgctcttcgacgcgctggaagaacaggtcgtgctgatgaagctcatgagcaacctgagcgaggagacgaatgcatccggcgtgggcgtggccatcggctccgaaatgcacacccccggactactgcatgcttccgtggtcagcagtggctatgggcgcagcggagcggcgggcgaaccggcggggaacgatcccgtaggcgaacccgaaaccgaatccgagacggagagccagacgaacgacacggaacccatcgccttcgttggctccatagggccgacccacatggactacgcggccactatggccgccgtcagggccgtagccagatatttgaccgccttcctctccgagggccggactcaagactgaccgccgtctgtggcacaatgacccgcagaccaaacgaacacaaaggatcaatcaagtggcagattattacgagacgctgggtgtggaacgcggcgccagtgacgacgagatcaagaaggcataccgcaagctcagccgtaagtaccaccccgacatcgcgggccctgagttcgaggacaagttcaaggaagtgaacaacgcctacgatgtgctgtccaatccggacaaacgccgtatgtatgattcgggagtcgacccgaacaacccgaacgccggtgccggcggcttctccggggcgggcttcggcgatatgagcgacgtgttctccacgttcttcggttccgcgttcggcggtggctcacagggcccggtgccgcgtacccagcccggccgcgatgccttggcctcggcgtccatcgatttgaagacggcggtgttcggcggcaccgcgcatgtcaagatcaatacgttctccctgtgccaggagtgcggtggctccggtgcccagggcggcgcacagccggtcacctgccccgactgccacggacagggattcatgcagaaggtcgtgcgcaccatgctcggccagatgatgacctccgccccctgtgaacgttgcgagggccacggtaccatcatccagaacccgtgccccagctgcatgggccacggccgtgtgcgcaccacgcgtaccgtgggcgttaccgtgcccgccggcatcaacgacaacgcgcgtctgcggttggccaaccagggcgaagtgggtgagggcggcggcgctgccggcgacctgtacatcgacatccgcatcaaggcggataagcagttcacccgcgatggcgacgacctgcactgctggattcaggtgccgatgagctgggccgtgcttggccacgatctgtccattgatacgttcgatggtgagaagaccgtgtccatcccggccggctgccagactgaggacacggtgacgcttaagggactgggcgtcacgaacatccgcaacaaggacgagcgcggcaacctcatcgcccacgtcaatgtgcttatccccaccaagctcaacgaaaccgagcgtggcctcatcgaacagttcgccgcctcgcacgattcaggcgccacgcacgtctcccaggcatcccgtccacaggccggtcaaaagaaaggtttcttcagcaagttgaaggacgcactgagctgagagcggatgcgttcttggctccccctctgaggggagccaagtctgttacttcagcagggagcggcacatggagcggtattcgttgacgtagccgccgccgaagaagacgcagtggccggcgatggggtagagctgccagagcgtgatgcgctcctgccatccggccttcaatggatgtacggactggtagccctcggtgatttcgctcagatagctcataccgaacaggtgcagcatagccagatcctcctcgcgatgaccgccatgtgccgccgggtcgatgagcacggcctcggactgcccggaatcggcggtccacatcacattgccgctccacagatcaccgtggatgcgcgccggcttgtcggccgcggcgcggcccatcagatccggcagcgcttcaatcacacgctcagtcaactcgacatcgcgcttatccagctcgccacgtttcacaccaaggttgaccatcgggcgcagacgtccatcagcgaaatagctgatcgggtcggtccactcgccggtatccattttcaccgggtcctgcaatggtccgaaatagcatgtgccgttatatccgtcaggcgcagacccgaaatacttggcacccgcatcatgcatacgggccagagccgcgccaaaagctcgtgccgcctgaggcgtgggggacgcgctgcccacacgttcgatatccagataatccttgccccagccgtatacctgcaccacgcgcgggccgccttgcgcatgagccgctcccaaccattcgagtcctcgaccctcgcattcgaagaatccttccggtgcgaatgccctgcttttgcgatacgtggccataatgctcccttcgtcgcttacgtactatatccactttcattgtagaagccgcggatgttaccgattcttagtgttgttctacacccccttgggtagggtgttcatcgtcataacacatcaaatacttagaaatcacgaggggttatgaattttttccaagcgatcattctcggcatcgttcaggcgctgaccgagtatctcccggtatcctccagcgcgcatatccgtattttcggcgatttgatgctgggctctgatcccggtgcggcgtttaccgccatcatccaaatcggcaccgaacttgcggtgattctgtatttccgtcacgacatcatcaatatccttactcactggttcagctgcctgttcggcaagaacggcaaggattggaaggcccgcatgggccgcggcgacaattacgccacactcggctggaacattatcgtcggctcgattccgattattatcctcggcttcactctgcagaacgtcatcgaaacctcgttgcgcaacctgtggattacggtaaccgtgctgttggtattcggcattctgctgtggatggtggatgccaaggctcgccagaacaaaaccatgaatgatatgacgtatcgtgatgcattcctcttcggtttgggccagtccatggcgctgattcctggtgtgtcccgctccggcggcaccatcaccgtcggtcgcgcactgggctacacgcgtgaggccgctgtacgtctgagcttcctgatggccatccccgcggtgttcggctcaggtttgctcgaagccatcaaggccgtgaagaactacaaaaccgatgcgatgttccccggctgggggccgaccctcgtagccatggtcatcagcttcgtactcggctacatcgtgatcatcggattcctgaagttcgtatcgaacttctcctataaggccttcgccatctaccgcatcggtttggctgtggtcgtcgccttgctgctgattgtgggcgtgctgccggccatcgatccctccgtggtggctgcggcataagacgggtcgataggcgactcaatataatggtgctcccgccggcgggagctgtcagcgaagctgactgagggtggtcactggaatatgccagcagaaccaccctcagtctcgctacgcgagccagctcccgtcagcgggagtattgtgtgtatagggctaattgcccatctggcgtagaaacgcttccgcttctttgaccagttgttcagcctggggcgctcccaatgaagcctccgcctcggctttctgctgcaagtcgtagtcgtgctccaaatgctccacataatcatgaagctggtcattgcaacgaaccagtatcgatgcctgcgccttccactgctcggctttctgcttcaggtctgccgtatcgaaaatgaagccgatatacttgcccaacgcatccagcaatcgtatagtgccggcagagcattcgtcgctgcccaaatattgggggatggacacccacatcgaggaatgagcaaatccttgttgtgcggcagctacatccagaacagtaggaatgcccaccgggccgttatacgaccggtctccttcgcattgacagtctccgtcgctgacggcgatgggcaacggacgggtatgcgggcaatcggagaacatcgaacctaacgtaatgatccgattgacatccagctcatcggcaatggccagactctggctacagtattccttccaccgatagtttggttcgggggcgatctgcgcatagatacgcttgcctgcgtccaacgtgatgtcgtagaacgtggtctgtggccagataagattggtgcgacccgaaacatggcacagcataggacgggcaacctgatagtcatagaaatcatcacatctaatatgacgaatctcgcgggactcatatcgcttgaccagatggcgcaccgcgttcgtcgccgcctgacaggcatcattccatccctcgaatgcggcgatcaatactgcgccggtgtccttcgctgcttcactcatacctctagagtaactggaattcattgcccgaagcgcacgctttagccataagcgagagtatgcaattacaggcgacacgccgcagctggacgaactacacgcatgtgagtatagtaaacactcgtgcttcggtagggagacctcgccaaggaaacacacgcggacatagcttagttggtaaagcgcaaccttgccaaggttgagaccgcgggttcgagtcccgttgtccgctctaggtccgtgagttgacagaccttacggtgggttagccaagcggttaggcagcggcctgcaaagccgtatagacgagttcgactctcgtacccacctctcagaccagcgaagcaattcaatgggatgaaatatgacccgggcggttggcgcagtggtagcgcacttccctgacacggaaggggtcacaagttcgaatcttgtatcgcccacgaaagtcgaagcaattcgactggatataactgaagaaccgagtattcgggcgattggcgcagcggctagcgcacttcgttcacaccgaaggggtcgtaggttcgattcctacatcgcccactggattccgcttctcacggcggattcctttgcggacatagcttagttggtaaagcgcaaccttgccaaggttgagaccgcgggttcgagtcccgttgtccgctccacaacgaaacctcgcttcggcgaggtttttttcgtattggttcagatgctggtggtatttgtcgcacgcccaacctatcgtgtcctacgttgattaaccagtccaggcctgcacattagtaccgtgggccccgatagcaaaggacaaatcatggcgcaagctaccatctccataaccgtcaacggcgaagcgaaggaggtggaagcaaccaccaccggcgtagaactgttcgcggaagacaagaacatcatcgcggtcaagatcaacggcgagaaccgtgacctgtacacgccgctgaacgatggcgataccgtcgaccccatcgccctcgactccgaagacggcctcgcaatcatgcgtcactcggccacccacgtcatggcccaggccgtgcaggaagtctacccgaacgccaagctcggcgtcggccccgtcatcaaggacggcttctactacgacttccaggtcgaccagcccttcaccccgaacgacctcaaggacatcgagaagcgcatgcagcgcatcatcaagtcctcccagtccttccgccgccgttccgtgaccgaggaagaggctctgaaggaagaggccgaccagccctttaagatcgaactgatcgaagacaaggaagcacacctcgacccggccgccgccaccgagatctccgaaaaggagctcagcttctacgacaacgtagaccgtgatggcaatgtggtttggaaggacctgtgccgcggtccgcacctgccgaacacccgctacatcaaggccttcaagatcgagcgttccgccgccgcctactggcgtggttccgagaagaacccgaccatgcagcgcatctacggcaccgcatgggccaccaaggaagacctcaaggcctaccagacccgcctggaagaagccgccaagcgcgatcaccgcaagctcggcgccgagatggacctgttctccttcccggatgaaattggccccggcctggccgtgttccacccgaagggcgccgccgtgatcaacgcgatggaggactactcccgtgagatgcaccgcaagcaccactacagcttcgtgcagaccccgcacatcaccaagggcggcctgtacgagacctccggccacctgcactggtacaaggacggcatgtacccgcccatgcacctcgacgaggagaaggacgcggacggcaacatcaccaagccgggcgccgactactacctcaagccgatgaactgcccgatgcacaacctcatcttcaagtcgcgtcagcgctcctaccgcgagctgccgctgcgcctcttcgagttcggcaccgtgtaccgctacgagaagtccggcgaggtccacggcctgacccgcgtgcgcggcctcacccaggacgactcccacatctactgcacccgcgagcagatgaaggacgagctcaccagcctgctcaccttcgtgctgaacctgctcaaggactttggcctgaccgacttctacctcgagctgtccaccaaggacccgaacaagtacgtcggctccgacgagatctgggaggaggccaccaacacgctcgccgaggtcgccaaggaatccaacctcgagctcgtcgacgatccgtgcggcgccgccttctacggcccgaagatctccgtgcaggcccgcgacgccatcggccgcacctggcaggtctcgaccatccagctcgacttcaacctgccggagcgcttccagctcgagtacatcgcgaaggacggcacccaccagcgtccggtgatgattcaccgcgccctgttcggctccatcgaacgcttcttcgccgtgctgctcgagcactacgcaggcgccttcccggcgtggctggcccccgtgcaggtgctcggcgtgccggttgccgacgagttcgccccgcatctggccggcttcgtcaagtcccttgaagatgagatggtccgttgcgagatcgactactccgacgatcgcttcggcaagaagattcgcaacgcctccaagtccaaggtgccgttcatcctcatcgtcggtgaggaagacatgaacaacaacgcggtcagcttccgcttccgcgacggcagccagctcaacggcgttccggtggacaaggcccgcgagcagatcctcaccgtcatcaagaagcgcgtccaggtgaactccgccgacgacttcaacgccgctgtggctgagtgatgtgaatggtactggctcccctctctgaggggagctgacgccgtaggcgactgaggggagtcctgcatggctcgcactcccttcagtccgtttcacggacagctcccctcagagaggggagccaagaaagggtgcgaaaatgactgacgtgcgtgtcgataatccggcggactttccgcctcaggaggacacggtcgaacgactgtggactccgcagcgcatgacctatgtgctgcgcaacagcgaggatcgcccaaccaagcccaagacgaaggaatgcccgttctgcgccggacccaaaaaatccgacgaagacggcctcatcgcctggcgtggcacgcacgtgttcgccatcatgaacctctacccatacaatgtcgggcatctcatgatttgcccgtaccgtcacgtcggattcatcaccgaactcgacgatgccgaactgttcgaattcgagaaggccaccaccctcgccatgaaggtgatggagaccgtctcccgtccggacggatacaacatcggcatcaatcagggcgaggtcgcgggtgccggagtcgccgcgcacctgcaccagcatgtggtgccgcgttggaatggcgatgcgaacttcatgcccatcgtcgcccagacgcgtaccatgccgattctgctgtccgaccagcgagacgcctatgcccaggcattcgaacagctggccccgcagtatcatttgccgcttgcctgaccgggtgcggcacccgcgcaaccggttttatcggtacgcgcaataagacaatcatcggaaacattacgggtatgtctgattaacggcctacaatcgtttcgtttgacatcatccgtttcaataattgctaggagcattatgtcaggtcattccaagtgggcgaccaccaagcacaagaaggccgccatcgacgccaagcgcggcaagctcttcgccaagctcatcaagaacatcgaaatcgccgcccgcctcggcggcggcgacccggacggcaacccgtccctgtacgatgccatctacaaggccaagaaggcctccatgccggccgacaacatcgctcgcgccgtcaagcgtggtgccggtgctgaagatggtgccgccaactacgaagacatcgtctacgagggctacgctcctgccggcgttggcctcatcatcgaatgcctgaccgacaaccgcaaccgtgcggccgccgaagtccgttccaccctgaccaagggcaacggctctctggccacctccggctccgtgtccttcaacttcgagcgcaagggccagattgtggtgccgtccgagggcgtggacttcgacaagctgttcgaaaccgccgccgaagccggtgccgaggacgttaccgatgacggtgaagtgttcaccgttgtgaccggtccgtccgacctgttcaccgtgcgcaaggctctgcaggaagccggcttcgactacgattccgccgaccaggtcatgcagccgaagaacgaggtcgagttgagccttgaggatgcccgcaaggtgtccaagctcatcgacaacctcgatgacctcgacgatgtgcagaacatctactccaactggaccgcttccgacgaggtgatggcccagctcgacgaggagtaatcctcgtgattatccttggcgtcgaccccgggctcacacgttgcggggtcggcgtgatcgaagccggcgagcaccgccggctttcgtttattcacgtggacgtggtgcggtcctcaccggatatcacccaggatctgcgtctactggccatctacaacggcctgtccgagaaaatggaccgattcgcgccggacgcggtatctatcgagcgtgtgttcgcccaatccaaccgcaacaccgtactcggtaccgcacaggccgccggcctcgccatgctcgccgccgcgcaacgcaatattcccgtggcgttgcatacgcctaccgaagccaagctggctatcaccggtaacgggcaggcgcagaagattcaggtggagcgtatggtgacacgtattttgaacctcaccaaaatgccgactcccgccgatgccgccgatgccttggctttggccatttgccatgcgctgcgcccggcaggcgcattgcagggcggcgaacgcgaacaacatctgaccgccgcgcaacgccagtgggctgaggccgcacagaactccacgcgccgccgcatcaaccacgaccgaggcatgtagtatactttcgaacagttgttcgagtcttgaatcctggagcgctgaaggagtacctgtatgatcggcatgctgaccgggcgggttgaatcggtcgaaaccgataccgcattgattgatgttgggggagtgggctacgaagtgcgcatgtccgccaccgacctgagccgtctgcacgccgggcaagacacccgcgtcttcacctatatgaacctctctcaggatgccattaccctgcatggattcctggatcgggacgccaagaaaaccttcctacaactcatcaaggtctccggcattgggcctaaagtggcccaatcgttactctccacactgacgccgagtcagttggcccacgccatcgccgacaacgacgccaccgcgctggccaaggctccggggctgggtaagaagggcgcacagaagatcatcctcgagcttaagggctctattgatttgagtcagatcgagggtgcttccgctcaggcggcaacatccaagtctccggtggataccggtacggaacaggttgtcgaaggactgatttcgcttggctggcgtcagcaggacgcccagcaggccgttgccgaggcttgcgccgaaaacgacattcccacgccgcttgccaccgacgatgtgccgcgtgtgctacgtctggctttggcgctgatggataggggccgctgatgagcgagacaacggattacggagcctccaacaccggtgccaacgaagagtcgctgcgcatggtctcctcccagccgatcggcaacgagccggtcagcgacgaggagctgcgcccccatgttctcggaggctttatcggacagccacggctcaaggcccagctgcaactgttcctggacgcggcccgcaaacgcgatgtgccaccggaccatattctgcttgccggccctcctggcttgggcaaaaccacgttggccatgatcgttgccaatgagcttgaagtgccgattcgcgtgacttccggccctgcggttcaacatgccggtgatcttgcttcgattctgagctccctcgacgtcggcgaagtgctgttcatcgacgagatccatcgtctgccgcgcgccgccgaagagctgctgtatatcgcgatggaggacttccgcgtcgatgtgatggtcggcaaaggcccgggcgcaagctccatcccgctgaccctgccgcgattcaccgtcatcggtgccaccacgcgcgaaggtatgctgccaagcccgttgcgcgcacgctttggcttcaccgcacatctcgacttctatccgcatgaggagttggaaaagctcatcgaacgttcggccaacgtactgggcgtaaaccttgatgcgggttccgctcatgagcttgcgttgcgttcgcgcggcacgccgcgtatcgccaaccgattgctacgccgtgtacgcgactgggccatcgtccacgacctgatcgtggtgcggccggacgacgtcaaggaggcgctggccctgtaccagatcgactccgaaggcctcgaccggctggacatcgccgtgctcaatgccatcgtgcgcaacttcaacggtggacccgtgggcctgaacaatctggcggccatggtgggcgaggaatcggaaaccgtggaaaccgtgtgcgagccgtatctcgtgcgcgaaggttttatgattcgcacgcccaaaggccgcgtggctaccgagaaggcatggcagcatttgggaattacgcccaaagatgatgtcagcaagctcttctagactttctcctgtttgcacactcggcagcgtttcgtcaatgtcgctcgtttgaaggagttgtttcgtggaacaacagtacattatgctcatcgtgatcgtcgtcgtgttcggcggcatgatgtggtggcagtccaagaaggccaagcagcaacagcaggagaagcaggacttccgtcgcaacctgcagcccggcaccgaggtcatcaccatcggccaggtgatcggcaaggtcgtcgaagtcgacgagcagtatgaggagatcgtcatcgactccgaaggctccaagctgcgtttcggcttcaacgccatcgcccgtgagtacacccgcccggcctatgtgtccgatgatgaggtcgacgagaacggcaacccgctgcccgacgaagacaccgaggctccggctaacgatgaggctggtcaggttccgatcgaggcgtccgtcgtgtccgaggaagacaccgctgacgagaccggtgacgacaacgaaaccaagacgaagtaagctgttcgattcggtagcaccatccgcgtatcgcatcgcaaaggcataaaaggggcgagcactatggcacagtcggacatcaccatcgacgcattgagcaaggtagggcaacaggacgccgaatatctggtgtccttggtgcgttccgtaccggggtttcccaaggaaggcatcatcttccgtgatttcatgccagtgctcgccgaccccaagggcttgaagattctgctcaaagcacttgaagaggccctgccggtgtccccgagcgaattcgactccattgccggtctcgaatcgcgcgggttcctgttcggcccggccatggccgcccatttgggcaagggtttcatcgccgtgcgtaaggccggcaagttgccgcctgaaaccatcggtgaatcctatgacctcgaatacggcacggccagtgtcgaaatcgaaaccgacgccgtacaggcagggaagcgagtgctcatcgtcgatgacctcatcgccacgggcggcaccgccaaagccgccaccgaccttatcgaaaaggccggtggcaccgtggtgggcttcagtttcgtgatgcggctcgatggcctcgacggtctggataagctcgacggcaagcccagcagctcgctgatcgcgatgccggcctgagatttcgtctcacccaacgtacagtcagttttcaaggtccggcatgtactgtgtacagttacatgccggaccaattacatagtcagggaaggatcgatggatctttacgaataccaggcgcgtcagctgctcgaggaacaggacattcccaccccggacgccatctttgcccagaactcccatgaagtcgctgaagcggcggacaaaatcggctatccctgcgtaatcaaggcgcaggtcaagatcggtcatcgtggtcaggccggcggcgtcaagatcgcccataaccgcgacgaggcgattcttgaatccgagtccatcctgccgatgaccatccacgggcacaaggtttccggcgtgcttgtagccgaagccaagaacatcctgcacgaatactacgtgtccatctccgtggaccgcacctcgcgcgacttcgacgtgctggccaccgctaacggcggcaccgaagtcgaggaaatcgccaaggaacatccggaggccgtcaagcgcctgcacatcgatgcgctcggtgacttcgacctggccgctgccaccgaaatggcacagagcatcggcttctaccacgcggacgtcgatcaggccgcacagattctgctcaagatgtggcgctgcttcaaagacaacgacgccacgctcgtggaaatcaatccgctcgccaagatcggcgacccggatgacgaatccaccaagcagctgagcgccttggacgccaagatctccttggatgacaacgcctccttccgccatgacggctgggcgcgtttcgtggatcccatcgttcccgatcccttcgagcagcgtgcccgcgaacacggcctgcactacgtgcacctgcacggcgaggtcggtgtgatcggcaacggcgcaggactcgtcatgagttccctggatgccgtctccggcgctggcgaggaacagggcaccaacatcaagcccgccaacttcctggacatcggcggcggcgcctccgcagccgtcatggccgaaagcctggagatcgtactgtccgaccctcaggtcgaatccgtgttcatcaatgtctatggcggcatcacctcctgcgtggaagtcgccaacggcatcctcgaagcggtcgccaagctcggcggttccaagccgatcgttgtgcgcttcgatggcaacgccgccgccgagggtctgcatatcctcgcctccgccaataacccgaatatccatgtgtccgagaccatggaaggcgcggcagccaaggccgcgcagctcgccggtgaggcgacccagtccaaggaggttcgctgatgctgttcatcgaagacggcgctcccgttatcgtccagggcatgaccggccatcagggcatgacccatacggctcgcatgctcaaggccggcaccaatatcgtcggcggcgtgaacccgcgcaaggccggcacatccgtcaccttccccggtgccaagaacggtgccgacgcgaacatccccgtgttcgccacctgcggcgaagcacgtgaagccaccggcgccaaggccagcgtggtgttcgtgccgccgaagttcgccaagtccgccgtggtcgaagccgtcgaagccggcatcgaactcatcgtggtcatcactgaaggcattccggtggccgattccgcatacttcgtcgaactggcgctcaagaagggcgtgcgcatcatcggaccgaactgccctggtctcatcacgctcggcaaccccggcgtcaatctgggcatcatccccgacggcatcgtcggccgcggcccgctcggactggtctccaaatccggcaccctcacctaccagctcatgggcgaattgtccgatatcggcttcaccgcatgtctcggcgccggcggcgacccgatcgtcggcacgacgctgctggaagccctgcaggcattcgaagccgaccccgacaccaaggctgtcatgatgatcggcgaaatcggcggcttcgccgaacaggacgccgccgcatgggccaaggagcacatgaccaagccggttgtcgcctacatcgccggtttcaccgcccccgaaggcaagcagatgggccacgccggcgccatcgtctccggaggcaagggcaccgcccaggacaagaagaacgcgctcgaggcggcgggcatccccgtgggcaagaccccgggccaggccgccgaaatcatgcgtgacgtactcgccaaggccaacatcgactgatcggttccaaccaatcgtgatgaaagccgtgattcgccaatgggtgcggggagccatagtcgccctcgcatccatggccatctatgccgttgcattaggctgctatacagcgctgatgttattggtcgtctctatggaagagggcggcgacaatctcaccgtcggcacaacctcgctgacacaggccgttgtgcttctgagtgagggatcgggctttagaaccgattcgttcaccctcaccattacgccattgctgttgaccatactgctgatatggctgatcaatgcactcatcatgcgaatcaaagcatacgggccgcatgcgtatgttgccggattgattgtttggctcgggttgaacgaggcattccggcaatccgtgcacctaggtcttgtcgatgaccagtggctggtgttgctgaaagcagccatcgtattctcgatcggtttcctatgcgcagccgtaccggaatcagccaaaatgcgagcattcagggactggactcgcaagcaggtgccggcggacatacgccactgcctgaaaatcggcgtcgccttggccgtcgcgatactgagcatatatctggcaattggattgattaccgtcatcgtatggtcggtacgcaaccatgccgctgtcgtatcgttgttcgaattgtccgggatggaaaccggttcacgaattctcaccaccgtcgccatgctgatctggctacccaacgtcatgctctgggctgtttcctggctcttcggcggcggattcgccatcggtgatttggccagtttcacattatggctcggccaatccaaagagcttcctgcaattccggtattcggtattctgcccgaaccggtcagcagcgaactatggcgtaccgttgccttgaacgcgcctctcgccatcgctgcgctcgtgggcctgctggctgtattcctaccgcaaggattcgcctgcagaccgttgaatatacggaatacgtccacccgcggcccagtactggtttcgctgatctactccgccggggcattctgcctgagcgcgatgctgatctcactggcatccacattgctgttcgctctgtccaatggatcgcttggcgatcatcgtcttgctcacataggcgtcgacgtcatggcctccaccagagtcgtcggtcattcgaccgcactgggacttaccgcggcgtggctgctcgcgctgattggcacagcgctcgtttttccgatagtctggttggttgagagaatcaaggattcccgcaccaccgccgcgacctcgaagaccgccaccgttcgtcaggcgcggttcctagcgtcacaaccacaagaatccaaggaggaacaggatgacaaacacgaaccgaccgatacgtcgagcactggtctcggtctttcataaggaaggcatcgaagtactcgcggaagcgttcgtgaaggccggcaccgaagttgtttccactggttcgaccgccaagaagcttgccgaactgggcgtcaaggtaaccgaggtgtccgatgtcaccggattccccgaatgcctcgacggccgcgtcaagacgctgcacccgtacattcacgccggcattctggctgatatgaccaaccccgagcacgccaagcagctcgaggagttcggcatcaagccgttcgacctggtggtcgtcaacctgtacccgttcgccgacaccgtgcgctccggcgccaacgaggccgataccatcgagaagatcgacatcggcggtccctccatggtgcgcggcgcggccaagaaccacgccaccgtggccatcgtcaccgatccggccgattatgcactggtcgcctcccgcgtggccgacggcaccggcttctccttggacgagcgcaagtggcttgccgccaaggccttcgcgcacaccgccgcctatgacgccaccatcaacgagtggaccgccaagcactggcccaagccggcctctctggacgccgtcgaggtggacaaggacgatcagggcactgaagtcgattccgccaagttcccggcccagttcacccgcacctgggatcgtgcgcacaccctgcgctacggcgagaactcccaccagcaggccgccctctacatcgacccgctcaaccagaccggtttcgcccacgccgagcagctcggcggcaagccgatgagctacaacaactacgtggatgcggacgccgcctggcgcaccgtatgggatatggctcccgccattgccgtggccgtagtcaagcacaacaatccgtgcggtctggccatcggcgcgaccgcggccgaggcccacaagaaggctcacgcctgcgacccgatgagcgcctacggcggtgtgatcgcctgcaactccaaggtcacccttgagatggccgaaagcgtgcgcccgattttcaccgaagtcatcgtcgcccccgactatgagccggccgcgctcgaactgctgcagaccaagaagaagaacctgcgcatcctcgaggtggccgagccgccgaagggccacgaggccatccgccagatcgatggcggcctgcttgtgcaggacactgatctgatcaacgccgtcggcgacgatccggacgcctggaagctcgtggccggcgaggccgccgacgctgacacgctgaaggacctcgtgttcgcatggcgtgcaatccgctgcgtgaagtccaacgccatcctgctggcccacgaccaggccacggttggcatcggcatgggccaagtcaaccgcgtggactcctgccatttggccgtcgagcgcgccaacacgctggccgatggtgccgatcgcgccaccggtgcggtcgcggcatccgatgcgttcttcccgttcgccgatggtgcccaggtgcttatcgacgcgggcgtcaaggccatcgtgcagcctggcggctccatccgcgatgaggaggtcatcgaagcggccaagaaggccggcgtgaccatgtacctcaccggcacccgccacttcttccactgatcgggactctctgaggggagcagctcagccaaaacgcacaaaggtgggattccgcctgacccgtcaacgggtccaagcggaatcccacctttgctattcgcctgctattgtggtcacgtaaccgttcgacagaaggaatcgcaacatgcacaaccatccctatgtatccgaagcacatgagggcaagccatggtttgaatggtgcgtactcggcgtcgtcgccgtcatcacactgctggttgctttcggatatacgatggccgccacggtcatacttgccgtgacggccatcatcaccgggcttgttcgcctgattcttcaggacagaagcccatggaaagtgcgctcagtggcgttcgactccttcatcggcatcgccttgggaatcggcctgctgattacctacttcagcttctttggactcttcggcaacatctttttccgctgaatcgccatcagacgaggcggcctgatcgaagaattcgccatcgtcgagcgtgtccgcgtttgcatcggcatccgtctgcggaagatcggcggcagccggcactttgggagtggtcatcatctgcgcgatgatcatgaccaacgccaccacagcggcggccaagaccgggctaatccagaatacccacagctgctgcagcggattttgcgtaagaccctcattcatcgcggccagtgcgatgccggtggaacgggcgggattgagaccggcaccggtaaccgggtagctgatggcggtggccagaccataggcaagacccatggcaatgacatgacggtccgaggactcgtcgtgatcacccagagaagacatggcggtggcaacgacaatcagagaggcaacgacctcgacgacaatcgccagcgtaatcgagaacgtaatgccatactgggtcagcagcgagtaagacacggagccgttttcgaaaccgttaacggccggagtcagccacactttggcagctacctgctcggatgtgggcagcagcttgaccacggcgaagccggcggcgatggcaccgatgacctgagcgatcacatagaggatgccatccaggattttcgtcttggaaaccagcacagaggctacggtgatggccggattcagctggccaccggacacgcgggagaagatggcggtgactgcggcatatgccaagccggtagccaacgcgaagaacacgatattgatgccatacacggccgaaccccatgtggagaaggcgtaaatggcaaagcacagcaggaagctgccggccaattcggcgcacacgcgcagagccagcggctgttgattggtttcttccatgattgttcattccttttcatctgtcggaagacgggcgaacccgcacaaacggttgccagtctagcagcagtcctacgttgcggtatgatatataggttgggattggctgggattccagtccgccaactctgaagtatgtatacaaatcgacagtctctgcgatgacagaatctgtccggccacgttgggagaacgatgccaaacgcatattcccgcgctgcgaaagcgcaagacgattccaattccattcgactccagaagctgcttgcccaagcgggattcggttcccgccgcaagtgcgaggacatgatcaccgaaggccgtgtcgaggtcgacggtgaactggtcaccgagctcggaactcgcgttgaccctcataagcagcaggtgcgcgtagacggttcgcgcgtacgcgtcaatccgaaccacgtcactctggcactaaacaagccccgcaaggtgctctccgccatggacgacccgaagggccgctacacgctgcgcgacatcgtgggcgacaagtacgagcgcatcttccacatgggccgtctcgactacgattccgagggtcttatcctcatgacgaacgacggcgagctctcgcagcacgtcatgcaccccaagtacgaggtcgagaagacctacgtcgctacgctggaaggcaagatctccggcaccgtgtgccgtcgactcgtgaccaccggcgtgcagctcgacgacggctggatcaagctcgaccactgcgcgatcatcgactcctcgcgtgaccacacgatggtcaaggtcgtgctgcactccggcaagaaccgcatcgtgcgccgtatcttcggctcaatcggcttcccggtcaagcgcttggtgcgcacccagatcggcccgatcaagctcggtgatttgaagcccggttcctaccgcgtgctgtcccagacggaagtccgttcgctgtccaaggaggttggtctgtgattcgcgttgccatcgacggccccgccggcgtgggcaagtcgtccacgtccaaggcgctggccaagtatttcggatacgcctaccttgacacgggcgcgatgtatcgtgcctgcgcttggtggtgcctgaagcagggcatcgatctggacgccgaaaccgtggatgagcgtgtcatcaccgaagcggtgggcgagttcttcaccggcgaccatttcgatatctccgtggacccggacaacccccgcgtattcgccgacgacgaggacatctccgaggccattcgttcctccgaagtctccagccatgtctccaaggtgtcgaacgtcatcccggtgcgcaacgtgctcatcgccgcccagcgcgcctacatcgcccgcgaagcgtcggccgactccttctccgggggtttgggcatcgtggccgagggccgcgatatcaccaccgtggtgtccccggacgccgaggtgcgcgtgctgctgaccgcccgtgaggaggtccgtcaggcccgtcgcaccggccaagccgtcaagggcgtgggtgctgaggatgtggccgcgcgcgacaaggccgattccaaggtcaccagcttcctgaccgccgccgatggcgttactaccatcgacaattccgatttggacttcgcccacacgctcgatctgctcatcggtctggtcggggacgccatcgagaaccaggaatacgagcagtatgccgccaatctcgaaggctatgagctggacgaaggcgatgaggatctgatttccggccgcggtttcacggaaggcgcgcgcaaggccggccccaagccggtgggtgtgctggctgttgtaggccgtccgaacgtgggcaaatcatccctggtcaaccgtatcctcggccgccgtgccgccgttgtggaagacacgccgggcgttacgcgagaccgtgtgagctatgacgcggaatgggccggcaccgacttcaagctggtggacacgggcggctgggaagccgacgtggaaggcattgaatccgccatcgcctcacaggcacaggttgccgtgaccttggccgatgctgtgatattcgttgtcgatggtcaagtgggcatgaccaccaccgatgagcgcatcgtcaagatgctgcgtgccgccggcaagccggtcgtgctggccgtcaacaagatcgacgaccaggccagcgaataccttgccgccgaattctggaagctcggtctcggcgaaccatactcgatttccgccatgcacggcaggggagtgggcgacctgctggacgtcgcgctcgacaagctcaagcaggccgagaagacttccggctacctcacgccttccggcctgcgccgcgtggctctggtgggccgcccgaacgtaggcaagtcgtctctgctcaatcagctggcgcgcgaagaacgtgccgtggtcaacgatttggccggcactacgcgcgaccccgtcgacgaaatcgtcaacatcgatggcgaggactggctgttcatcgacacggccggcatcaagcgacgccagcacaagctcacaggcgcggaatattattcctctctgcgcacgcaggccgccatcgagcgctgtgaattggcgctgatcctgtttgatgcttcgcagccggtatccgatcaggatttgaaggtcatgtccaccgccgtggatgcgggccgtgcgattgtgctcgtgttcaataagtgggacgcgatggacgagttcgacaagcagcgtctcgaacgcctgtggaacaccgaattcgaccgtgtgatgtgggccgagcgtgtgaatctgtccgccaagaccggctggcacaccaaccgtctgacgcgagccatggataaggccttggaatcctgggatcagcgtattcctacaggcaagctcaacgccttcctcggcaaaattcaggccgcccacccgcacccgttgcgtggtggcaagcagccgcgaatcctcttcgccacgcaggcatccacgcgcccgccgcgtttcgtgatcttcgccaccggcttcctcgagcacggctaccgccgctacatcgagcgttccctgcgcgaggaattcggcttcgaaggcacgccgattcagatctccgtgaacatccgcgagaagaagaagcggaagtgacacgcgcgtaatttgccagatttcatatatctggtagattatctactcggtgcttttgcaccatcgggccgtagcgcagtttggtagcgcacttgactgggggtcaaggggtcgcgggttcaaatcccgccggcccgaccgattagcctcggaattccgccacttttgagtggttgtcttccggggcttttccgttttcagacaacataacgacggacttacctttgtaagccattcgtaatggattaaacacggacttcatcttggcgtgttattggaattatcaccgacaattcaccgcctccgcaccccccgtcgtatgcgtttgccccaaacagggactagacttgttcctattgatttgacgaaagggacccgaattgaccgaaataaacgataaggcccaactggatatcaccgccgccggcgacaccgacgccgtcacctcggatacccccgaagaaaccgtaaacacccccgaagtggatgagactttcgagctttcggccgccaagatgcgcgagcatggcatgagcgaaaccgccatcaaccagttccgccatttgtatgacgtatggcgccatgaagaagcctccagctggattcgcgaggacgacatcgagccgcttggccacgtgcccagcttccacgacgtctatgagaccatcaaccacgacaaggccgtggacgccttcgccaaaaccgcattcctcaagctcaatggcggtctgggcacctccatgggattggacaaggccaagtcgctgttgccggtgcgtaggcacaaggccaagcagatgcgcttcatcgacatcatcatcggtcaggtgcttaccgctcgtacacgcctgaacgtcgagctgccgctgacgttcatgaactccttccacacttcggcggacacgatgaaggtgctcaagcatcatcgcaagttcagccagcatgacgtgccgatggaaatcatccagcatcaggaacccaagctcgtggccgccaccggcgaacctgtgagctaccctgcgaacccggagctggaatggtgcccgcccggccacggcgacctgttctccaccatctgggagtctggtctgcttgacgtattggaggagcgcggcttcaagtatctgttcatctccaattccgacaatctcggtgcgcgcccctcgcgtacgttggcccagcacttcgaaaacacaggtgccccgtttatggctgaagtggccatccgcaccaaggccgatcgcaagggcggccatattgtgcgagacaaggccactggtcgcctaatactgcgtgaaatgagccaggtccatccggacgataaggaagcggcccaagacatcaccaagcatccttacttcaacaccaactcgatctgggttcgcatcgacgctttgaaagacaagctcgccgaatgcgatggtgtgttgccgttgccggtgattcgtaacaaaaagaccgtgaatcccacggacccggattccgaacaggtgattcagctggaaaccgccatgggtgccgcaatcggtctgttcaacggttctatctgcgtccaagtggatcgtatgcgcttccttccggtgaaaaccaccaatgatttgttcattatgcgttccgatcgcttccacctgacggacacgtatgagatggaagacggcaattacatcttcccgaacgtcgaacttgatccgcgatactacaagaacatccacgatttcgacgaacggttcccctacgccgtgccatctttggccgcagccaactcggtttccattcagggcgactggacattcggacgtgacgtcatgatgttcgccgacgccaaactggaagataagggcgaaccaagctatgttccgaacggcgaatacgttggcccgcaaggcatcgaaccggacgattgggtgtgatttacaacacggtcgaacgataaaaaagatattatttttgtgaaatggcgctcaagtgcggaaaaagcctctaagatagagtgagtgtggggaaactcatacgcacttataacgaaacagtaactatacgtgaggactaatggcagagggcacaagcggacgtcggcgtttttccgacaaatggggcaagcacgagctggacgtactggctgtgttgtcatccgcgttcccgcaatggctcacatcccgccaaattgcgcagcgcgtcaaggcttacgccgactcgtatggagagctggcagatcaggccgccaaggccgcgttcgccaagcagttccagcgtgatcgcgccaagctcgccgctatgggcatcgccatcgaatcacggcagcctgagtattcgtccaagtcggaaggccaggacttcgcgtcctaccgtctgcagttgggcgacgaaccgcgcgtccgtctgatgttcgagccggaagatatgccggtgcttgccgccgccaactatctggctcgttcgatgtcgatttcctccgagccggatcagtcccagctcgcccaacatgcgtcgcgcaccacgccgcgtgtgccgcagacccctattcccggtctcggtttggattcgattgcgcctggcttgggcacgcagcccattccggactcgctggtcaaggttatcgattcgcgtcgctttgccgccaccgttgatgtggacggcgaacacctgaacgtggcctacaccgattccgacgatttggccatgtttgtgctggagcatccgggtgccacgattgtcagcccgcaggaggctgtggacgcctatcatcgccgcctgcacgccgccagccgattcactttggccgacgaatccgccagccctgtaagcgcctcggtggtttccccgtcgattagtcgcgatgttcgtgagccgggtgatcccgagtcgatcaaggcccagaacaagaagaacggatccgctttccaaacgggcagcgaggtggatcgtcgcctgcgtctgatgctgttcctctccgctcacctgggtgaggaattctcgatgagcgagctggccgagcgctttatcggcaaaccgaagaacgacgacgagctcaagaaattcgtcaacatcattcataaggacatcaacaccctgaccaccgtttccgacgatggtgagatggctggcagccagttcttcgatatcgactggccgctgctggatgccgagggtattgtttccgccaccaattcgttgggtcttgaacgtcttgccggcatttcgccgcaatacctcagcatgctcaccgcctcggtcagctacttggcgcattcgccgttactgccggacaagcagcgtgggcaggccgaatccctgtatgagcgtttgcgccgccatgtcagcccgggccagaccccgtggctgagcctgaccggctatgagctggagccccgaagcttctccatcgtcaagcgcgcgatcaacaccgattcgctgttggacatggagtactccgacggtaccggtagtacccgtcgcaagctggtggcccccgccaagattttcatcgacgaaggcgtgtattatgccgccgtctacacggatgtcggttccgccgcccctaaggacaagaaggcctacgtctccaaagacaagaccatcgacaaggcgaacggcaagccgcgcatctggcaggtgctgcgcttggcccgtatcgaaaaggcggaactggtcaagcccaccaagcagatcaacattccgaacatgccggtgagcgaattgcgcaagtggagtttcgacaacggtaccgacgcggtgttcatcaccgatcagcgcgatctggcattcatcaagacattgccgggcgctaccgtcgaacaatgcggtgccggtgaaaaggtgcatctgaccgtttcctccgattcctggttcgtggccttctgtattgcccacgcgcgtcatatcacggcggtcgccccggaaacgttgcgcaccatgatcgtggcacgcgccgaacgcgaactgagcatcagcgagaacaagtaaggagcctttcatgccttggtggatatggctgattctggccctgttcatgctggccatgattgttgccggactcatctatgcagcccttcatggactccgtgccttgaaagacatgtccgacatcggcggccaactcggtgaacgtgtggccgcgatgggggagcccgtcacttctgccgacaccagcgagccgcctctgttcactcagccgctcagcgtggcacagaatcgttatgccgaggcccatgcggacgtgattcgcagcaaggccgccaagcgcgaacgccacacccaggcatgggcccgctggaagcgattcaacaactaacggaaagcagcaatggcacgtcaccaacaccataagggtaatgccgattcccagacgctgagcccttcgcagcggtacgcatcattccaaaaagtccagcgccatcgggcgtccgcagcagcacgattcgccgaatccctgcccttcgaactggacgacttccagaccgaagccaatgacgcgctcgaagccggcagcaacgtactggtcgcggccccaaccggtgccggcaaaaccgtagtggcggattttgccatttacctcgcccaggaacgcaacgtcaaagccttctacaccacaccgatcaaggcgctgagcaatcagaaataccatgatctggtcgacgtgtacggcccggacaaggtaggcctgctcaccggcgacacctcgatcaactccgaggcggacatcgtggtcatgaccaccgaagtgctgcgcaacatgctctacgagcgttccaccacgctgaacgcactacgctacgtgattctcgacgaagtgcactatctggccgaccgattccgcgggcccgtgtgggaggaagtcatcatccacctgcccaagacggtcaagatcgtcggcctgtccgccaccgtgtccaacgtggaggatttctccaactggattgcctcggtgcgaggcgacaccaaactggtgatcagcgaacaccgccccgtgcctttggaacagcacgtcatcgtgcaggcggacgaatacactgagcccgaggtgctggatctctatcgccgcgacggcaacggcgagcaggccaccaagctcaacgccgaactcatcaaccggctcgaccagttggaccgcaaggccgcacgccggcgcggcgaggaacgtcccgataagcgcaagggcttcggcagaggccgcggcggcaaaggcgccaagggccatgccccgaaagcggaacgccacaccccgcgccgctgggccgtggtggacgagcttaacttcctgggaatgttgcccggcatctacttcatcttctcgcgcaacggctgtgaccaggccgtggaacagtgtatcaatgctggactggagctcaccaccgatgaggaagtgaccaagattcgccgcatcgtggatgagatggtggaggggcaactcactcaggaagacctgaaagccctgcagttctccaagttccgctttgcgttggaagaaggcttcgcttcgcatcatgccggcatgattgccctgttccgccagatagtcgaacgattgttcgaagaaggtctggtcaaaatggtgttcgccacggaaacactggccttgggcatcaatatgccggcccgctgcgtggtggtagagaaactcgagaagttcgacggtactggtcatgtgggcctgacgcccggcgaattcacgcagctcaccggtcgtgccggtcggcgcggcatcgacaccatcggccacgccatcgtggtcgaccatcacggttttgtacccgccacggccgccgcgctgtcatccaagcgtgtctacccgctgcactcgagcttccgacccacgttcaacatggccgtgaacctgctcaactccagcgactacgagaccgcgcgcgttaccctggaccagtcgtttgcccagtgggaggccaacgaatcggcctggcagctggaatcgcagatcaacacactgaagaacgcactggccggatacgaacaggcgttcgcatgcgaacacggcgacttcaaacagttcatgaccctgcgtatggagctgagcgacatcgaaaaggaaggccgccgcaaactgaagcacgaagtgttcctgaccgatcaggagcgttcacgcgccttccagaaccttgaccagcgcattcgcgatttgcgcaaggcggaacacgagcacccatgccgcaactgcccggacctccagcaacacctcaagtggggccaccgctgggcccgcgagacccgcgaactgcagcgcgtcaccgatcgctacgactcccgtaccgggtccgtggcccgtcagttcgatcgcatctgcgatattctcaccgggcttggttacctcgaacgtcatgtcaatgcggccggccacattgacatgacgttgaccgaaaaaggctcgctgctgcgccgcatctacagtgaacatgacctggaactgtgcgaggcgctgctcgccggcacgttcgacaagctcgacgccaacggactggccgctgtgctctcttcactggtatacgaggccagacgcgggggagacggcgaaccgaggcactacccgggcggcatctccgggcccatcgcaatcgcttcgtccaagctcaagggcatctgtgaagacatcgatatcctgtgcgaggatcacggtctggacgagatgcagcggccggacttcggcattctcgacatcatgtatgaatgggcggatggcggttcgctgggatcgtgcctgtacggcaccgacatgaccggcggcgacttcgtgcgcactgccaaacgactggctgacgtgctgcagcagatcgctgtcgcccagccgctgccgttcgacgggggagagcggctggcaggcctcgcccacgaagcggccgaccgggtcaatcgtggcgtggtggcctactccggcgtggactgacggggggccgtttgatgggagtttgtcagccgacgtcggaagcttggaatagcggccaagtccgaactgttgcgtaaattagtagggttaaagatctttcaaggaggatgccgatatggcagaacgtagcctcaggggcatgagcatcggagcgaaatcgctggagtccgacgacaacgtcgatttcgccgcacgaaacgatgtggcgtatgtatgcccgaagggccaccgcaccatcctgccgtttgccgagggtgccgaaatcccggacgagtgggagtgccgttgtggttccgtggcccaccgtgagggcgacgccgaccgtgagggcgacgagatcagcaaacccacccgcacccactgggatatgctgctggaacgccgtagcgaagaggaactggccaccctactcgaaaagcgcctgcaaatgcaccgtgacggttggattcctgactacgagtgatctcctactgaacaacacgtgaacttgatgcccagtcatcccgactgggcataatcattgttggaacaagtcgcatatcgtttgacgaccattcaaagcagtcgacatgaacaaaggggagtggaatctcaatggcacagcatccgatgaaagtggtcctgttggacctcgacggcacgcttaccaagtccgacggcggcatcatcgcctccgtcgtcaagacgttcgaggaattgggtcgcccggttcccgacgatgccgagctgcatcgtttcattggtccggccatcatcgaatcgctgcgacgcaaccatgtgccggaggatgagcttgaccgggcggtcaccatctaccgcagctactatgcggatcgcgccgtgttcgatgatccgaacgagcccggcaacaaagttcccggccgcttggtgaacgtcgtgtttcccggtatccgcgaacagctgctcaagctgcgtgccgacggctattatctggcgttggccagctgcaagcccgagtaccaatgcgttccgatctgtgagcatttccatctgaccgagctgttggacggcatctatggcgcatccagggataactctcgtttggacaaggatcaggtgattcggtactgcttcgacaaaatcggttttgatgctgcagcgggggacaaggccgtgatgatcggcgaccgctacaccgacatcgacggcgcccacgcctgcaatctggacgccattggctgccgctggggctacgctccggccggtgagatggaagaacacggtgcctacgaaatcatcgagaagcccgagcagatcgaagaagccgtaaaccgttatttccaaacacactgaaacacaacggcgaggacttcttcatgatgggatgcgatggagcctgcgccgcgggcttcgacctggttttcatcggtttgccattgctgtcgctgtatgagattcccatgctgatatggttcatttggcgagcattccactggaaacgagatgacaaggattggctgaaaggcacggcgattcttgcaattgcggtggtcgctccggtgctcctttggctgtcggcctggtatgctccggtgctcctttggctgtcggccttggtatgcgtggactagttgatacaggcgaccgaatccttgtcaaggataactaatctgacataacgtacattatcggttatttaatatcatctttattccggtgagaagcaacacctaaacgcctatccatttcggtttctgaagcgttgcgtgcctgcagatacatggcgatgatttccagcagcaccaacacaaatatgatgattgcaccgggcaattgcgcacgatcatagaacgcgagcatatccgcgtccatcaaatccgctgtaaacgtcaacacgggaaacgggatcagcgccgccgcaaacgacaggaaatgcgttttcaccatcgcccagtcgaccggatcaaccggcggtcgccggcgtctcggcgtgaacagatggcctcggctgaccgttatagtgatgatggacacagcaaagatgacggcgaccatccacagaacgcccggcaacaatccgacaacaatcccgttcacccggtcctccaatcagtcataaatcacctcaacatataaaaaacataaaatggcaggcaacaaaagcaacacatacaacaaagcgacctgccgaccaaagccggcaagtcgccaacaaccatacatgtatcaggcggttgcgcgttgcaagcgctgtgcctcgagcttcttgcgcatcctcatggcagtcagttcatcaatcggacggcccgtggcaatcgtcagcggcttggcctcaagatcaacatattcttcctgttccaaggccgtctcaatctggtgccacaacgaacccaccgacacggcgaacactgccttaccgctttgcaacagttcgagcatctgttcgctggtcgtgcattcatgcacgttttgaccatcgcacatgatggtcacattggccagctgatcggtgctgcgttgagtcaagaatccgatagccgccgtcacgttctgcagattcacaccggcatcaagcaacttcttggatacagcgagaatcaccacatccttaaacgagtatagtcgtcgtgaaccggagccatgagacggcgtgatggacggctcaacaatctgcttgcgtgcccaataatcgagctgtcggtacgtgatgccggccaccttggaggccacagtgccacggtagccgcgcttgatctcctcagtatcgacgttggagaacaactccccctgaatcgcgtcagcgttcagattctgacggtcctcaagcgaaacatgaagatgcagcccggtctgtcccatggcactcccctaactcatgcgtgtctcgcatatgactcacactggtgtaatcacatgattgcaatttctgcaatcagtctaaccccgtgctgggtgtggactattgggaaataatggcagatttcgtgaagaacacgaggcggaatttaccgatcatgatttcgtcgccgttcttcagcgtcgcctgatcaacacgctgacggttcacgtaggtgccgttcagacttcctgcgtcaaccacaaagaactgaccgttgaccctgcggaacacggcatgctgacgggatacggtggagtcgtcgagcagaatatcagctcgcggatcacggccgacggtgatttcatcctcgtcaagcaagtaacgagaacctgagaccgctcccctggcggaaatcagcaatgccgttccctcggacaatctggtgatggtgtccagatcctcttgagtcagcggtcgatcgccggtggtggtaatgggcagtacattaatcgcgggcaggccgataatggtggtttcgcctgcgctaggaatcgggttggtcataatcccctattctaccgtctttgcatactggttttgcgtagcttcgcgtacttcgtcgataatgatgctgtcagaaggctgtacattgacgttggacccgtatttcacctggagctgagcgcccacaccgccggcgatatcgactgcgttggacagttcctgcggattgccaatggccttcaccgtgtatgtgggcttgatggtggtgccatccacgatcaaaccttcctcggcgtcctgaatgtaggtggaggtgatgacgcgcacgttattgatggcgattacctcggcaccggcattgcgaagttcctcgataaggttgaacatgattgaggcgtccactttagtcgtcaagcctcgtccgattcggatggtcacgccttgaccctttgccgggagtctgccggagatcaagccgctggtctcctcgttttgcttggcgatcttacgcgcctgctcctgctcgttagccgccgatttcagcgagttgagctggctgttcaactgggttttacgctgctcgagattggagatttgcgtattcgactcgttcagcagccttaccagttcactctcgtccatcgtttcgtacgtggatttagtgttattgatctggctcatgtaggcgaaacccaacaacgcgcacatcagagcgatgagaatcgaggatagtaaccgtgatttgttgctggcacggttgagatccttccggggcttcttacgcaccgtgggaaacgacccggtttccatccggtcgttgaccttgtcttgtgcatgctggtcgcgcattttctccagcatgttgtctgattgtgctttacgtgccatacgtcagtacccttgtcagcctcggaagatgaagcgtctgatcgcggacacgttggagaagatgcggatgccgagtacgacgatgacggctgtctgcagctgcgaaccgacgccgagctggttgccgaggaacacgagcagtgttgccgtcaccacgttggcgaggaaggagatcacaaacacgcggtcggagaagctgcgctcgaaataggctcgcgcggcacccagcagggcgtcaagagcagcgaccaccataatcggcagataaggctgcacgatgatcggaatgtccggcttgacgaacacgccgatgacgacgccgatgattagtcccagaacggctgccattattcattcctttccgcgtacttcacttcgccagtgactgctgcctcaagtgtaatcgaattggatttgctcacctgcgggtagataccggcttccttgaaggaatcgtaaagacttgcaagtttcttcttccccatcgcttcggccaaggcgctcttatcgcctatggcttcaatggtataggggctttgtatcgcggtcatgccgatgagaatatgcccgccggccttgcgtatcgaggtttgcgcgccgagcctattaccgttgatggcaatggcttcggctccgttttggaacatcagggagaccagttgctgcagatccagatcggtgatgactcggatgttggtggaggtgccgactctcgtcgaggaggattgatccgactggcttgccgcgattggatcggccagcgtcatggtgattccttcgccttcgaccaccgtggcaccattgaccatttcgtcttggataagcgtatcgcttttcacgctgccggatattttcttggactgttcgtcaacttgggagcgcaaattattgacgtccgtggtgagttcgtctatttgcgagttgcgattctccaattgcgtggccaaagtctgccgtacctgcttacgcggatcggattgcaactgttgcacgaataggctgcaggcaaagccaacgccgacgcagatgatgaatacgacgatgcgattaaaccagatggagaaggtcgaacgatgctcatggaccagtcgtgagtcggagaacatcggatccatcggacgattgacaagatcatcgatgagctgaagcgaatcgtcgttggttttacggcgacgtctggtgcggatggcggcggcgtcatccggggaaagcgcatgatgtgattccgcgcctcggactgagtgggagaacacggcgcggcgtcgtaccggctcattctccttgggtacggggaatgagaccggggccgtggcctcaagcgccatacttctcccccagttccttgcgtagcaatccgacgccctgcttggtatagatatatccggcgagccaatacatggcgatgccccagatgccggcggccagcgcggcgatgtagagcaagtggaaaaacgtactggtgcccaaatcggcgaaaatcagaccgacgatggaaatcatcagcagcgcggtaccggccttgcccacgaaatgcacgggcagcggaccataaccgtactgggcaagccatagcacctgaatcgccatccacagatccctcagtcccacgataatcagcatccaccatgggatgatgccggcgacgctgagagccagaatcgagcagaaaatgagcagtcggtcggcgatcggatcaagaatctgaccgatcttgctcacttggttgaatctgcgcgcgatgatgccgtcaagtccgtctgaagccgaggaaatggcgatcagggctagcgccgcaatcatctcgtgcttggatatcagcacgctgatgaaaggaatcgagatgattcgtagcgcgctgatcaaattgggcacggtgaaatagatgtcacgtgcttccggactgtatctggtgttgactttctggttggtcatatcgactaacagtctacatgcgggaggcttgtagagcggtaacgatgatgccgcgtgcgccgacttcgtacaaatcatccatcagctggttgaccttggccttgggaaccatgactcgcacggcgttccactgtttgtcgtgcagcggggagatcgtcgggctttcaaagccgggggtcacggccacggcggcggcgaccttgctgatcggaatgtcatagtccatcagcacatactgatgtgcagtgagcacgccttgcagacggcgggtcagcacggccagacgtgagtcctgctcgttcagacgcggcgaacgaatcaggcaggcttcggagtgcatgagcggttcggcaaacacgcgcaggccggcgttgcgcagggtggtaccggtggagaccacgtcggcgatgaggtcggccacgcccagctgcacggaggattcgaccgcaccgtccagatggatggtctcggcctggatgccgtgctcgaccagatagtcgtgtacgagcttatcgaatgtggtggccacgcgcttgccctgaacatcctccagggtggtgatcggggattcgttcggtgcggcgaaacggaaggtcgaggcaccaaagccgagcggcatgtgctcgagcgcggcggtaccggagttcttgagtagatcctggccggtgatgccgacgtcgatggcgccgcggcccacgtatacggcgatatcgagcggacgcaggtagaacagctcgatgccattgtcgggatcttgcacgaccagctggcgagggttggtgcgcagacggtagccggcctcggccagcatgttccacgcgggttcggatagcatgcccttgttgggcactgcgattctcagcatttgcgttcctctcacaggtgcttgtagacgtcttcgagcgtcaggccgtgcttgatcatcatgacctggacgtggtagagcagctggctcatctcctcggcggtgcggtccgcaccctcgtattcggcggccatccaggtctcgccggcctcttcgatgatcttcttgccgatgaagtgggtgcccttgtcgagctcgtcgacggtcagggagccttcggggcgggtctgggccttttcggacagttcggcgaacagggattcaaacgtcttcatgtgattcagattcttttcttgcggttatggatgaaaggtggattgcggttcaggcttggagctcaggccttgaacgcggcctcggccttggtgcggatgtcgtcgatggcttgggcgggattctcggcgccgtacacggcggaaccggcaacgagcacgtcggcgccggcttcggccacgatgtgcgcggtcttggggctcacgccgccatcgacctggatgcgggtcttcaagccacggcgggtgatctcatcgcgcaggcggcggaccttggccatctggttgtcgaggaacttctggccgccgaagccgggctcaacggtcatgatgaggaccatgtcgaactcgtcgaggatatcgaagatcggctcgaccggttcggccggacgcacggcgaagcaggccttgcagcccatctcgcgcagctgtcgggccagacgcacgggggcgtgggtggcacccatgtggaaggagatggaggcggcgccgagcttggcgtattcgggagcccaacggtccgggtcctcgatcatgaggtgcacgtcgaccggcagatcggtgacctgacagatgcggccgacgatcggctcgcccagggtcaggttcggcacgaaatgatggtccatgacatcgacgtggaccaggtcggcgttggcgatggccttgagatcacgttcgaggttgcagaagtcagcggacaggatgctgggtgcgattgcgatattgctcatggtttcctaccttatctgtgcaatgggacttggagccccgtgtttcgcgctgtttcggcgctgtttatcgtggtgtcacttagtgcgattggtttgctttttctggcgaagttgttcctcttcgatgctctggcgttcgagctcgtcggcggtgaccgccgcaagcccgcgcgcctgcgccttggggtccggcccgtactggtagagcacgacgaacaggatgcagccgagcacgaagacgatgatcgcggtccacacgttggtcctcaggcccaggatcaccgtggaatagttgatgcgcacgttctcgatccaggtgcggcccaggccgtaccacatcaggtacatggcgaactgctggccggccttgagccggtcggcaagcttgtggccgaggtagatgatgagcgcggcgccaatgaggttccagatcatctcgtacaggaacgtcgggtggaacagcgtggtcctgtagtccgggcattgcgcgccagaatagcagatttcggatttgccgatggcgtccgcgtcgttgagcttcaggccccacggcaacgtggtgggccagccgtagagctcctggttgaaccagttgccgagtcggccgatggcctgggccacgggcagcgcgggggcgatggcatcggcgaagatcgcgaacggatagtgcttgtgacggcaccacaggaacgccaccaaggtgccgacggagatgccgccgaagatggccatgccgccttcccacaccttgaggatgttgaccaggttgccggtgggcgggaagtagtcggccggcgtggtgatgcagtggtagaggcgcgcgcccaccagtgcgcagggcacggtgacgagcgtggtgtcgagaatctggtcgaaggtgccgccgtaccgcttccaacgtgtggcgaggatccatacggccacgcagatgccgatcaggatgcagatcgcgtacatgtggatagtgaacgggccgatctcgaacttggagaaggtcggcgagggaatataagccagattcatcgtgcctctacttgctggtgctcatggtgtgtgtccacgcgcgggttgtgcttgacgctctgtgactaccctaccgtgtcacggcacaacccgcgtgaggcgcaccgggtgtttaccgggcgttgtggatgccttcggccagttcctcgctcttggcggcgagcagcttcaagccttccttcgggtcgcgtgcggtcttgttgtcgtccgcgagcagggtgtgcacgagcgcggagccgacgatgacgccgtccgcgtaggagccgaccttggcgccctgttcggcggtggacacgccgatgcccacgcacacgttctcggcaccggcctgacgggtgcgctccacgagcagttcgggcgaggcgtcgatggtggcgcgttcgccggtgacgcccatgcgggcggccgcgtacacgaagccacgtgcgttgcgggccacggtttcgaggcgctcggtggacgagtccggggagaccaggaagatgcggtcgagtccgtggcggtcggaggcttcgatccactcccccgcctcgtccgggataaggtccggggtgatgagaccggcgccgccggcgttctcgaagtcgcgggcgaaacgctcgacgccgtagtggtacacgaggttccagtagctcatgatgagcggcacgccgccggcgttggccacggtttcgacggcctcgaacacgcgcttgatggtctcgccgttgttcagggcgatggaggcggcagcctggatgaccgggccgtccatgaccgggtcggagtacggcaggccgatttccacggcgtcgacgccgtgctcgaccatcgtcctgaaggcgtcaagcgagacgtccgggttagggaagccgtagggcaggtagccgatgaaggcgggcttgttctcggccttgaacttggtgaacatagcgcccgacttgctgggcttgtggctgatgcccagcggctggccggacggcgtggttgcttcgttggtcataatcaaaaatctcctcttcttgttcaggcgacagtattgccgtgggcgccggtcacatcgagcgcggcggcctggtcgtcggtcaggtagccgaaccacttgccggcggtggccatgtccttgtcgcctcggccggagatgttcacgatcatcacggccttgtcatagcccttggccttcagatcggcggcggctttgtacgcgccggccacggcgtgcgagctttcgatggcggggatgatgccctcggtctggctcaggtcgcggaaggcgttcatggcctcctcgtcggtggcccagctgtagttcacgcggccgatgtccttgagccatgcgtgctcggggcccacggaagcgtagtcgaggcctgcggagatcgagtaggtgtcgagcgtctggccttcgtcggtttccagcaggtagctcttggcgccctggaacatgccgagctggccggtgccgggggcgaagcggatggcgtgcttgccggattcggggccgttgccgccggcttcgtagccgtagaggttcacgcgctcgtcgtccaggaaggcgttcatcacgccgatggcgttggagccgccgcccacgcaggcgcagatcgcgtccggatggtcgatgccgtaccagtcctggagctgctgcttggcctcctcgccgatgatcttctggaagtcgcgcaccatggccgggaacgggtgcgggcccgcgacggtgccgagcaggtagtgcgtgtccttgacgttggtgacccagtcgcgcagggcttcgttgatggcgtccttcaggatcttgtcgccaagggtcacctcgaccacttcggcgccgagcatacgcatgcgggccacgttgagggcctgacggcgggcgtcgatctggcccatgtagatgcggcacttgaggccgagcatggcgcacacggtggcggtggccacgccgtgctggccggcgccggtctcggcgatcacgcgggtcttgcccatgcgcttgacgagcagggcctggccgagcgcgttgttgatcttgtgcgcgccggtgtggttcaagtcctcacgcttgaggaagatacgggcgtcgagaccggtcttctctttgacaagtgcggagaagcgcggggcttcggtcagcgggctcgggcggcccacgtaacgctgctggagcgtcatgaattccttgtggaattcggggtcggccttggcttgcgtgtacacgcgctcaagctcgtcgagggcggtgatgagggcctcgggcacatagcggccaccgaactggccccaatacggtccctgatgttcgctgagcggggtcgtttcggatgctttcacttgtgctcctgcctttactagtcgttccactgcaagttcatgattgtcggcggtggccacgccctcgccgaccagtaccgcgtccgctcccgcgcgggcgtagtcttcgacctcgaccgcgccgaatacgccggattccgccaccttgatgacgtcatcgggcagatcggccgcgagttcgttgtatttgttcacgtccaccttgaggttcttcaggttgcgcgcgttgatgccgatcaccttggcaccggccttgcgggcgcgttcgatctcttcgcgggtgtgcgtctccaccagcacggtcatgccgagctcgtgcgccaggtcgagcaggtgcttgagctgggcgtcgtccaatgcggcgacgatgagcagcaccaggtcggcgccgtgggcgcgggcctcgaagatctggtagtcggtgacgatgaagtccttgcgcagcactggaatgtgcacggcggcgcggaccttgtcgaaatcgtcaaggctgccgaggaatttgcggccttcggtgagcacggagatggcgcttgcgccgcccttctcgtactcgcgggccagcgcggccgggtccgggatgtcggacaggtggcccttggacggagacgcgcgcttgatctcggcgatcacggggatgccgtcggcgcgcttaagccatcgtgtcgcgtcaatcggagccggggccgccagcgcggccttcttcacatcctcaagcgatacggtgagctcacgggtgcgctgatcctccagcgctcccgccaccagttcgtccaaaaccgacatggtcctccctttgttggtgttcggtcatgcgccactctaggtcacgtcctgtcccgattgccgaacccgtcctacattttgggctttcgcaggcgattccggcttaggcagaacattggcataaactggcacgcatgtacagacgtttcgcgctcgacttggaatgggacgccgtggctggaccgcacaatcgacggcgcatccttgctcgccggcgtgcggaactcaggcactgcgttatcccgccgcttgcaatttcacgaggtcgccccgctgcagggcgacggcaaacgcctgattcagccgttggattcgaccgagcccatgcgcctgttttgacggaacatctttgacgagagatcgtcactgaatcattgtttgctatatatgtatcacagtgtcataactatgaaatcatattgtggaattgtggtatatgaagttcgcatgacaacgatgtcaccgttggtaggtggaccagtaggtgccgttgctgccggtggtggtgctgaactgccgatgtgattcagtccaccagcccgcgcagcagcgcgatttcgtcgcggtgcgtggtcggcgtctgctccttggtttcgagaatcatcgggagcttggccatggtcggatcgttgaccagtcgcgtgaagaacgggatgccgagctgcccttcgccgatgttggcgtgacggtccttatgcgagccgaggccgaactgcgaatcgttcacatgaatcgccttgaccctggccaagccgatcacctcatccaactggcgcatcacgccgtcgtagtcgttctccaaatcgtagccagcatccaacacatggcaggtgtcgaacgtgacgccgacgttcgccttattctccacgccatccatgatcgtggcgagctcatcgaaattgcggccacattccgtgcctttgccggccatggtctccagaagcaccatgacgccatccgcacgctcgaacacctgattcagcccctcgctaatcagccggcagccggtctcggcgccttggcccacatgcgcgccgggatgaatgttgatatatacctcctggccggccgcgcggatggcggtcagcagctcgatgtcctcggccaacgcctcgatcgcgaatgcgcgcttggcctcatccttgccggccagattgtagacgtacggcgcgtggacgaccaacggcccatagccctcagccttcagacgcgcaccgaacgccgccgcaccggccgggtcgagcgccttggaacgtttgccatacggagatcgcgggaagaacgcgaacgcggtgccgccctcctcatgggagcgttccagcagcgcattccatccgccggccgtcgacagatgcgatccgatatacagttccgtcattccaaattcctcgtgttccactcgctgttcgtgttaccgctatcatatggtaggaggcatcgagcgccgcccgcacaaccgacacgagacacaactgttcacccgaccaaaggagacccgagcatggcgtcagccggcaatcccaaggacgacaccggcctcgaacggaaaatggagtcgcaccacctgacgatgatctccctgggcggcgtaatcggtaccggcctgttcgtcagctccggctatacgattcatcaggcggggccgttgggcgcgatcctcgcttacgcggtcggctccctgctcgtctactgtgtgatggtctcgctgggcgaactgtccgtggccatgccgtatgccggcagcttccacatgtatgcgaagcggttcatcggccccggcaccgcgttcaccattgctatcctgtattggctgaactgggcggtggcgctcgcatcggagttcacggcggccgggctgctgatgcagcgatggtttcctcattcgccgtcctgggtgtggtcggccgtgttcattgtggtggtgttcgcgcatggtatggtcgctggccaaggagcggctgattcccgcgcgattcgccaagacgaatttccgtggtgtgccggtgtgggccgtgctgttcagcatggcgggttcgctgctggcgctgctgtcttccgtgctcgccgcctcgaccgtgtaatttggtgttggtcgcagtatccggtttggcgacgctggtggtgtggttctccgtgtgcgtgtgccatatccgtttccggcgtgaatgggcgagggacgggcacagcgccgatgagctcgactaccgtgcgcccggtttcccggtgctgccgtggctggccatcgtgatgtgcatcggcgcgctggtgctcgtggtgctcgatgagacgcaacgttcgaccctgattgcatgattccgttcgtcgcctgctgttatgcggtctattacgccctcgaacggcagctcaaacgcgaaaagagcgcctaactcggtttcgaggggctgattcggcgttcgccggaggtctacttgcgtttcaaggggctgatgcccaagtagacaaggctctgaaatggcgttatgtcgttgccacaaagccgtttatactcgcggttcggcgtttgagcagcccctcgaaagccaagtagatgtccccaccggacgaaatcagccccttgaaagccaagagccccactttttcggcgaattacgtcttatatcaggtcgtacggcatctgatgcttgaccatccagaagatgccgaggccgatgaacaccagcagattgaatccgccgctatgccaccacaccacggcgatcagcgtcgccatgcgcgccacatagaacgccgcacgccgccagccttctcgcggccgggtttccactgtcatatgcgtgaagctgccgccgagcgtacagccgccgcgcaaccatggcaccacgccctcgaagaggatgagcgccgccaggaagaggatcgaaccggtccagtcgaacggttccatcgactgccatgagccgttggagcccgagggcaggtttgagcggacgatcatgacgaacagatgcgtcggcatcacggcgaacccgatcagcgtcatgtcgatgatgaacgtgatcagccgccttatgaagccgggtgtggtggtcggcgtcgtatcggcgacccgcgccggaatcaggcgcagcgagaacatggccagcgcgaacccgatcagcgcgccggttgtgttccacaggagatcgtccacgtcgaacagacggtaggcgcacgggaacacgcccatgaggccggtcagctgcatcgtctccagaaacagcgatgtggcgaacgacagtactgcggtaaccggcagcggccaacgccatatgcggcccatgatgaagcccaacggcaggaagaacacgatattaaacgcgatttgcagtacggcggtgagaccatcggtacggatgtcaccgatgaactgcagcgggttgagctgcggtgtcagatggtgcgcggcgcaataggccgccgcatcggccggcatcggatacagtgtgaagcacagcaggccgagcaggtacagcaccgtgccatacgccactatggccgacgacagtcggatgcgattgtcgcggtgatacagcaacgccagcaccggcacagtcagcagcatggacacaaacggccacaatgccagcgcgaacgcaaacggttcggaaaagttcttaagaaatcccatcttcaatgctccctgcttcggtccgctccattcggtttcggaccatgactctcgacttctgattccaaggtacggaacatgacggcatgcgggtatcggccatgagagcgaaatcattgggatgaaaggcgattcgtatcattcgcatggatgaggaagatgcaccagttgtgactgacaattgcggcctgcgaaccggcaggatgaatgggactgacccaactggcccgtctcatcttgtagggtgtttcgtgctcttgtaggcagatgattccaatggcgatgatcggaataccgccattgcaatgacctctcgccaaggccagctacctacaagatgctgaatctgcctacaagatgaattcgccggtgaaccatgccggcatcaccgcttcgaggtaaggacgcatcacgttcacgagccgaaattcgtgagcgtagttcatgagtttgaccaagtcagtgtgcgcggatctcatgtaattctggaaggcggattgcaaatcttgcggatccactgtgctgcgggagcggaacaaatcgcaaatggttcgttccaaatcataaacgcgaaccgtatgcccgaacatggtgatagccgacgccaggccaattgcaaagcgattgtcggccacctttctcactgttatgtcttcattcttgagacgagccgtacctgatgattgcggtaaggtaatcgtcggtgtcagggggggctcgctccccctctccaagcaagaacaacgcagtttcatgcgaaaaaatggctttcggatatcgatactgcaattcgaacagcggatcggactccgcattcggtgaaacatataagccctttgccgctttctcaagcttggcttcacgcacgaatcgcgaaatctccgtgcgggaaactcctcgacgctccatttccgataccggaagatatcccatatgctccttcaatacgctttccgcttctgtcgctctagtggacatgggcactccttcagatgttgcggagctcggagagttgcctgaagaaaagttttgctatcgcctaacctaatgcgttattcgactccaaccgttgctcgacttcgaaatgctcgaatactatgagcgagttgtcgttcaacggaaagtttgggttggcgaattcatcgcggtattccgccgaattccagaaagattcgtgtgcgctccgccattgggccgccgtgacgtcgccttcaccctcatcgatggcgtaccggtcagtgacttttccgagcggaatcacgtcaaccgcagtggtgacgagtacggctacgggtcgttcatcggaatccaccaacaccgaatgcgcgccaacgcacggcagcggttcgacctcttcctcatattcaatcatcagcgcagcggtggcggtttttacgccgtccagaatgagcttcaccaagcgatcgcgttcaggcccaggaaacataaactccgctttgggcaaatcactggtttcaaatgccgtattgacgctcatgcaatgctccagatcgtctttatgttcaattgtgctgtgcttttcttactcccatcataatagcccgaattccatgagtttccggcgctgatccagtggcctccattacggtcaatacaacctgatgccaagcaatcacatgacaacaagtgacactgtactcacgaaccggcctactatgggcggcatgacgattcgtattgtttcgattgagccgccatggtttgaggaaaaggcccaagttcagtcgtgcacgtggcgcgaactcaatcaggggcatattccgcaggaaatcgtggatgcgatcactcccgaattcgcgctcaaactgacgcgcagcacgccaaagaccccaatcaggtcgtattggtcgctttggagaacaaccacgtgattggttttgctgagcttctgcaaacgccgcgttcgccaatcaaacggtccgaggctgcggaactggcttcgctatatgtgttggaatcttgccatcgtcatggtgttggccgtgctttggttgaggcgggccaacgcgccatcggcaacgatcggctcgccttgtgggtcgccggattcaacaccaacgcccaaggtttctaccgtcacatcggcttccatgagaccggcctgactcaaaccgaagacatgggcccggaactcgaaatgatcaactactctgacggcgtattccagtgagcagcccgacctcccacacgcgtccggcgctaccatgaagccatgtctttgaacagtgagcaacgcgcggcgactatccgcgaatttcaggagaacatgagccggctgggtctgaccgccgaacggcggcagggattttggcgtcagcggcagcagagtggagcaaatcatcaccctcaagtcgggcgtgctggagtatccgtggattatccgagcctatctgctgagcagagctgagacacagggcgtggaactcacgccgttcatggcgttacgcggaaatccgcacgattattggttcctcgacggcgactttatcgaccgaggcgaaatcgattaaaaccgattgataatcggccatttacacgcaagaggcgccgtcaatcgcctcgcgcatagaggccatcgctctccgtgcaggtggcgatgcgtgtgtagtattccgtcttgtcctcatggtcgatacgtgcgccgcaatgctgctgcaccgcaagacttgccggattggttttgtggacactcaggtaagcctccttgatgccgagctcgcgggccttggcaagcgtgagcttgagcccggcggtcgcgtagccgtgaccgcggtattcgcgggcgacaccgtagccgatgtggcccggaccgttgcgcaggaagtcggtgagccggtgacgcaggttgaagatgcccacatagtcgccctcatcgttgacgagaatgtatttggtggctggcacccagccgtccagcaggccgacgccaagcgactcatcacgcaaccctcgcacatatgcggcgaaccgttcacgattcatgccggccgctgggttctcgaatcccgtctcctccgccgggaatttcgcgaacaagtcaaacgcgcgttcctggtccgccagccatgtctcaatcagccgcattggtcacactcctcctgttgacacagcagaccacactactactgtgctcggccaacggccgcaagccttatctagggtgtgtttacagataggcagcaagtgtctgccaatgcgtttatcgcaggatataccaggttactttccccgatacacggcagcgacgccgaagacaaattgtatgatgaacaatcccagcaggaagatcagagctcctggccggtacatgcggtagaagtcgaccatatccggctgcgccaaaggcgctgccatgatatacaccagcgcagcgaacacggcgccgagcgcggaaacaaccaagaacgcgcctacggcaaaacgcagcaggccacgatccgaggtcctccggcgcagaccacggcatcccacgaagacgaataccgagatcagcaggtagaacagcagcccgtacgtgggcagcatgtcgataatcagcagatcgttcatggcatatcctttcgtggcgcaatcccattcaacctgcgcatggccaaaagcgcaacatcgtgtcaagtaatcgcatgatagcaggttttgtccggctgcgaccgtggccacgatgagcggcatgggacatgatgacatgaccggggctgcggcgcggtcgatccgtatcgcccgtattggacaatgatccgttcgccctggatgcgatgtgcgcgatgatctcggccgtatccaaggacttccatgtcatgtggggcacgggttcgcccgcggtggcgatcgagcactgccataacccgcataccaggccggacgtgccggtgtcggatcctaaggaatctgttggtgtcgctgcagctcattgccattcccactgaagagatgattggcgaaaacgatactcactacctattcattaggcttcagctcgtgttcgagcacaagtttcatcttgctgttatccatcaaccatgcgtgtaggtctcggtccaggatcatcgccagagcgaagcacgcctgcgtcgcattctccaatgcaatccgtcgattctcacccggcagaggtatgccgttgacaagcggctcatggtgagcgacccgattacgcagggcatgcactgtttttacgatatccagcgcgtactttctcgtccagcgttcttccactgcacgggcatactggcgcccattggagaatgtcttatcgagtcctttgcgccataaatcgttctcataatctgcacggcgctggtctggccacttcgtgtggattgttccgccgtcttccaagagattgcgccaaaatccgaatgtcaatgacgctatgagatggccatgcgtatgattttttcgctggtgcggggtgagatggttccacgcttcacgaatctggtactgggttcggtcatcgaattgtagccctgccatataccagtcttcagtgccattctgctccagagcgaggagggagagttgccggtccatgcggttgcgcagagcgacctcgaggatggcgatgtcgcccatacaggcgctggccatgtcgtgatcccacaggtacagctctagcgctgggcatgaacgtctttgagcctcataattgtaggtggcaagccgttcatcggtaatgcacgcgcgcagcgccttctcccgcggacttcctttccttggagtccgtgagaggaaatcagttgttgaatttgactgtcggctcatggctcattatgatatatcaagaattcccccaaagggcctctccggacggtcttcgactcagccgtgatgcactgggggtttctttttatctggataatcggggcttggttggtctgggctcttcttcaggacaatcgcatatgtttcgggagtgctcagctttcagacgaggcattcgaagaaatgccattccgaggaatcggcatcatggatgatgatcagcgtgccgccctcgttggttatctccttatgaggccggtcgtagagcgcatcgagctgtgttcccaggttcaatcgcagggtcgcatccgcttccttgattatgcggatgttctcctggggcagttggccactggagtaatccctgccgtccagaatggtgccgtcgacttgttctgggtcagcggcgaccttcacgtacccggtatccgtccccatgaaagctttcctcgtccttgctgacgattgcccgcgcatcctcggaaaatgagatcgagaacgtctgcgacagattcgaaaccggactatagccctagtatcgagtccatccgaaccatactcccgccactaccaacgccgcgatgcccaaagcgatgatcgttccggcccggccaccggcggaaggttcacctttccatacgcggtttcccatcgtcggcctcctagccttagccgtagggtctgctagatcaaagtgtgtattactgattagcgtgaggtcgccgccactacgtgagcggtcgaaaacctcatgccacccggcaaatccgagaagcggtcggagaactattcgaagccgtcagctaatccagtattgaacgtacgcgacgacacccagaaacgctcctatacccgctccgaggaagacgaatccccatcccaaccagtcagcaaatcgattgaccggggatttcgcaaagccctccatcaccgaattcgttccagtcgagccctcccctgattcatggttgtcctcctcggcatccctacataaaacccgttagtccaattcaactatatctgtttttcgccagctacaggagagaatcgactataactgatttccatgcgcttcttcagagaagacaagtctgttggacactttgatggactaaaggccagaacacaatggcgctagatgggacaaaaggtacattggtcctatggctaagcgcaaacatatcggcaccgtaattctcacgatactggtcgcggctctgctggcgtcgggcatttccggctggctgttctggcagtcggcgcaacgggtaatcggcgaggcgcagtaatccgtcgagcagggcgacttcaagcaagcgcttgagcagatgggcagcgctggcagtcacatcgtcacggcgcgtgatgaaacccaaggcatgccatggcaggccgccgaatacgtgccatattacggttcggacgtgaaggcggtgcgcggcatgctgggcgcggccgccgacgccgcgaccaacgccctgcccaaaatcgacagtgccgcgcagggcacgttggtggacttcaatatcgaagagctgctgtccggcatgaacttctccgacggcacgctgtccattcccaaaatcgcttccatcaagcaggacctgtccgacgccggcgtggtcttgaagcgcgtcaagacgtcgatttatgcgctgccgcaaccccacacagaacagatcaccgaaatggtcaaccagggcaagcaggtagtggaccaaatcgatgaggctttcgacaccttgaacaccatcgtcgagaagattccgggctgacgtcggtttgttcttgtcgtatattggcgtaacctccgcataaggctagtccatacaaatttatgtttaaatttgggataggaggtgccaatatgccgacacgcacaccaatcccggtcagtcgggcgatgcgtcagatatccgccaacctcgatttggcgcgcagacaacagcgcattcccgtagccttgctggccgagcgggctggattatccatgccaacggtcaccaaaatgctgcgtacgggtaatggcagctttgagaacttcctccgcattgctcgtctgcttggactgctggacggcgtacagcaagcgacggaccctcttaacacagatatcggcaaattacgcgccgacgaagacactccaaaacgtattcgatagtacagcaggaggcgcaacacatcatggaagcaatcgtcaccctgcagttcaacggcacagacgtcaccgtcgggaaattattcaccagtatcaggcgcggcatcgaatcggcacatttcacatacgatacggcctatatgcgctcttcaaacgcagtatccctctgtccagagatgcccctctccccccggaacgttcccggccgagcataatgcgatgcatcgcatctttcaagactgcatgccggatcgttggggcaggaacctcatgcttcgtgcagaacatcaagatgctcgttcggagcatcgcacagcacgcacactatttgagggagatctcttgctatccgtcaacgatgagacccgacaaggcgcattgcgcttctggaacaacgacggtgacgcgctagctcccagtgagaccggcggtccaagagaagtgaccattcagtcccgcatccatagcaatgatgagcagctgctttgaatccggcattgcgcggcttcgcgaagcaaacgcacaatgacttcacattcccgccttgcaccagctggctgcaatctgcgtatggtcatgtatctgtaggccggcacgaatgcggctgatgggtgcggcgaatcgtgacattgcttattacccattcgccccttcagtcgtaccattcgggtcgtcgcagttccaggaatggccgctgtttgcgcgctgctgcggtctgtgtgagatcgatgtcggcgataatcaactgttcttggtcgtcggccttgctgacgacgttgccgtacgggtccaccaccaccgattggccggcgaacgtcacatcgccttccttgccgacccggttgcacatgacgatggccacctggttctgcatggcctggacacggattttccacaggaacggcttcgacggttcggcgtcagtgttcggaaccgatgctcgccgtcggcacgatgaccaggcggcgccgcgcaacgcgcatgtgcggatgccttcacggggttcactcaaatagcgtcatccagtcgggatcgcggtgggccgcaaaacacatggcgatttgttccgcggtgtttcttgtttccgaaagccgcggcaaccggtcttcctcgaagtagcggatttccgtcgtttcgatgttggccgagaaccaaccgccggcgcggctgcacaatacgaagaacttgagcaccccgtacggataggtcagcgcgttgtgattggcgcagtcctgcaccgcgatgagtcgctcgcccctcacatcgagcccagtctcctccttgacctccttgacggcgttggaccgaatggactggttctcgtcgacccagcctccgggcagtgaccattccccgctgttctcatgcgtcatgaggatcctgccttcttcatcgaagatggccgcacgagtgtcgagtttcggcgtcggatatccggcgctgagcagtcgactcacctgtccggccggcgcatcaacctgcgtggagagcatgtcgaccgccatcgcgcggatacgctcgtagcgctcccggtcgaaggggtccttgcagtacatcagtccggtctgggccagcgcctgcaattctcgggcctgttccagtaacgtgcggttcgtggccatcatcgttcatcctgtcatcgtaaggtcttggatccgtttgcgctcaggcatcgcagcgtagtgcaagcagtatagcacttcgaaccgttccggggacgagggtctcagcgcatcccccgtaacctctcccatgtgccatcaacgcttggcgagctgcacgttcttgcgctgtctgcgattgcggctggcgaccgacttttcacgctcgcggcgcacgtgggcctcctcacgcgcggccgccgcgcgctcttcttccaaagacggcaatccggaggcggcgcgatgccggttctcccgctcatggtcgcgttcggccttgcgctccccgcctcggatccgggcgccggaaaccatcgcagttggcagagcgtctggccgaagttccacaggttattggtcagccagtacagcagcacgccgaacggcaaggtgccgcccgacaccacgtagatggccgggaacacaaacgcggtcagcttctgcgtgcggaactgcggtgaatccatggcgtccttcggcgtattgcgatggatgagcagccactgcatcgcgaacaacatcagacacatcaacgccacggccacgccgatgacgacgtgcgactgcggcgagacgaccgtgccgaacgagtcggcgatgcgcacgccgaatatggacgatgattcgatgtcgcccgccatgacgcggtcgatgccgctcaacggttccgcattcccggcggcgcttgcgggcagggattgcagcgtgtagaacagcgagcacagaatcggcgcctgaatcagcgaagcaggtatgaaccgagcggattggcgttatgccgctgctgcaaagccataatttcacgttgcatggcttctttggaacgcggatccttacgcgcggcgtacttgcgttggatacgttggatttgcggttggagcacctgcatacgctgcgtcgcgcgcatttgggagaagaagagaggcaatagacagatacggatgatgagcacgaggcacataatcgcgatgcctaagctgtgcggcaccgactccttctacggcggcggcatggtcaccggccagcccatcggcaccatgatcggctctcgcatgatcaacaatgcgcaagccggcttcatcatcggcgccgtgatcatgggcttccggattcgtggcgcttgacatctgacctcgcgaggaatcctcaaaggacatggaacgcaccaagatgacgctcaaggatctcgctgtctccttccacttcccgaagttctccacctcgcgtgacttctacaaggcgttcggctgccgagtgtgcatgttgctcagctaccagatgatctccgtgtaccaactctacatcgtcgaggattacgtgcaccagaccaagaccgaggctgccggcaccatcgccaccatgtccatcatcaccatggtcgtttccctgaccgcttcgctgatctccggcccgatctccgacaagatgcacacgcgcaaggtaccagtcatcatcgcctcgctgctgttcgcgattggcaccgcgatgccgtggatcatgccgagcgtcacgggcatgtacctgtatgcgggcatcgccggcttcggctacggcgtgtgctcggccatcgaccaggcactcaacgtcgacgtgttgccgaacaaggaagaggccggtaagggcctcggcatcctcaacctggccaccacgctcggccaagcagtcggtcccaccatcacctccgtggtcaagaccacgaccggcacctacacgccggcgttcgccatctccatcgtcatggccgtgtgcgctgccgtgttcgtgctgcgtatccagaaggtgaagtagccgctgcgagtgcctatctccgtttcaaggggctgattttgactttgcggaacatctacttccgtttcaaggggctgatgccaaagtaaccactggttaaaaacggcggaatagcgatagaacaatgccatttctatctgcgttccgccagttgaccagccccttgaaacggaagtagacctccggcaaacgccaaatcagccccttgaagctgattttgactcagcatcatgcagcgcagctatatcctcggtgcgggtatactattccgggccgtcacgacgacgcctatggaacgcacgcatggcaaagagagaaacatgagtcagcccgacaccgacacggcggcacagtcgccgtcctcgcaacaggaaccgcagattcagacggatggccgtcgaagccattcggaacagatgaatcaaccagcgcaaaccagccagtccgagtcgtcacatgatggcaaagacgagcacgccctacataccaacctgaagcgcggcatggaatcccgccacctgcagatgatctcattaggcggcgtgatcggcaccggcctgttcctgagctccggatacaccatccagcaggcgggccccatcggcacgatcctggcatacagcatcggcgcgctgatcgtctacctggtcatgctcacgctcggcgaactgtccgtggccatgccggtgaccggctccttccatgtgtatgccgagaagttcatcggccctggcaccggcttcgtgatcgcaatccagtattggctcacctggacggtggcgctcggctccgaattcaccgccgccggcctgctcatgcaacgctggttcccggacagccccacatgggtgtggagcgcggcgtgcatcattctcatcttcaccctgaacgccttgtcggtgcggctcttcgccgaagcggaattctggttcgcctcgatcaaggtgttcgccatctgcgcgttcatcgtcatcggatcgctcgccatcttcggcgtcatcccggtcgccggctaccaacatgccccgatgttcgtcaatctcatcaaggacggcgtcttccccaacggcttcatgccggtgttcgccacgattctgaccgtcaacttcgcgttctccggcaccgaactcatcggcgtgaccgccggtgagacgagggacccgcaaaccgccgtgccgaaagccatccacaccaccctgtggcgtctggtgctcttcttcatcggctcaatcaccgtgatgtgcgcgctgatcccgtggcgcaaggccggcgtgggcgaaagcccgttcgtgctcgtgttcaacggcataggcatcccctatgcgggagacatcatgaacttcgtggtgctcacggccgtgctctccgcctcgaattccggcctgtacgcctccacgcgcatggtgtggtcgatgggcaacgaaggcatgattccgcgctggttcgccaaaacgaaccgtcgcggcgtgccgatgctcgccttgtgcgccgcgatggccggtggcctgctggcgctcctgtcttccgtgatcgccgcctcgactgtgtacctggtgctggtggcgctttccggcctgtccgccgtggtggtgtggatcgccatcgcctactgccagatcgtgttccgtcgccgttggctggagtccggccattccaccagcgaactcaaataccgcacgcccggctatccgtacgtgtcttgggcggcgttcatcctgtgcaccgcatcgttcgtattggtgattttcgacgtggagcaacggttcgcgctcgtggccgagctcgtgttcatcgtggcctgctatggggcgtatttcctgcaacagtgggtacgcaagcgcaaaaaggcgaccgaggccgacgacctcgatacgctttgggtcgcgcgcgactgaacggctcgcgacctaccggcgcaccgctattcgcgccgtgaacgtgcactgatccaacgcaatgccagacccagcaaatccacaccgccacgattgcccatgatgtgggtttgagcgcggccggggagaacggcagcacctgcaggccaatgatgattaggccggcggccagcagcgaagctgagatgaccataccgaacttcttccagtcaaggccttcgcttgcctcttcggcactctgcggaatcgtgtcgaaaccggtgtagaagagcggcgtcatcaccagcactccgggcagaaacgacccgaccatggtaaccgcgccggacgtcgagccgatcggcagcagaaacacggcgcccagcacgaaggcgatcatcgcctcgaccgggccaccgccgacgatcatccagtcaccgaccagcagcacccatacggtgccgatgattgcgccgaatcccatggtgaagtagttccacaggctcagcgatctgaccatgccgccgtcgtcgccgctgccatcggcactactgtcgccgttgccgttgttaccatcctcgtgcacaggaatagcggcactgggcaggccagtcgattccaccaaactggccgtcatcgtgcttgacgggctgaatgccgtggatgcggcgaccatgaccgagcctcctttaattcggcctgactgtgatgataacgccgttcacgatatgccgtattatgaacgcagtgagagcccgcttcaccggccctattcggctcatgaataaacttcgcctatctgcggcactgaacacatgaccataatgcgatacacgtcacttcctgaagtacgtagtcgttatggaatcacccgcacgtttcccgtatcggagctgtgcgatagctgtgagacaggggggtcgtcagatttcggggggagggttccggaaacggtccgactgcaggatgcaccgggccgtgcgacacatgtcaacttgcgtattcacgccaaactcaattgagcaagccgattctcgtaaatggccagaagcggaacaacgccacaccttggatatcgtcgtatggcactagcccattgttgccgtcgtcaagatggtatcgagaatctctggaattggagcgattatcaccaagcacgaacacgttgccgtcagtaacggttacggaaaaaggactgtcgcttggattcacgccggacttaagataagcgctttcatcaatgggtttgccgttgaccgtgatgggctccccggatcccttgcaggtgacggtatcgccgggcagaccgatgacacgtttgattaggtaacgattgctgtcgattatcgacatcagattggtgggaagctgctccccctccatccagtctgcgggatctttgaacacgatgatgtcgccacggtgcagtgcaaagagtctcggagtcaatcgcgaggcaaatacgcggtcgccgatttgcaacgtgtcttccatgctacgggatggaatcacatagacgttgaacacgaaggtgcgtcccagcaacacgaccagcatcaccgcgatcaccgtcagcagatagccgcgaatttcactccaaacggagggctttcgcgcatgtctcctcgactgtccacgcgcttttttgctatgacaccccaccatcatatcctttccgaccggtaacgcaacaccatagtcctcaaaccatgccgttacctacgcccatgtttgagctcagctgtcacaccagcggttcgcgcacgtctagttcacaggcgatgccggtttccttgcgggcccattcggccgcctgcagtgcggcgatgttccataatgcgcacggcactccgccaaggtccggatgcgatgcccagaatgtgaggtcatcagcgtatgcggtgatgaccgattcttccgtgactggcatgatcgtgtggtacagacggtccgcaagcgtggccacgaattcgttggccgcggcgaacgtgtcgataagatgctgttcggcggtcaccggcgggccgaccagctcccaggattcgacgtccgtggcgctccaatgcgcggcttcgccgtccacatcgcgttgcaaagagacgaacagcctggcgaactcatccgaagtcagtcccgtaacccggcgtcgggttgacaattcaatcggagtcatcagataccgttcctttcgcttcgttcattccgttgtctcgctggtttgatttgctgccaaccggtacaaagcctatctcgcacacctcacgatagcccaaaccaccggcatggccatgattgccagccctacgaccagtgaccatgaggagccggcgattccggtcagattggtcatggcggcggagacgtcatacatgccatgagccacgatcggcggtgtaatcatgcccatacggcggtacagcagcacggcgagcactgcaatcagcacacgcggtggcgtgccgccggcacaatggccctatcgagcatcgccgcatgattcgtgcggtccacaatcgaggcagcatcggtttccattcggttcatgcggccagactatcgcccgttcttgccgattgcctgtaagcaggttcggatagactggcgcgagaacaatgcgagaaagaggcaagaatgacccggaaacggtcacaacagcacgacgcacaacgcaaaccgtcctggcgcgtacgctggaagaccatgagccgagccgtaggcatggaaatccgcgaacacaaaagctcattcgcggtctatgtggtgctgcgcatgctggtgctcgccatggcaatactccagttctttaacggcgactacgaaaatgtgttcctgtgcatcctgacgttgctgctgctgttggcgccggcgttcatccaggtgcagttccgcatcgagctgccttcggtgctggaagtcatcgtgctggtgttcgtgttctcggctgagattcttggcgagatcagttcgttctatgagatcttcccgttctgggacacggtgttgcatacgatgaacggcttcctcgctgcggcgatcggcttctcgctggtcgacctgctcaaccggtccgaccgggtgaagttcgagctttcgcccctgtatctggcgatcgtgtccttctgcttctccatgaccatcggcgtgatctgggagttcttcgaattcggcatggaccagttgttcgggttcgacatgcagaaggacgccatcgtgcattccatcagctcggtgatgctcgaccccacgcacaccaaccatgcgattcgcatcaacgacattacccaggtcacggtcaatggccaagacctgggcctcggcggctacctcgacatcggtctgatcgacacgatggaggatctggtcgtcaacttcatcggcgcggtcgtgttctccgtgttcggtttcctgtacgtgaagaaccgcggcaagaaggactccatcatcagtcgtttcgtgccacgccgcaagtccgccgaccgcgattatctgcgactggtgatcgatggcgggagcgcggctgatgccaaggccaaagccggcggtgccaacgctgacgatagtgctaacgccagtgcggccggcaccgattcagctgatgcagccggagccaaagccggcaatgccgacgccgctccgaccgtcatcgccaagccctgagtacgctctacagcactttcgaagcgtcgaaacggtagtgcccggtgaccgtcatgtgcttcttgaaggcgaagtagtcgttttcgcgctgccgctgcgccatgttgtgaatcacgtacggtgcacgccccgcgatcggccggcggatagccgccctgatagtagccggaatcgtaagccggatggttttcggcgtccttgcgcgcacccgccacgataggggctgcggacgttttcttggagaccgaacggaaggattttcgtatgttcagtcttgaggaacgagagcgtgcggtggagttgtatttcaccacgccgatgacgacggcccaggtggtggagcat

SEQ ID NO: 23 - DNA, 116226 bp, Bifidobacterium longum
cttcgttcgaatcaaatgggacaagacgaacataacccggaacgttaagccgggaaaccacatgggacacggccagccaccaagaccccgaaccgttccccggcttaacaacaaacccggcttaatccgagttaaaccgatgtcggtttaactccgaccgcggctgccactaccggtgggacgaatggatccgcatctgcgaggagcacgggctgatccggtcgatgagcgccaagggatgcagcccggacaacgcggccgccgaggggttcttcggcaggctcaagaacgagttattctacgggcgggactggaggggcgtgggctacgaggagttccgcgaacgcctggccgcctacctgacccactacaatgaaaccaggatcaagaagtcactggactggatgagccccgtgcaataccgcagaagtcttggactggccgcctgaccgtccaaaaaaacatccgcaccccctccgtgcgatcatggacgatgcgctccgcctgcgccatcgcatgattccgtacctccacaccatgaactggcgcgcatcccggacaggccttcccctggtggagcccatgtattggggatcgcccgacatcgacgccgcataccacgttcccaacgaatacatgttcggcaccgaactgctggccgcgcccatcacggaaccgatggataaatcctcccgacggggcaaggccgacgtatggctgccgcagggcgactggttcgacttcttcaccgggcgccggtatagcgcgtcttcgcccaacggacggcgcatgaccgtctggcgtccgctcgacggaattcccgtgttcgcgaaggccggcggcatcgtgccgatgcagcccctgtccgagggggattccatcaactccgtcgacaacccgcagcatctggagatcatcgtcttccccggagcggacggcgacttcacgctgatggaggattcgggacattactctcggcagatcaccccggcgaccaccgcgatcacctatcgatggcgcaaggacggcgccacatccgcactcacggtatcgccagcccagggagacgttcacgctctgccggcccggagaacatgggatttcctgttccgaggcattaccgacagcgacatatccgtacaggccgacggcgcatccgtcgattcggatcgccggtatgatgccgaaaccctcacattgcaggtaacggtcgccgacgtatccacccgcagcgagatacgtgtcaccatcggcgacacgacgatggccgccgatccccgcatggaagacgtcttcgacatccttcggcatgccgaaatgcgatatctgaccaaggaacaggcttatgccgccatagcggagaacggcatcgacgcattggccacgatggattcactcgagcacgtcagcgggccggacatggaagattgctccgattcgcatatgccgagcgccgtccgtcaagcgctgacggaggtgctgctccaatcctagcccgcatgtcgcctctcccggaatacgccacgggagaggcgacagcagcccgtcacagacccatgtccaggcgaacgccgggccgtcaacacgtcgaggcacgacgcaccagatcgtaggaggtcacatacgtgcggaacggatccgccgacccctcgatgcgcgcgatcagcatatccacggcatgtcgcgcgtaatcatccacatgcgggtcgatcgtcgtcaatccgggcatgcagtactcggcatccggcacgttgtcgaacccaatgacctgcatatcctgcggcacgcgcacgccgcgccgctgcagctcatgaatcaccccgatggcgagcgcgtcgttcaggcacatgaccgcatccggacgcggcgcatccggatcgtccaacagccccgccaccgcatcgcggccgccggactgcacccaatccgcgttacggaccagccgccaatcgacctgcaggccacgctcctcatgggccaacacatagccgcgggtacgcatcgtgctggtggtttcgggccgcgactcgcggtcggcatccgggcatgcgttctccgcggtgccgccgatcaacgcgatcctacggcatcccgaatccagcagcgcccccaccgcggtgcgtacggcctccacgttcggcatcgtgacccaatcggccagtccctgcgtatcgtaatcgcccacaatcaccaacggatacggctggtgcagtatcgtgcgatccgtgatcggcgagcccatgaagaaaatccagccgtccgcggccagcttcttcgtctccgggatcgcctgcgccaagccgccggcgctgttgtaggtatcggtgatcaccgcgtacccgcgggaacgtgccgccgccacgatgctgtcggcgagatagggcatgaacggctggcagaaatcggtgatggccagtccgatgagcttcgtgccgccggttttcatggcgcgggcggacacgttaacgcggtatccgaggcgttcgatggcatcctggacacgctggcgcgtctccgggcgcatactgccggtgttgttcagcacattcgacaccgttttgatggagacgcccgtctcgcgcgccacgtcggtgatggtcacccgtttcgccacagcacccctctcgtcgcaccatcgggcatgttccgcacggttcaggcggaacgcccgtctgattccagcataacgcgttttccccggccggtccggtcccttccgcccggcccgggaagcaagggccgtgcgatccgtccttctccggaacggaccgcgcggcccatcgcgtcacttgatgtgcagggcggtccaactcaccggcggcagggagacgcggaccacgccggactcggcatcgtacatggccgacccgttggcgtgcggggtcacacggttctggtcgtagagcgtattcgcggcgaacagatcgtcgtcgtgcagcgtctgcgcctcgacggatgccggctgcgcgccgtcctgcagcctgatctcgaactcggcggtcgcctcgagcgaacggttcaccgcaaacacggcgagcgagccgtcggcgcagcgcacggccacggcgttcacgccgtcgacctcgccatagcgcggcgtatccacggtgccggcggacagcttcggctccagcacggtgccgcccttggccaggcgcgcggtcacggagaacgggtggaacgtggtctggcgccaggccgggccgcccggctccgtcatgatcggggcgatgacattgaccagctgcgccaggctggcggcgcgcacgcggtcggcgttcttgagcagcgtgatcatcagatcgccgaacaccacggcgtcggcggcggtgtagatgtcctccagcagacgcggggccaccggccagttgccgatgccctcgggggtcttgctcggctcctcaccctggtaccagacattccattcatcgaacgagatgtacacgtcgtgcgcgctcttcagatgggccttggtggcgtcgatggtggcggccacgtccttgatgaagccgtccatatccacgccggaggccaggaagctggccatgtcgcgcgtgccgtcctccttgaagaacggctggtagtaggcgtggcaggagacgaagttcacgttctcgtaggtcttctcaagaacggtctgctcccacttgccgaaggtcggcatgccatgggcggaggagccgcacaccaccagttccacgtccggatcgatctggcgcatgccggcggccacggaggcggcgagcatgccgtagtcctcggcggacttgtggccgagctgccacgggccgtccatctcgttgcccaggcaccacatgcggatatcgaacggcttgtcggcgccgttggcgcggcgacgttccgacagctcggtgccgccgggcacgttcgcgtactccagcaggtccagggcctcctgcaggccgcgcgtgcccaggttgacggcctccatcagctcgttgccgccggtggcctcaagccattcggccatctcgtgcaggccgaattcgttggtttcggtggaatgccaggccagatcgagtcgacggggacgttcctgcttggggccgatgccgtcctcccagcggtagccggacacgaagttgccgcccgggtagcggatggtggtggcgccgagttccttgaccaggtcgatgacgtccttgcggaagccgtgctcgtcggcggtcgggtggtcgggctcgtagatgccggtgtacacgcaacggccaaggtgctcgacgaacgaaccgaacagacgattgttgaccggagcgacctcaaaatcgtcatcgacgacgagacgtgcggtcagatggtcctgctggggcatgggattcctttctacatatctgcatgcactctgcatacgtgacacgtatccatacaacgatgtaccgcggaggcgcgggcgaccggggacatccatgtgacagccaccagtgtagtacaaccttgtactgactgccggaaggcgtggcgcagagacggctgagaccttttggcgcaccactgcagcaaaaaagatcccaagaagtcgaattacagtcccatccgacgcatagccaccgtgaacatacggcaaaaggcatcaaccacgtcacccgtccacccgctacattcacaagcagtaccgcccactctgcatcattcgcatatgcaaaggccgcgaaccgtacgatgacggttcgcggccccctgacatgccattaggccacccggctcgcaccggctgttcggcctgccggctcagccctcgcgcttgggcgcctggctggccacgcgggtcaggcgcggcgggcggcgcgtggacacgaacagcggctgcacctcgaccagcgggttgtacggcgccaggccgaaccacttgaccggggaaccggccacgcggcggatcgcgtacttgatctgcagcgagagggcgccacggccggagaccttcgactcgggcatcagcgccttgtggatcaccacgtagcggatggtgccgatgccgggatcggcgtcaagcttcgggtagatcgactgctggttcggcagctcgccggtcttctccagatcgtgcatgatctgatgcaggtaggccgggatggactgcgagaccttgaagccgaggcggatgcgcacacggaacaggtagtcggtaccgaagctctcgaccgaatactcacgggtgaacggctcgtcggtggtctcgacggccaccgcccaccatgcgcgggcgcgcttggggtggtcggcgaagatcgagaagaagatgtccgtatcgagacgcttcaggtccggatcgctggtcaggtagacgatgttgtccgcgaaccggtggatgcggctatcgccgtgcagcttgtccagcgcggggaggaagtccttcggcatcatgtgccgacgctgcgagcgctccagcttggtgccctcgttccacgtgtacatgatcatgaggatcgccagcgtgagcagcagcgtgaaccagccgccgtgcaggaacttggccatcgaggcggcgaagaacaggacctggatcgccaggaacacgatggtgaacacaacggtgccgaacttgttgctgcggtgccacaggtagatgcccagcaggatcgtggtggtgatcatcgtgatggtcagtgccaagccgtaggccgccgagatatgttccgaatcgcggaacagcagcagcacggccagcgtggccacgcacagcaccacgttgacgaccggaatgtacagctggccgcgggtacgggcagggtaacggacctgcagatgcggcatccagttgaggccggtggcctcggagaccatggtgaacgcgcccgtaatcagcgcctgggaggcgatgatgccggcggtgaccgacagcacgacggccacatagcgcacgttcggatccatcatctggaagaacgggttgatcccctcggcgtcggccagttcggggttgttctggttgcgcagcatccacgcgccctggccgaagtagttgagcaccagcgccaccttgatgaacggccaggtgaagtagatgttgccgcggcccacgtggcccatatccgagtacagcgcctcggcgccggtggtcgaaaggaacacggtgcccatcagcgccagaccggtggcgttattcggactgaacaggaacttgatgccgtagtacgggttgagtgcggcgagcacggaccagtcgttgccgatggctaccacgccgacgatcgccaggaacgcgaaccagaccatcaccaccgagccgaagaccttgccgatcgattcggtgccgcgcgactgcacggcgaacaggatcacgatgatcaccgcggtgatcatcatcgtcagatccttgttctcggtgaacagatgctccaacgccggcagcgtcttcaggccttcgacggcggacgagatcgacacggccggcgtcagcaccgagtccgccaggaaggccgcgccgccgagcatggccggtatgacgagccatgcgccgtatttgcgaatcaacgagtacagagcaaagatgattctgcagaaacggacatccaaacatcccaattcacatcacacatgaccgattctccagaatcggacacacagaacacatttttcggaactcagacgtccgattcggcagaatcggacacatgggcacaagtcggatgatgagcacgactatcgacgggcgttcgccggttgtggacgccgctgaaatcgatgcgatccacaccgggcacacgcatgaagacgcacagtatcaacgcgtggtatcgcctggcaccagtgtcatgggaataagcacgttcggctcgaacggcttggggatgttcttgcgtgaagcgttagccgcggccacttcctcattggcaatcgcctgcacgatatggtcggccgccgactgtgcgatcgccgagaaatcctgcgcgaccgcggtcagcttcatgccggccaaatcagtcaaatacgtaccatcgtaggcaacgatctgcagctcgtcaggaatggaaattccacggcccaacgcttcgcgcacgcagaacgatgcaccaatatcggaactgaccacggcatcgacgccgtcggtcgtcaccttgtcgagcgcattgctgaccgcacgatgatagccggcaaaatccatcacttcgccagcttcaacatactcgtatttcacgcctgcggaggtcaattcctgttccaacgtgaggtagtagcgcaccgtcgggaacgtggtctttcccaaatcgaacggtccttcctcgacttctccgcgcgcagtcaaatcgaagaattgatctcgcggaccgccaatcatcaccacatgtttggcaccattgcggatcagcatctgcgcaatcaatcgcccaccctgctcgtggtcggatccgattgacgaaataccgtctccaagcacacggtcgaacgcgacgatcgggcgatgaatcgacgtccaataatcgccgggatgcgaagtgtgcgcacacatgacgatgccgtccatcatgtgccgacgcaacatgtcgacatactggatttcgccgtccgcctcatctgcggtagagcacagcatagtgcgtaatccttgcgcggcgagcgcatgctgcagatgtgcggtaaacgtcgcaaagaacgggtggcggatggtgggcacgatgacgccgaccagattcgtgcaatcatgatacagattgcgggcaagctcgttcggcacataattgagggcttgcatggctttgcgcacacgttcgcgcatgtcatcagacacgtacccgttgccgttcaccaccagcgagacggtgctcagagacaccccggccttcttcgccacatcgcgcatgccgaccatgatcgcaccttccccgtcatcactgttctatcgttgtatgctcacgtgcttaccacgaaatattacattcatttacattctctcgaacctgttcgacagtccggcaacgaaatacagcttcttagtgtcgactcccgcggaggcgaaggccttcagcagcggcttggtctggtcgaatgcaatcaccagcgttgcatccggactggcggccttgatggcggttgcgctcagatttctttcacgttactcagcgaccgtccgtgtaacgtgaaaattacgccggattggcaagcagcgcaatgccgaaaccggcggccacacaaatgagaggcaccgcgacggttgctattccatagcccagagccagcgtaaaacgacgctggcgaatcaatgaaaccacttcgttgagcgccgtggagaatgttgagaaaccaccgagaaatccgacaacgaacatcatgaccgtgtccatatccaccgattgcgaatagtaggacatcatggcgatgcccgcgcatagcgaggcgacgccgttgatgacgagcgtggatagcgggaagttgcgattcgttcttcgattctcgcggttccagccttgttgaattgacacgtcgagcacgtaacgggccatggctcccagaccgccgaacagacagatcatccacatcatcagcgcacctccccggtagtcgggtcggcgacaagcgaaatctccgcagtgatcggtttgggctcgaagctgggtggaagcgggttggccggctgctggattggctgcgactgctgctggggctgctggattggttgcgactgctgaatcggctcgggcagctgccccaagtctgaagtatccggctcgcgcaacaacggctgcgatgactgtgtcagctgaggaacgaccagcggaggaatctgcggaacgcggcctgtctgcataggctggctggcggtcggcggcacggttggtgtttcgactcgcggaacctgtcccgtctgtgcaatctgctgggccgtctgcgcggcttccattgcggcctgcgcggcagaacgcgccacgtcggccactttcacatggcgtacgccctgcgtgtccgattcggcagaatcggacacggaaacagctgaaaacgcaccccgaacccgctttcgagtactccgtgacagcagtgcctgcatcagaaccacgccggcggcggcagtgagcaaaccgcctgcaaaatttcccgcaagatagccaagcgcactggcgatatgccgctcgtgcagaccttccatcgtttccagcatcacgccggacatcgtcgaaagcccgccgagcaagccgagcccaacgccacggctgacaacctgccgcacccggcgacgcagccacgaagcggtcgccatgaattcggtcagcatcgcgaacaggaagcaggcgaccatattcgacacaaacgtgcccacaacgaatggcgtcccgctgaccgacggcaggagcatatccaacgcatgccgacagccgactccaacaaatccaccgacgaacaccacaacatacatcagtccgtcggcgagcggattgaaccgcgcctgcatacgtttcatcggcgccaggggaatcgtaggcggatccatggtgttagcggcgggcgcggttgcaccagcatgcatcacctcaacagtgtcgattgcctgcgtgatgggatgtgagtcctcacccgcagtcaccacgtctcccggcgattgttcttgcgattccattgcgctccccctgtactggccttccgcggacagcgttgttccgcccataggccgtgcaacaacgagctgggccgcggttgccgccttcctaacgcatatgagtttacacggagcgccaacgtatgcaccctggatgtccgattccgcagattcgtacatccagagtccagccgaattcagccaggctcagtcaagccgggcatcacacagccgccgcatcgcaggtcgcacctcgcgctcctcctcgccactgaacagcaccaccagatagtcgccggcacgcagccgtgtatcgccgcgcggcacgatctcgctttcgccgcgacgcaggccgatgatcaggcacccagacggccaacgcacgtcacgcacccgcttgccgtccgcaatcgctcccatttccaatggcagttccataatgccgctgcccacatggcttgcgatcgccatctgcatgccttgcgcgcgcacgtaccgctccagcaactccccataaatcggtttggtgcgcagcaaatcggacaccaacagcgcgacgaaagcgacggccgcgaccggcagcatgtgcgtcaacgttccagacatctccacagccaacagaatcgacgtgatcggcgttttcacggacgcggcgagcgtgcccgtcatcacgcacaccgcaaacaccgccactgcgtcggatggcagatcaccgaatcgatgcaacacttcaccgcagatgccgccggccaacgaaccgaccgcaagaatcggcatgaaaataccgccaggcgcgcctgagccgaaactcgtagatgtgaacagcatcttcgccacgaacagcagacacagcattcccaagccgacgcgcgcatgttcggcggtatcaatcagattcgagccgccgccgagcacatcgggcaaccagatgccgacaggcaacgcgatcgcaatcgcaatcaccgggcggctccatgccggcagtttgccgtacagcgtctggaagccaagcaacgagcggttcatcagcgaaccaaccaaaccggccaccaatcccaacggaatcagccacacatactcttccaacgacagctgaccgatatcaccgaaatccaaaaccggacgcagaccaaaacagtattttgagacgaaatcggcggtcagcgatgcggcggtggcgcccatcagaatcgcaggggaaaaactccgatgcaccccttccaaagcgaacatcatgccggacagcggcgcgctgaacgcggcggacaagccggccgcggcaccggcggtgaccagataatgctcctgcatgtcctcacggcggcggccgcgcaaacggtgggatacacactgcgcgcccgacgcaccaatctgaatggacggcccctcacggccgagcgacagaccaaacaacgcgcccaacagtccaccgacgaaacggactggcagaatcgtctgccaacgcatcttcaagccgcatatcaccacgccgttggtctgcgggatgccgctgccaccagccatcggctccttgccgaccatccacgcgatcgccagcgcggccgccaccgcggcaaccgcccacggcgcaatcagccacggggtctcgcgaatccgcgcatatatccaacgggacgcatccgtgccgtattcgatgccgagacggtatacgacaaccagcaatcctgaaaccagaccaatgactatgccggccgccgccatcttccacttcaagtggtcgaatcgcggaatcagccggcggatatcatgtgccgcgtcgttaccagtcaagccgggaaattcgttgcagacggtcagtcgaccagcgaattgatctggatgacatgatcgcgctgcggaccggtgccgatcacggagatacggcagccgctcagctcttccaaacgcttgacgtaggcctggcaggtggcgggcagctcgtcgaaggagtggcagtcggagatgtcttcgtcccagccgggcatggtctcgtaaatcggcttggcggcggcgaaagcggcctgatcagtcggcatatcgtcgtgacgttcgccgtccacgtcgtaagccacgcagatcggaatctccttcaggccggtgagcacgtcgagcttggtgagcacgatgtcggtcaggccgttgacctgggaggcgtaacggttgacgaccgcatcgaaccaaccacagcgacgcgggcggccggtggtcacgccgaactcgtggccctgctgacgcagccattcgccggactcgtccagcagttcggtggggaatgggccttcgcccacgcgagtgacgtaggccttggagacgccgactacgcgggtgatcttggtggggcccacgccggtgccggtgcaggcgccgccggcggtcgggttggaagaggtgacgaacgggtaggtgccgtggtccacgtcaagcatggtggcctgagcgccttcgaacagtacggtcttgccttcgtcaagcgccttgttgagaatcaggccggtgttggccacgtacggcttgaggcgttcgccgagcttcagcagctcctcggtggtctggtccacgtcgatcggacgacggttgtagagcttgaccagcatctggttcttctggtgcaggctggcctccaccttgtcgtgcagatggtcggcgttgaacaggtcatgcacgcggatgccgacacggttgatcttgtccgcgtaggctgggccgatgccacggccggtggtgccgatcttgtgcttgccaaggaagcgttcagtcaccttgtcgagtgtgcggtggtagggcgcgatgatgtgcgcggcctcgctcaccttgaggtgggagcaatcgatgccgcgggattccaggccgtcaatctcctcgaagagcacttccgggtccacgaccacgccgttgccgatcaccggggtgaggttcgggttgatgatgccggagggcagcaggtgcagggcgtacgactcgtcgccgaccaccacgctatggcccgcgttgttgccgccgttgaagcgcgcgacgtaatcgaccttggtgccgatcagatcggtagccttgcctttaccctcgtcgccccactgagcaccgataagaacaattccaggcatgatgcacctccgcattcgcacgattccgccggaaacagactaccttacaccctctaccctgcgaagtttcgtctcacgcagggcgaggctgggggtgcgacgacccggaatgggtgacgaatttctactcgtacgaggcggcgctgtgaccaatcgcacaagcgcacaggttgaagaacggggcctagcgggcatgcctcgcgcgataatgaagccatgacgatcgcaacaccggaacgctatgccgaaatgctcgatgccgcccgccgaggcggttacgcctatccagccatcaacgtaaccagctcacagacgctgaatgccgcattgaagggcttcgcagacgccgagtccgacggcatcatccagatttccgtgggaggcgcggcttacgtctccggcataggggtcaatgatcgcgttaccggctcgctggcactggcggctttcgcacatgaagtggctgcgaaatacccgaacatcaccatcgccctgcacaccgaccactgcgccaagcagtatctggatgagtgggcgcgtcctctgctcgcgcatgaggccgatcaggtggcacgaggccaggagcctacattccagtcgcatatgtgggatggctccaccgtgccgctcaaggaaaatctggacatcgccgaggaactgctcgacaagtcgcagaaggcgcacaccgtgctcgaaatcgaaatcggcgcggtcggcggtgaggaagacggtcactccgccgaaatcaatgaaaagctgtattccactccggaagatggcctcgaagtcgcccgccgactgggtttgggcgaacgtggccggtacatggccgctttcacattcggcaatgtgcatggtgcctacaagcccggcgtggtcaagctgcgtccgtcgctactcggcgacattcaggcgcgtgtggcgcgcgcggtggccgaaggcgagttgcctagcgcggccggcatagtcgatttccccaacggcaagccgtttgagctggtgttccacggcggctccggttcacgcccggaagaaatcgccgaagctgtaagctacggcgtgatcaagatgaacatcgacaccgatacccagtacgccttcacccgtccaatcgccgaccacgtgttcgagaactacgacaaggtgctgaaaatcgacggcgaagtgggcgagaagaagttctacgatccgcgttcttggggccgtaaggctgaggattccatgtccgcccgcgtggtcgaggcttgccggcagctgggttccgcgggcaaagcgctcaaatagcgcgtagttttgcgatcgtgcgcgacactttcccggaaataatgaaaatcattgaaaatcaatggagcggacaacgggagtcgaacccgcctctaaagcttgggaagctttcattctaccgatgaactatgtccgcatgccttacggctgctgcacctcacgtgacgagcatgctcagccaaacgaggcacgaatagttatcctagcacgtcacctgccgacgcgcgtggagtaggtgggcggagcgatcggcgtgccgttcatttcgttggccatctgcatgagacgcgctatgcgctcatcggtcggcggatgtgtggagaacaagcgcgagaaaccgaccgcggagaacgggttggcgatcatcattgcggagacggactgggtgccggcggttttgcgcatcggcgcggcctgcgcgccgtaggaaatcttgttcagcgcggaagccagggcctcgggatcgccggtgagcaagctgccgtcttcatcggcgtcgtattcgcgggtgcgggagatggccatctggatcaaagacgcggcaatcggcgcgagaatcacgctcagcaatgcgccgatcaggccgaggccaccggaactatcgcggtcgtctcgcgagccgccaccgaaatacatcagcgaatagcccagataggagatgacagtggccatggcagaggcgatggcggaagtcaggatgtcgtggttgtacacgtgcataagttcgtggcccagcacaccacgcagttcacgggcgttgagaatctgcaggatgccttgggtgcagcagacagccgcgtgccgttcgttgcgtccggtggcgaaggcgttcgggctcatggtgggggcgatgtagatgcgcggcatcggcttgccggccttggcgctcagttcacgcacgatctggtagatttccggggcttcctgttcgctgacttcccgcgcacccatggaggcgatggcgagtttgtcggagaaccagtaggtgccgaacgtggtaatcaggccgatgacgatatagatgctcagggtttgccgactgccgcccgtggcccaccaaatcagcatgatgatggcccacatcagggcaaacagcagcgttgtcttcaggccgttgaaatggccgtgcacccgtactttggcatccataatgcacacactaaaatcgcatgctgaatgattgctggatatgcgccgcgagaaatgtcccatattcgcccggcccgtccggccccgagcccggccgcgtccgcacggggcgcggccgggtggacgaatgccggacgaatgccggacaaatgccggacgggcgtgggcgggccgtcaggcgtgggcgagctcgcgcatctggtcgggctcgatgaccttcttgtgctcgcggccttccttggcaccctcggcgcgctcgaaagcgtcgaccttcttccagccggcgaagtcgatcgggcgaatgccgcgctcggccagcagtcggtcgatggattcggggtcgcggtcggctgccacacggccaccttcagcggccttggccagatcctcgagcatgttggtcacgatggcgagcgcatcggacttggtggagccgatcaggcccaccgggccgcgcttggcccaaccggtggcgtacaggcggtcgcgcacttcgccgccgtcggcctcggtggtgatgcggccgtcgccgttggcgttggccaggtgggcgccgtgctcgtcgtaggcaatgccgggggcttcggcgggcttgtaaccgatggcgtggtagacggcctcaaccgggtagtcggtgaactcgccggtgcggtgcatcttgccgtcggcaccggtttcggtgcgctccacgcggatggccttgaccttgccgtcctcgccgagaatctcggtgggggcggagttgaagtgcacgtagtactttcggtcggccgggttgccttcgaagtcgacgtcgccgtcgtcttccatgtcttcggccatctcgcggatggcgaacagctcctcgaccatctggcgggtgagcttgtccttgccggccacctcgatggtctcgtcgtccagatcgaagtcgtcctcgttgatgatgagctgcacgccgggcagcttctccatctcgcgcagttcctgcacgctgaacttggcctgggccacgccacggcggatgaacaggtggagcaccttggccttgttctggccgatgccctcgtacacgttgtccggaatgtcggtcttgaccttgaggtcgtcggcgttgcgcatgagttcgcgggccacgtccatggccacgttgccgccgccgattacggcgacgttctcggccgtaagcggccattcgcgggcaccggtggggtagccgtcataccattcgacgaacttggcggcgccgtacacgccttcaaggtcggcaccgggcaggttcagcggcttgtccttgaccgcgccggtggcgaacagcacggcgtcgtaacgggccagcaggtcgtcaagagtcacgtccttgccgaattccacgtcgcagtagaggtggatgttcgggttatcgagcgtcttctcaagcgcggaggcgatgaacttgatggacgggtggtccggggccacaccgtaacgcaccaggccgaagggcacgggcagcttctcgaacaggtcgatgcgcgcttcggtgccgaggccgagctcttcgcccagcttcttgagctggcgcaggaagatatcggatgagtagacgccggccggaccagcgccaattacagcaatgcggagttcagtattcacagattcagtcacgcgctctagcctaacgcaaagccttccgttgcaacagagggcgagtggtgggaattctgtgtattaggccatagtttgtgcgtttgggaaacctacgagcactgctaatgtcagattatgggtttccctattggtcaagttattgccgttctcattccaagaagcatgcaaggcggatcaggcccttactccggatacgtttatgccgcaaggcggttatccacgcatttatgacacgagaatgccgctcaatctgttcttctcgaactacatcgacacttatatcgaacgtgatgtttccgaatatcttgatgtacgcaatttggctgaattccgccgattcttgactctttgcgcactcagttccggagcactcataaactacaccaacatcgccaatgaacttggtgtaagtccgcgaaccgtaaaggcatggatgtcgattctggaatcaagttacatcgcattccatctcatgccgttctacacgaacgcacgcaaacaggtggtcaaaacgccgaaactctatttttatgacactggcttgctgtgtcatctcttgggcattcggacggtcgaagcactggttgcgcaccccaagttcggcgatatatttgaaaacctcatcattgcggaaaccatgaaacagcatttgaacgccaatcaggagccacaattattcttctaccgcgatgccagcaaggtcgaggtggatttgttggatttcaccgatcctaacaaccgtatgctcatagaaatcaaatccggacaaacctatcatgaccggttcgcccgccatctcactttaattggcaatgttctcggtataccgtgtgagcaacagtacgtaaccagtcgggttgagcatagttatgtctcacaaggaatccgcgtcacctccacccctcgattggctagaaggccgacggtaaagagccgccgcagagcagtaggaattctgtgcaatcagtgaatcccttgaggcattaaagacgtcacctccaacggctctttacgacctcgattgcattcattaggtcatttcttcgtccattaggtcggagggtgctgaagccatcccttggaacggcggggtttcaagggccgctccgaccaaggaccgacctaataaacgtcaaatcgacctaatgaataactccgatgctattgctgctttcgtgggcgggatttccgtttccgccacgtcaccaaccgtatcgccccgattatgtttcgatgcggtggactcgacatacgaccatcccggtcagtcaactgacctacaaaaacagcagaagcctcatattcttaatcagtcccgatcaattagggcagtgagggcccagaggatgctcaccacgtcgatggcctcctggaggaaggcaccgacgacgaccgggataaggttgaacgcggcggcaatcatgccgatggtggcaagcacaaggcccgcgattacggcttgaagcatcacgcgcttggtgcggcgtgcaatggcgatggcgcgcggcacggcggcgatattgtcattcataatgaccacctgagcgctttcggaagcggcggtggacgtgccatcggtcatggccacgccgatatcggcaacagcgagcaccggggcatcattcacaccgtcaccaaccatcatcgtgacggttttgccggctcctgtagcggccctgactgcggctaccttatcctccgggaacagttcggcgtgaacctcgtcaatgccgacttcgctggcaatgatattggcggaagcccgcttgtcaccggtaagcatggcgagctcggtgacgcccaactcatgcagtttggcgagcactgccttggcgttggcacgcggcacatcgcgcagcacgatgcgcgcgatcagccggccgtcaacggacacgtaggacgccatctcatccggctgcagcaggccaaagcgagtgcgcaggtcatctttttgctgagctccccctcttagggggagctggccgcttcgcgggctgaggggggcagcctcgccgaccgccaggaatccatcctccccagcagccgcgaaagacagccggccaacgcgcaccgcgtgtccgttcacctcgccggaaacgcccttgccggcgtcttcattgatgttcttgacgaccggatactcccggccatggccaggccagctggcctccggctctgggcacaggcgctggccatcctcgaaccgctggcgcagtcgggccagcgcctccgcgccggccttggcaatgcctttggacaggatgtgcaccgagtagctttccaccgcgccggccatcatcagcacatggtcttcgttgagacgggttgcagcgccgggcaacatctcgacgcgcaccacctgcggctgcttgacggtgagcgtaccggttttgtcgaagaacacctgcgtgacgcggccaaggttttccagcacgtcctgtgctttgataagcacgccggctgcggcgaggcgtccggttccggcgatgtatgccaccggtgcggcgatgagcagcgggcagggcgtggccagcaccagcacctgggcgaatcgcgtcggtaccccggacaccgcccatgcgacgccggcaatcaccaacgaaagcacggtaaagggcacggccaagcggtcagcggtttttaccacggccgggcgcgactcctgcgcggaggccacgagctcgaggatgcgctggtactgcgaatcggcggccacctgggtggcacgcatggtcaatgcagtcgagccgttcaccgccccggacatcacacgggcgccggcgaacacttcacgcggcaccggctcaccgttgatattgctcaggtcgagcgtggccgtgccggacagcagctcgccgtcaaccggcacagtttcgcccggcaacaccatgagtacgtcgcccagctgcacctgctcgaccggcaccgtgtcgaagcggtgcgcggcggcggcagccgatgccaagcccacacgccggaagccatcggacgaatcgcccttatcggcagcaaacccacgccccacgccaggcaggttgacgacgtgcgcggtttgcggcgcggcctccatcagcgcggtcagactgcgctcggccttggcttgagcgtattcctcaatggcctcgccggacgtgatcatcagcgtcaccgcccaacttgcccagtattcggcgacggccacggtggagaggatcgcgaccacggccagcacatcgactccaacctgcccatgacgcaaatcgtcaatcatgccgcgcacagtgtcaatcacaataaccagcaccagtgcgataaccagccactggccgaaacccggattgccgagtaccggaatcgccatcgcattgccccacggacgccaatcgcccagtaaagccaacggaattgcggcgatgacgacgaccggaagcatcggcacaagcttgcagatgtcgagaattttggtgaagaatctgatgagtctgctcatcattgctccttacgctcgtatacggagtcgattgcggtacggtaagcgtggcccgcgcaatcggcgctacggtcacgccttgttaacccaccggcggctttgcctggggcttcgctttgctcggctcccgcgcgaccttccgatacacggcgtaaagaaatgtattcagttttgtattgaattatgcgctgtgttcaggacgtcgcccgaactcagtgcttggcctaccctatcaacgagcgttgcgcgacatgccggatatcgaaactgcgttggcggcatgggcgcggggcacaatcgcgcatacgaaaggcccgtggcaggagtttgctcactgtcacgggcctttgcttgtccgacacggtgttcagcggttaccgctcaacaccgtgtgacgttgtcgagtcggctttaccacaggccgaacgggtcggagaagccgccgccgtcaccggtgccgccatcgctgttgccattgccgttaccgttaccgtaaccgttctggccattgccattctggttgttctgcttattctggctgttgccgttggaatcggagctggacgagccgttcaccgacgactcctcctgatcgagcgtcacgtccacatccatggtcttgccgtcgcgcacgatggtcagcgtcaccttgtctcccaaagccgcggcacgaacgtaaccaagcagcgagtagttgttgttcaccgcgttgccgttgaaggccacgatggtgtcgccctccttgagaccggccttgtcggccgggccgccggagacgaccgcgctgccggtggcgctcgacttggtgatggtcgcgccgccgcgggtcacaccgtcggcttcaaccgtgtcggacttgatgaccacgccgagggcaacgtgcttgaccttgccgtccttgatgatttcgtcggccacacgcttgacgaggttggacgggatggcgaagccgatgccgatcgagccggcggagtcggaggaagttgcggtagaggcaatcgaggagttgatgccgattacctggccggccgcgttgaaggtcgggccacccgagttaccggggttgatggccgcgtcgatctggacggcgttggtgacgatctcgttgttgttatcgtcggtcacggtcaccgggcggttcagggcggagacgatgccggtggtggcggtgtcgtcgtagccgagcgggttgccgatggccatcacgttctcgccgacggcgagcttgtcggaatcggcgaatttcacggccttgaggtcgctcggcgggttgtcgagtttgatgaccgcaagatcggtggtggtgtcggtgccgacgagcgtggcggaatacatgttgccgttggcaagcgtcacctgaatctgctgggcaccggagatcacgtggttgttggtgatgatgtggccttcggtgtcgatgatggcaccggagcccttggcggtgccgttgctcaacgcggtctggatggagaccacggagccggagacatcgctggcgacagtctgccagtcgggggcttcgccgctcttggcggtggcggacccggagccggacttattcgagctgacgttggtaagcgagttgctggtcggcaaggtgatcaggccgctggtgagggcaccgtagccgaggcccaggcagagggccgcagccagaacggcggcgaccacggcgatgagaatgttgctcgccgtcttggacatgccctgcttggcggggccgggctgaccgggctgaccgggctgtcccggctgggtcggaccttgaccgttcggcgtaccggtaccgggaacgccgaaaccgaacagaccgccctgctggggctgctggccattctggccattctgaccggactggctggcaaacgggttgccgttgttctgctgcggctgcgtgggcggattgaacggattgccgttaccctgcggctgcgggttattggtgtagtaggggttgcggttgccctgctggccctgtggggtttgctgtgcaggctggccgaacgggaattgctgcgtgggctgggcattgttgccggcctggccgccctgctggccctgtgcctgagtcggggtcggcccataagcgccgtattccggggccggacgatacagcggagttgtggccgaggtctggtctgcggccggcgctgccggagaagccggcgaggaggagaccaccgtgctctcgcccttggcggaggcgtagtccgggatgggctcggtggcggcagtgtcggtagcggcttgcgtaggctgctgatcggcagcgagggcggccgaggaaaccggggcttgctgctcgctggaatcgctggcgttgccggcatcaaccgagtcgccacccacaaacgggttcttcggctcggcgttgccggtatcggcagtactattggggttttcgttattccgcggggtctggtcgacgccctgcgggttaaattcgtcagccattgctgctccttttcctaaattcctatcacgtctgttcggcggctattcgggcacttgcccattgccacttctcgtgtgctacctcagtagtaaaggcagtcaatctggaggttttctgaacgttgattgaaagtctatgcgtaatcatcgcagagtcttatgggcatctcggcttcgaggggctgatttcctgtttcgggaacatctacttgcacttcaaggggctgttcgcgcggtcaattccgagtatcaagggccctcatttaacgccattccgccatttttgcagccggcctacttgaccgggagccccttgaagcggaagtagacgttcgggagcggcgaaatccgcccctcgaaaccgagttcttcacaatttccggcccttttctggcccttctgcctaaagtgaacatatgacgatcagccttcttgaacatccgttgggcgcacagcccggacagcccggcgaccgcagcgccttccatttcgaaacgatcacccgcctgccatccacggccagcgggcttgggcgagacggtgcccgatacggccgcaccggcatcattcacacgccccacggcgatattcgcacgcctgccttcgtgccggtgggcacgcaagccgcgatgaaggccgtgttgcccgagcagatgaaggatctaggcgcacagtgcctgctggccaacgccttccacctgttcgagcgcccgggcgaggacgtgctggacgcggccggcggcttggcgcgtttcatgaactgggatgggcccacgttcaccgattctggcggtttccaagtgatgtcgctgggcgtcggcttcaagaagacgctggcaatggacgtgaccggcatgaagtcggacgacatcatcgccaagggcaaggagcgcatggcctgggtggatgaggacggcgtgacgttcaagtcgcctttgaatggtgacgcacatcgtttctccgctgagatttcgatgggcatccagcacaaaatcggcgcggacatcatgttcgcgttcgatgaactcaccacgctgatgaacacccgctcctaccaggaggattcggtggagcgcacgttccgctgggcccgtcgctgcgtggacgagcaccagcggctgacggcggaacgcctgggcaggccgtatcaggcgctgtatggcgtggtgcagggcgcgaattacgaggatctgcgccggcgcgcggcttcgcagatcgcgtcgctggacttcgacggcgtgggcatcggcggcgcgatcgagaagcgcatcatcggcgacacctgtgcatggatctgcgacgcgatgccggaaaaccgtccacgccacgtgctgggtatcgcctctgtggacgacattttcgcctgcgtggagaacggcggcgacaccttcgactgcgtggcccccgcacgctgcgcccgaaacggcgcgatttacacgcgcgccggccggtacaacatcaagcgtgcccagcataagttcgatttcgggccgctggaggagggatgcgactgctacacatgccagcattattcgcgcgcgtacgtcgaccacctgctgcgcgcccgcgagttcaacgggttcacgttggccacgatccacaacgagcatttcttcgtgaagctgctagacgacatccgcgcctcgatcgacggcggatactttgatgagttccgcgacgaagcgctggcccacttctacggcaacggcgagcgccggccagggttgtgagtttttctccttcgttgcggcttgtgctgccacgaagtgactgaggggagtgtcgccaccgtcaaagatcacggcacccgcagaagacccacgagcgatatatccctgccgcccatgcgacacgccgaagattgcatgattacccagccgggtgtaagttagtcgattgtctgcgagtgtggcggaatggtagacgcgctgtcttcaggtgacagtgagtgtatgctcgtgggggttcaactccccccactcgcaccagcaactaaagggctggaatcggaaggttccagcccttttgctttgtccgggcacgcgccgtttttcaggggggctttaggacttgagacttatggcccaactttcgtggcggaaaatgtcccggtacctgcatcaatcgtttgacgttcaagccaggccagaatccgctgtcccggttcgcgatttcgggcgatctttgcaaaccgggacaatttttgttgccccggtataaatgtcaatcgatttatgcgaaaaccgggacaacgtgccaattccagaatcggccttattccgccgattccgtctgccagacgatatgagttgaggaaaccggagtgtcccggttcacgaaaacaagccgaaatcgccgaccgggacagcggattctgccccggtcgacaggtcaaacgattgacatatgaaccgggacaaatacagatcagagagaagcccatgaagcagatttaactttcctcaactttccatccgccataaactagcattacataacatcatgaaccgagacgaaaccaacgaagtatctggagtcaccgacgaccagctcggccgaacggccgagccgtacgaatccggcaactggcggggcggcgtcgggagcatcattcgcagcaatccgaaatcaggaaccgacacaagtcggacccagcagacacgcataatacgagttcacagactcggcgatgtattccgcaaccgcaccaccgaataccgcaccacggaagaactgtaagcattacgaaatcaaccttgattattgcgcgggcctatactaggttacggtagcgtaggttagtggtcgggagagcgtcgccggccatagcgaggtgatcagtatgagcgtttccatcagcacgccatctggacgaaccatggcttccgccgcaacagttgcgccttccgcaaccgcgagtcaaaaatccagcgcaaacgccaaccccaccgcactggaccgtgcatcggcccgatacagggccgcgcaatcgcgctaccgccaagccaaggccgcactgaaggcgatcaagcgccagatcgtccccgtggatgcattcggcaatcgcaagccgcgactgcgcggatggcttcacctcgccaccctgccgctgtgcatcgcggcgtccatcgtactcatctgcatcgcgccggccggctcggtcaaagcggcctgcgcggtgtacggcgcctcggccatgctgctgttcggcaacagcgcgctgctgcacgtcgtgccatggcgcagcgcgaaggtgactcgcgtgctgtgcggcatcgattattcgaacatcttcctcatcatcgccggcaccaacacacccgtgctgttcgcgctcagcccggcgattcgccggccatatctcacggtaatctggacgaccacggcgattggcacgatactgcatatcgtctggctgcggacgccgaactgggtgttcaccaccgtatacgtcgtgttggggctggccccggtaacgcttattccgcagctctggacggctcccgcagtaggcccggcgccgaccgtgctcatcgcgtgcggaggcgccgcgtacatcgccggcgctgtatgcttcgcgctgcgcaagccgaaccccgtccccggctggttcgagtttcacgaggtgtttcacttgggcacggtcatcgggtatgcctgccacgtcgtggcgatttatctgattgtctgtgcgctgtagtcgtccagcaattcatacaggatgcttcgaactcgctgtattgcagcgatttgaacacggcgcgggacagacagcggcccttaattctcggagccaagaatcaagtccttgatcagccagccgtgacggccgccttcatagacttcatcggtgagtcgatagccgcactgctcatagaacttgtagtggtcgttttccgagtgcacggcggtcatggttccgccggcttgcgcgatgcggcgttcggcgtcagccagcagccgcgagccgatatgccggccttgtgcctcgggcagtaccgccaggcgcgcgatgatgtatcgcccgggctggtcgggatgatcggggtccgcgtagaaccgacaggtcgctacggggtgattctggctgggctgaatgggctggctgcgtgaggccaattgcgcggacgagccagggcgattgggcgcatcattatccgaatcgaacaccagcagatgtacggacgcggcatcccattcatcgaactccggccgccagtcgcgttcgcggatgaacacctgctcgcgtatggcgcgggcggcggcgggcagccggtcgtatgcttcgattcgtatggtcatgagcgtcagtgtaatgcgtcacgataaccgacaaagcccggctcggtggacgagctcgggcccaagctcggcctgcgttcgataggctcaggccgtacgcgcgatctgcacggcggtgccggacgcggtgaccatcagcatgccgttgtcggcgccgagcacctcgtagtcgatgtccacgccgaccacggcgtgcgcgcccatcgcctccgcacgctgctgcatctcggcgatggcctcgttgcgggcacgcatcagctcttcctcatagccctggctgcggccgccgaacatgttacgcaggcccgcgccaagatccttgaacatgttcacaccggataccacttcgccgaagacgatgccctggtaattggtgatggtgtatccgtcgacggacggggtggtggtgacgagaatcatggcgaggctcctttggcttgtctgcgtagatgaatcactgccgagagtcggatcgctcccgaatctcacctcggaaacggatcgcttctcttggctaccacaatagtcgagagcgccttccccaacatcttcaatccacgcgattgcgtaatcaaacgcatgtttcgcctccaaaaaatgctgatagacattgggccgcaaaaggccagcctcaacgggcgcaagccgctcaccaaactgaatcgcagacccaaatgactcgtcatgggcaaacggctggaccacccaaattccgctgcgataatcaaccatcaccgaaagcccaggctgctccgtcgatacgaccatcatcgaaccggacacgttctcgacattgatattcgggtgcccgtacaacgcgtaactcaaaccatcatcggcaacaccctgctcttgccaattggcgcctaagcactccaacatctcgctgggcgagtacgcacaatcttccgcataatcaatcggctgagcatccgtataacagcattcaccgccgtcaccttccgcaatgctgcgctccacaagataggccatcacatccggcatctcccaataatcaatggacagcttatcaatacagccgtttttccaagccatataatgcgtttgctcgtcgccaagaatctcttcaaacgcctcggctgagataaacgtcgacccgtccaactgatagcactcgtccaaaggatagatttctcggttcgcgtattgttcctgagccttggacacaagcttgtcatccaatgcgctcatctgctgatcaacttcatcctgtgagggaatgaaaggggcgaagtccagccctgcttcgccacagcctctctgccgttcacgcctgtacatcacgtccgcacacgtatcggtctgccgttcattcaccattgatcagcctttcttttcgttccacaaatgccctagaacactgcgattccagtagttccgattgaatcaggatcgttcttgcgaaactgtcgaggatcgtggatcgcttgtggatcttgaagcgttgtatcctggttgttcatggatccggaacgcaaaatcattaacgtcgtgggagccgcaatcgtcaccaacggcaccgtactatgtgcacaacgcggtccggggaagtcgttggccggatactgggaattccccggcggcaaaatcgaacctcatgaaacagcgcggcaggctttacaccgcgaaatcgaagaagagctgttatgcgaagttgaagtcgcggaagaagtgtgcaccagcgaatacgcctacgactttgggaccgtacggctcactacattcgtctgtcacctcatcgccggcacaccgcatctcaccgagcatactgatatccgatggctgaatcctgccgatatgccgacattgaactgggctccggtagatcgcgaagcagtcgcgattatcgccagcaaacagctgacgctccgatgaatgcgccatagcgcagccatgcagtcatgcagtcatcaacaaacaattcgaatcgcaagggaacaagacaacatgtctatcaatctggccagcacctcaagctctccggccaacacgcaacatagtgatcctggcccgacaccctcaatcctcgaagatgtcatctcaggtctgatcgagccgcgctcagatgctcccggcgaatataagccgaccctcatcgcaaatcgccccggtggattgaccatgcgcgaggaaatcggcaattccttggctactagcgattccttcgacatttctgtcgcattcgtctcggctgaggccgtgctcagcttatttgaagacttcagaagtcaccatgaaacagcgacccgagcgggcacactgattacctcaacgaaaaatcatttcaacgatcccagggcattctgggagctgctgcatcttcagaacaccactggtgttgacgttcgcgtgtgggaaggctcccgcaatgcctcagtggccgcaatggctcaaggacagccattccatccaaagggatatatcttttctcgccgcatgaaagacggtacgccctattacgacctgtacgttggcagttccaatctcactggagccgcattgaccacgcaacgcgaatggaatctcaaagtctcatcgctggcggatggagagctggtcgggcagttccaggatgaaatcgactcacaggtggccgattccgttccgctgaccgaagagtggatcaaacagtatgaggaagatttcaagaaatacgccccaccgcgtcatgagattctgcagtcgtttgaggggcatgacattcagccaaacgccatgcaacaggaggcgttggcgaatctcaagaaacttcgtgaacaaggcgagcaccgcgcaattatcgtgtcggccaccggcaccggaaagacgtacctttccgcattcgacgtacgcgaatgccagccgaagcgcatgctgtacatcgcccaacagcagatgattcttcaaaccgcaatgaactcttaccaaaaggtgctcggctgtgatgaatccgaattgggattgtattcaggcaccagcaagcaacaggaccgccgctacgtattcgccacggtacagacgatgcggcagccggaggttttggcgcaattcaaatccgatgaattcgactacgttctggttgacgaagttcatcacgctggagccgaaggatatcagcgcgtcatcaatcatttcaaagatgccgacttcatgctcggcatgaccgccacgccagagcgcaccgacggcatcaacatcttcgagctattcgggcataacatcgcgtacgaaattcgcttgcaaaaggcgttggacgagaacatgctctgtccattccactactacggcgttgcggaataccttggctccgacgacgatccgaatggaatcgcccatcgtctcgatgtctccaagggtcttgatgcgaaggactcgaaacagctcaagtacgagatcgagcagcttgccaccgaaaagcgagtccgctacatcattgacaagttgcaggaatatgggcagttcaacattccggtcaccggactcgtgttctgcagccgacaggaggaagcccataagctgtcccagctgtttaaccagcagtggaatcaacaagatgaacgcccctatcgcaccgctgccgttaccagcacggacgatgacggcaggcccgtgtcccaagcgcagcgagacgaatacgtccgcaagctcactgaaggcgaactcgactatctcttcactgtcgatatgttcaatgagggagtcgatattcccgccgtcaaccaaatcgtcatgttgcgcagcaccgaatccagcattatcttcacgcagcagctcgggcgcggactgcgcaaattccctcacaaagaaagcgttgtggttatcgatttcatcggcaattacaacaacaactatctgattccggtggcgttatacggcaacactggcgaccgcgacagggctcgcaagaacctgcagcgaaagtcaatcggcctgtcgtccatcagtttcgacccgatcgccaaggagcgcatccttaagtctttggacaccgccgactggtccgacatgaaaaagctgtccgaacagtatcgccaagtccgttacgagctgggccgcatccccatgcttacggacatctataactacgacccctcactgccgtataccatcgcatcgaagcgcagcaactatcttgatttcgtgcgttcccgtgaaaaaagcctgggcaaaggcaaacatcatgaagcgacatttgaggatcagttggagccggtgaccgacgttgaagacgcgatactcaagatggcagcggagctgctgctgcccggattgcgaccgcacgaattggtcattcttgctcagctatgccatttcgtcagcgaacggctcgacgacgacgtacctcagcattggagtgcgggctcgtcaatcggccgcagcgaactgctcgatgcgattcgtactgaattcccgctggccgatggttcagacgcgcaattcgactctgcgatcagcgtgctcgattattcatatttcaccggcccgaactgcaatcgttttggcaaccagccattggtcgaaaccttgaacagcaccggcacaggaagcgacaccgcatatcggttgagcagcagattcgccgacatacttgccacgaaccgaacgttccgcatcttcttcgcggacactttgcgcaccggtatggccaattgccgagatatgttccgcgaggccgccgccaggcaacaggtcttcgaccacatgttcttgtacgagcgcaaatattccatggctgacgtcatgcgcctgtgcggatggaagaaggaaaacactccgcaaaacgtgggtggttacctgctcgacaaggaaaccaacaccatgcccatcttcgtgaaatacgcggccagccaatacgaggatgaattcctgagcacacaggaaatgaaatacttcagcaagaacggacgcactccgcagtctccggaattccgatgggcgcttagcggcattggcccgaattgggaccacacacatttcgtcccgctattcgtcatgcgcaaggcggaagaggccgatggcaagtactactacgttggccacgtcgctgcgtttgagaatcctcagctcaccaccaagcctgacgcaaccggacagggcagtgtgaaggtcaccctgtcggtcctgcgtttggcccggccaatcgatccagagctctatcggcatttagccggctgaccatcagctcctcaaccgtacggcggcggccattccgccgtcgccgtaggtggggtgggccatgaaggcttgactggcggtggcgtcgccgcgcatcgactcgtcgtagccgccacagcgctcccacgcggcacggcgaattatgacgtggccgggcagcaattatgcgacacgaacgtggcggcgatgccacggttacgcgcggcgcatcatgcgatgctcgccggcgaccgtgtgctcatcctcacgcttggcgggcttgcgagcgcccgcaatattctccatgctcatgcctgctcatccccatccacaaccgaaatccagtcgccgtatccttcctcggccatgcgcgagcgcggcacgaagcgcagggcggcggaattcatgcagtagcgcaggccgccgcggtcggccgggccgtcggtgaacacgtggcccaagtgaatctgtgtgtccgacgtgcgcacttcgatgcggtcgcggcccggaatgcggtggtcctcatgctcggtcagcaagtcaccggcaatcgggcgagagaacgcgggccagccgcagccggaatcgaacttgtctcgcgacgagaacagcggctcgccgctgacgatgtccacgtaaatgccgggctcaaactcctcgtcatactcgttgacgaacgggcgctcggtagcggcgttctgtgtgaccgcgaactgctcaagcgtcagatcccagatgcgttccacgtacttctgacggcgttttacgttcgcgattgcggcgatcggcacatggcagtagccgccgggattgttcaccagatagtcctgatgatgtgcctcggccgggtagaagttgcgcagcggttcgaccagtacggccgggcgctgcggctggcggtcgaccagctgctccaaggccgccacatacacggcgcgctgcgtctcgtccgtgtagaacatgccagtgcggtactgccggccgcggtcttcgccctgctggtccacggagaacgggtcgatgacctccaggaacagcaatgtcagcgtccgcaggctgacctgtgccgggttaaactcgactttcacggtttcggccgcatccgtgccgcccgcgcatacctgctcgtaggtcggcgattcgacggtggattgcgcgtagccgaccgtggtgtccgtgacgccgtcgacgttctggaagtagcgctccagcccccagaagcagccgccggcgaagtatgcggtttgcgtattgccgtcattgtgttcgttacgttcgctcatgcgccccacgttactacgtcgaggcggctcgcgatgcagtcaacgacacctctgcaccggcaaaaccgctttcgaggggctgattcggccttcgcaggaggtctactcccgtttcaaggggctggtcggcagctagaccgcatgtaaaagcccatccgcgtcaacgccattccgccgattttggagcgtgaatactcggccatcagcccctcgaaacgggagtagacctcccggagaggccaaatcagcccctcgaaacggagatagcgccttctgcgcccttctcgctgggctttcgccgctcaaagaggtacattcgggcttctgcagaatgctttctccgttcaaagaggtactgaatacgggaaaccccgagtacaaacgccgtcattgcaacgctcatactcgggatttcagagtttaggtatctctttgaaggcagttagctgtccgcaagaggccaaatgtacctcctgaaagcagatagccccatcttgggctcgaatcggtcagtctccgtgtccgtacgtgaacgaacaggcaaacggcctagagcctcaaccgcgagcacaattgtcagggtccgccccgcaccctacgaccgcagcgtgctgagcataccggccacttcggcgggcgtcacgctgggcacgtaggcgcgcaccaccgcgagcccgatctgcggcaacgccgccgggtccgggtagcacacgtagaccggcgcttcggcgggctggaacttgcgcttgaagttgaacagcgagtggaagccgtaggcgggttccatccagtcggccacgatctgcagcgcgtgttggagcacctgcgtgccttcgccggccgccaccccaccttcccgggcattgtctcgctcggggttcatgccggccaagggtgccgcggacagactcatgaactccacggcatgctcaggatccgcaagcccctcgtcgcgcaggcgctcggccatgcgcgcgatcaggaactccataatgccgttgggactgtcggtgcgatggcgcatgaagtccagcgtccagccgacgatgcgcccgtcgcgccaggtgggcagccagctggtgacgcccagcacgcgaccgttcgcgtcaatggcgtacaacagccgcacacgcgggtcgcgcagttcttcgacgccgccgagcgtgaacttcatttccggcagcgccttgagctgcgcccactcctcggaaatgtcctcaatctgttcgcgcacgtcgagcgacgcctccaggaacgtggactgcacatcggtcacgccgtcgcgcttggccttgttgatggcggtgcgcacatcctgccatttcttgccggtcgtcttccagccgcgcgggtccacgaccatttcgctgccgacctcgatggagctccagccggcctccagcaacgcgtcgcgctgttcgcgatgcacgctgtagaacaccggcgaaagcgaccgctccacgcaatactgggtgaagccggtcaggtcgtccatccactcggagggctcgccgaacggcccggtgcaggtcaaggcgatgccgttgagcacgcgatatgccacggccgatttgcccgtgggcgagagccagtagctgttgccttcccacgtagtcatgaagctcatcgattcgccgccggtttcgaccagccgctcggcgcgtgcctgcgcccgctcgttcgattcgctcacgtcgctcatccagcggatcaccacgaccagcaccacgatccagaacaccaggccgacgccctgatacacgatcgaggccatcggggtacgcggcacgaacgacaacttcatatggctcaggaagccgatgggcaggaagcgccccggcagttcggccaacagcgacgaggccgtggcacgcggcgagaattcatccggctgggcgatgccgtacatcaggtacacggcggcgcacgccagcagaaccagcacgatggcgccgacgccgccgatcagtcgccgccagccgacgcgaatcgggaaatgcttcaacgccgcagtcaaggcgacggcaaagaacagcggcggcaaggcgttcgccacgcaggcggtgatcgcgccgtgctgcagcagtgaggtcatgccatccggcgcaaagctcagcgggacgaccaggtaatagacgatggcaacgcccgccgtgaacaggttgatggccacggcgcaggtggccgcgaaccgacggccgcggtacaggccccacgccagcaccagagtcacggcggtgggcagcagcgaacgcagtaccgcgcccggcatcgaggctcgcaataggtcgaattgcaggaagcagccgctgtgcgtggcgccggccaggcagcgcgcgagcgtgccgtcgtcgacggagaccgggctcatgagcaggccgactgtgctgagcggccccgcgtgattatgcgaggtgatggcgatgaccggccccagcgccagcaccacggcgatggccgcaaacatgcgccgcgcctcgaaggaggtgctgcgcagccagtgccatccggtttcggcgtgcgcgggcggcccggccatcacgcggccgaccgcgtgtccgatcagcgcggcggcgagaatgcagtaatcgccaggattgccgctgtaaagcagcgcgaccagaatcgccacgtagccgatcagccgaatacgccgccgcaacagatggctgcagaacgcgctggccgccataagcgcgccgaccggcaacaccagcgggctcaaggcgaactgcatgcgggagacgaattgggagtcctggaacagccatccggccgccgcacacaaggtcaggcccacgatcacgccgccgagcgcgcaggcgagcgcggtgccgacggtacgtgcgcggccaagccacggctcggcgattgacagcatgacgagccacagcacggcatcaagaatgagctggatgacgccgcgcgccaagaacagcgtgcagaagagtttgccgaaatcgaattcggccatgctggtgtcgagccgcagcgggaacgcgaatccggccatcgcgaccaccagccacaccaccaagttcagcaccaccagcgccaccgtggcagtgatggccagtcgatgaccgtccgcccactgtcgcacgtcgccggccagttcgcgccagctttccgccgcatgactgttgtgcttacgcaattcttcgctcattgcaacacctccacttgtgggtactccttcaacgatttcgtcatctcgcccaagccggtccgttcgccgaaccagtcgagaccgggccgccagaccgcctgcaccgcgtgccagtcgtggccggtgccgggcacgatcagctcgatgacctccatgccggctttgcgcgcggcggcggcaatcgtgcgcatgttgctaatcgattccttgtcccgttcgccagcaccggtgaacagcgcctgctcagatgtgccggtggaggcgatggcgttgaccggcacctgttcgtcgtatgccttgcggtcgccggcgaaatactcctggaccatcttggcgacgctgccattggtcggcttgagttcgccgtccaccggcagcatcgcgccgtagatgtcggggtggcgcgggacgagctgcgtggtgcaggtgccgccttgcgagaacccgcccatcgcccacatgcgggccgatttggccacgggcagcatcttcttggcccagttcaccacgtctgtggtgaggtaggtttcggcgttgccttgcgtggtgtcggcgcacaggctgttgtgcgtggcctcgccgttctggtcgggcacgagcacgatcggcgcgagcccgtcatgtttggcggcgtacgcattcatcgtggcggcgatgttgccggcgtcgatgaggcgactggggctaccgggctgcccggccaacagctccatcaccggcaaggccggcggacggtcggacagcgcggcgggcggcaggtagatcatcgccttgcgggccgtgaagttggattcggtgttcggaatgtcgacggtgagcaccttgccttggctgggcatggacggcaggctgcccttccgcgccttgctatgccagtcgctgacactcatcgcggccttgtgtacctcgattgagccgagcgaggcgtacggcgtgtagccgacgagggtgccgatggtctggtattcgccgtaaatcgagtccacgccgagcgcggtggacagcagcaccagcggcaccagcacgacggccagcgcacggcggaccccgcgcagggtcacggctgcggcgatcacgaagccgacgccggcgatgccgcccgcgatggtgaagatcaccggccagcccagcgatacgccgaacaccataaacacgtcggacaccagccatgcaaccagcagtccagccgcgccggcgagcacggcggcaatcagcgagacaatcagcgggtgcaggcggccgcgcttcttgctcttgctcaatgccagcccaataatcagtatgattgccgcgatcgcggtcagtccgaacacggtccgcggcacgattccgcggaccagagacaattccatgaacgttttccaaacggagttcttcatccttcacccccgcgctccaggctcctcgccttgtaagctcacgcaacactagcgcgcgattcatagagcgtcacccaatttcacaaaaattgtcgcgagttctcatggtttccccagactccgttcagcgcctgttcacatccggtctggcgcccgcagttcaaggccagtgtcggcgctggattagcggcgcgcaggcttgtcccagcttcagccggaagcagggaatatgctggtggatatgactcacgcaaacgaacaacgtccagcagcgaccggcaatgccgccgataacgtgtctgacgcccctactggccccgcgacgagcgcggcggcaaggcccacgaccgtcacggctgatggcacaacagccacaaacgccgcggccagttcaacagcaaagcccgcagccagcacctcttgggccagggaaaccaacccacgtcgagcactgttgacgattatcgtcacggtggtggttgtggtggccatcgtactggggctcggattcttcgtgaactggggattggcggcccttttggtgatcattatgattccgggggcgatttcgctggccgttctcgccaagcaccctgaatccaccggcgggcgcagcatgttcggcatctccgatccgaatacgctgcttgacccgattcgccgcccgtccgagcgccgcggcgagtaagttgctgctgcccatcgggcggtaatttatccatggggcggtaaaaggcccatggggcggtttgaagaaattgtgaaaccgcagaataaagtcattttgggataccgccccatgagggttttaccgccccatgggattattaccgccccatgagcaaagccaccccgctatttgcgcgcactgaccaagtaattaagcaccgatccgacggccaccagcagcgcgccacaccaaaacggcagcgacagcgccaaacccagcaacaccgcactggccccggtggacagcaccggcgtggcataggacgcaatagcaagccgctccatagacccatgcagaatgccatagccccagcaggcataaccaccgccaatcgccgccgcggcaatcaacacaaacagccatgcgaccagactcggaggctcggccggccacccctgcccggacgcgaagtggataatccacaacgccacggccacgcaggggaagaacaatgaagtgccgtccaccccatgactcatggctggcgtgaacaccgcgtacaccgaccaagcgagcgcgcccacgaacgccagcgcatagggcaaagggttggcggcgatatgctgcacggccgcatgccagtcgagcccggaattaccgccgaccgccaacaccacgccggcagtggccacgatcgcgcccggcagcaccttgacgaccgcgtgcttgcgatgggatacgcccgccgacagcagcaccatcatcgtgggccacagatagttgaccaggctcacttccaccgaggatgcgtcggtagaggccagacccagcgagagggatatcgacgattcgtaaaatacgaacaacaggccgccgataatcaggtatttcttggggaactcgcgaatcggggccgggcgccggaacatcagcagcaggatgccgccgaccgtgtagatcagggccgagccaagcgtggcgccgaagttttcggagacgatgcgcacggtgccggccatgaagctccacagcaggattgccatcaggccgatggtcgtggcgcgcgcggatacgacgtggccgccggaatggcttgccgccggtgccggtgtgccgcttgcgttctgtgcgccgttcgccatatgtccgcctctctcgcatcgtttcgaagtcactctacccatcggatgtgtacagcggcagaacggcacgcgaccggcgcgcgaacagggtggggttcggtgattgaaacagcaaaatgccgggtagggtaaatccctacccggcatttgcattggctatgtttcccgccgtctgtcaggttagtcggcgttgaaagcgtagggcagacggcgtgggaagcatggtttggttacgatttatctctcccccacccgcttcgcgggagccccctcgtcagagggggcaaagctactcgaagcgggacttcgggacgaatcaagtatcgtcagccctcaatcgcgatttggtgcttggactcgacttgcggctgggcctgcatcttcggaacctggatgcacagcgtgccgttccggtagctggcgtggatgtcggactccttcacgtcctcgccaacgtagaagctacgcgagcaggagcccatgtagcgttcgcgacgcagccacttgcccgaatcggacgcgcaagcacacttgctgtcggaagcctcgtcctcagcggccggagccttgtcctcatgctcgctgcaacgcgaggcggacacggtcagatagccgttgttgagctcaaggttgatatcttccttcttaaagccaggcatatcgatgtcgacgtcgtaacccttgtcggtctcgcgcacatcggtagtcatcatgttggcgggcattacggcactcatcgtgttgtccgtgttgcgccaaccctcaaagaacggatcatcgaacagatccgagaacatcgtgtcattcatcaaagccggaaacattgccataatcggtactccttgattaggagagaatcggcttggctgccggccgccaacccgtatcgcggggctagcagcggttatcgtggccggttccggaaccctcccgggctctcaacctttaaccttcacttcacccaattcccgagcgcggcaatcattccgggattatgcccacagagaaattgcggcgggaatagttgccggtaaagccggccgagccgagcgccgtgaccaccctcagccagtcttacggctgccagctcccgccagcgggagcatatatacgcacaccagtaggcgtactcatatacctctgccaacgggagcatggttgcacgttcccgcaaactccgccaacgggagcatgctggcgcgcgaacggctcacatctgctgggcgttttcgagcaaggcgtttttgaggtcggactcgatttggcgcatcttgacctgggcggcctcgcggttggcctcgccttccttctggatctgcacggtctccttcagggtggcgatgagttcggcgttgatcttctccagcgtgtcgatttccaccacggaacgctggttggccttttccgcgtccactgcacccttgtgcagggcggccgcgttacgcgccagcagcttgttggtcacatcgtcggccttgttctgcaggtcgagaaccttgcgctggttggacaggcccagcgcgatcaccatctgactcttccacaccggaatcgtggtggagatggtggtgtcgatcttgtccacgatggtctggtccgcgttctggatgattttgatctgcggcgcggtctgcaaggtaaccacgctgatgcggtcgaggtcgtcgagtcgcttggcaaaacggtcgagcttggacttgaagtccttcagcacttgcgcctgcatggcgtcgccactggcggcggcctcggcctccagcgctggcagctggttggcgttgaagtcggcgagcgccttcttgccggccagtacggtcattttcagctcgcggtattgctgggcgttctgcgtgtacatcgtgtcgtacatggagatgtcggccacgagtttggcttgcgcggattggagggtggtgatgaggtgttgcatggcgtcgttgttgggcagttcggatacggccgggatctggtcgagcgtgccggccacgccgaatcggctgatcgaatcggtgccggcgaagttggccgcgcggaagccgtggcgctcccacgccagcttctgcgccgccggtgttttcaacaggttcagcagtgtgtcgcctttctcgtccaaggccatcagcgtgtgggtgctccacacggtcggcgtcgggtagacgatgaccacgtcgtccttgatctgcttgaacgcatccgtctggttcacggccaaatcaagcacatgtgatacgcgcccgaattgtccttggtcacaagtccgccgttcacgagcccgtccgccacggccttgtgcgtgtatagcacaatcggtgagttgaagacgatgtcgctttggggggccttgacgcctttcgcattgccgtattcgacggccgcgcgcgaggaggggaacaggtaacccatgcctttccggtccgtatccatcatggccggcgatccggccttgcgatagtcgatggcaatgccttgcttggcggcgagcgccttgaacttggcgtcatcgaacaggccgattttctcgccgcccaggtagccggtgatgctcacctgttcggtcggttcggccggcgctggttgcgattgccgccacaccagcgtgccgcagaccacgcccactaccgcaagcagggcgatcagtccgatgatttttgatttggagagtttcattgtgcgtccgttttctggtccgactggtgagccgggccgccagatggagtctgactgggtgcatgccgtccttcatcagcagccgaggaaggcacaggcgaaggtgcgacgtcgtcgtatccatccatgcgggccaaccgttggatggcgtcggagtcggccgtaatgcccaacgtcttggcgcttaccgcccggctgagttcgccggcggcggtctgttcgagcacttgcagcgcctcgatggtttcgattcgtaccgtggctatctgatcgcgtgcgccggaactttccacgtccacgtaggagcgcaacagtttctcggtctgctcgccgtacacggtgatgtagtggcgcaacgtcgggtaggcggaggtgtctcgggtcacgtattgcactcaatctttggtagcggcgatgaagtcgttggcttcggctttgacggctgggtcacgtacttgcttggtgagcatggcgatcgagttgagttgagcgttcgccgcgtcgatcgtatcggcggtcttctgaccgttgggcaaggcggaaaccagcattttgccgatgcgtcgctccggctcggtgagcgtggaggcggcgatatacccaagtgcggccagtaccacggccacgatcaggccgggcactccgccgccgaccagtccgaaaccgagcccggcgagcagcagtccgacaacgaatccacagattacctggagcatcagttgaagcccttgacttggcggaagacggcggcgaggtcgccggagcggccgtcgaataccttggcgttgctcagggtggcgagagacttcagctggctgggatcggcatcgccgaacatgatggagaagatcggcagatcacggccgcgcgacttataggcgctttcgaattcgtcctgatgatcggagttggagcggccgtcggtcatgagcacgatggcggtggtgtattgcgaggcttccgactcgctgggcagctcgtcgagcgcgctcagcaggccttcatagatatcggtgccgccgctggcatcggtggcatcggcctcatgcagcaggtcgctggtgcttgtgccagtggccttgaccgggcggtgggcctcggtttcaaacgggatgagaatgttcacgtcgccgctggcgggctcgatgtacgacttcttggcctggtccgggtcgagcgccgcgttcaggcctttgaccacgccgttcttgccctctccagacatcgaaccggagtaatcgaccacccaaatggtccagctgggtttcctgagcgcggtctggtagacgttgagcgcgctgtcgatcaccgtggcggaggtcatggagaacgtgagtttgccgtcgctgaccgcggcgaggatgtccgcggtggagacgggcttggtggcgccggtgtcgtcagcccagccgagtttgacggccttggatttggcgatgccgaacacgatcggcgtggtggaggtgctggccgcgtctttgacgatgtgcttggtgtctcccatcgaaatccacatcgaggaggcaggccagacggcgtcgtgatcctggccgccggccttgagcgcgttcataatctccagcgaacccatgtagtgcatcgtcacggctacgttggattggtcggccgctttctggatggcgacggcgacttccttgttttcggagccggaggcaatgctcagggtggcagtcggtttgccgccggacggctggaaggtctgcgtggtggcggacgtgccgttgccgtccgctgtgccgtcatcggaattattgaacgccgtgcaaccggtcaacgcgagcacgccggcacataccgcggccgcaaccgcggcggcggagagaagacattatgcccataattccatggctctcccgccatctaaagcgggtcgggccacaaggtgaccgcacggtgaacaatgggtgaagagctacatcagtacgcggcgcaggcaatcatggggtcgtcgtagaagccgaggatcttttcgaggtagggcttgtaggtgctgttgggcatggagaagatttcgtggcgcgattcggggaagcgcacgatgttcgcctcgccgccgccgtccttgaccagttggacgaagtgattctgcggcttattgagtacccagatgtcgcgtccggactggaagagcagcaccggcgtctccacttcggcgcaggcggacggattcagtatggcccggttgagcttcaacgcttggcgcacccattcgaacgccgcgcagtaggtctggtattcgcggttctcgcaacgcagcttgaagtaccagcgttcacgcgcttcggaagcgccctcgttgccttccatcgagaattccggcgtgaagtccgactgcccgaacacgcgcttcttgccgaagccgagtccgcacagcgcgccgaccagcacacgggccacgcccagcggcatgccggtggcgggggcgatcatcggggcggagagcaccgctttgtcgaacagggtggggtatcgctccaacacggccgcgccgatgccgccgcccatcgaatggcagaacaggttcagcggcatgccggccgcgtactgctggccgatggtttcggcgaagccggccagatcggccacgtagcgctgccagtcatcaatccacaccatgcagcgattgtccacgtcgcgcgcggacttgccgtggccgcgatgctcgagtacacacaccgagtagccggcgagcagaaaataccagacgagctcgtcgtatttctcggcgaactcggtgaagccgtggctgatgacgatggccccgcggaagatggcggtggcgccttgctcgcgaatcgcgtcgaatttggcggagtcgtagcacaggtagtgcagctggcccgagcggccgccggtgtccataatgccggacagcggctcgatcccggccgaacgttcggcggcggacggatcgaaccagccctcctcgcggcattgttcgagcgcgggcagcaccacgtcggtcatcgtttcggcgtacttgttttcgtcgatcatcgtcacctgcatggttcccatcttaggacaagcctcacgcccacacctcgcacccacacccacgacacaatcccgggaatgttgcgctaatcggacctaccgagacccacttcgcgaaacaatcccgggaatgcgtcgcaagcctgcgcgccactgaccgcacaggcgcgtaggttgtgaggtatgagcgaaaccaatgatgtcaatgacgcaatcaagcatttcccacgcctccgggcgcgcacgctgcgcttcggctgcggcgcaccgcgctccgcacagaccgtgggcgacggctcgcgggccctgttcctgcgctccgacggccccgaggatctggtgaccgcactgtggctgagctggttcgacgagtccggcgaacaccatgagaccaagctggccgacccgcgcgaactgctgggcgcaaccgccgacagcgaggacgtgccggccgaggagaaggcccgccgcgagcgtgcgcgcgaaggcggcaccggcatcgtcggatactccgcagatgacgacggcaatcgcatcgtgttcaccatcaacagccgcctgttcctgaccgacatcgattggaatgacgagaccggcgcacccgagccgcacacccgtgaactggccggcgaatggctcgatgaggacccggcgatgtacacgccggtgctgaacccgcgcatcgccccggatggcgaacatgtgctgtacaccacgggcagctacctgatgctggtcgatatcggcggcgaactaggtgaccgcatcaccgccgtctacggcgtgagcgtggaggatgaggacggcaatccggccgaaaacacgtggaaaatcggtctggccgagttcgtggccggcgaagaaatggaccggtacgacggtttctggtgggccccggattcgcagcatgtgctgttcgagtctttcgacaccgccgacgagccgacctggtacatcagcgatccggccgaccccgagaagccggacgccggccgccgctacccgcgcgcgctgacccgcaacgccgacgtgtacctgaccgtgatcacgctggcgttcgatgagaacgaccggtacgcgggcatcaccggcaacgccgatgtggattgggatcgcgaggcgtacgagtatgtggccgccgtgaactggcgtcgcggccacgatccgctggtgctggtgcagaaccgccgccagacccgcgatcaggtgcttgaggtggcggtcgaggcggatggggccgcgctgggtgccacgcgcgtgcttgaggagcacgcgaacgagcagtggatcgacctggttcacggcacgcccgcctacacgccggatggtcgtctggtgtgctcgctcaacgatatggccacggacaccaaccgtctgacaatggacggccgcccgttcacgccggctggctggaacgtgcgcacggtgctcgccgtgaccgacgaggatgtgctggccgtggtgcagcgcgcgcccgaaatcgcgcctgaggtgccggacgcttgggccgatgcggccgccaccgagtccgtattcggcgaccacgacgcccgcagtttcgacgtggtgagtatcgattacaacggcacgatcacgccggtcacgaccgatcccggccagtggaccgcctcgcgcggcgagcgcggcatcgtggtctccggccgcgatatgcgttccgcccgcgcccagatgcggcatattctgggagaacagagcgccactatcgcgtccacggcggccgaacccggctttacaccgaacgtcacgtttacgcgactgggcgagcaccagctgtacacggcgatcatcgcgccgagcccggaaagcccgtacgcgcacgccgagaagctgccggtgctgatgaagccgtacggcgggcccggcttccagcaggtcatcgcctcgcagtccttctactgggagggccagtggtgggccgaccaaggcttcctggtggtcacggcagacggccgtggcaccaccggccgcggcccggcatgggaccgcgagatcttcgaggatatgaaggacgtaacgctggccgatcaggtcgaggccgtcaacgccctgcccgaggccgtcgcccggctcaacgccgatgtggaatcacgtgcggcacagccggctgcgggcgatcaggcagacgccgagaaccacccaccggcgcttcgcgccacctcccgccagcgggaggcgattcccatgccggacctcgacaaggtgtgcatgatcggctggtcgtacggcggcttcctgtccgcactggccgtgctggacgcgccgaacgtgttcaaggccgcatgcgccggcgccccgcccaccgactggacgctgtacgacacgcactacaccgagcgctatctgggcctcgacccggatgtctactaccgaaacggcatcgtgcaggacgcaccgaaactcgagcgcccgcttatgctgatccacggtttcgccgacgacaacgtcaccatcgcccacagcctgcgcctctcgcaagccctgatggcggcgggtcgcccgcacaccttcctgccgttgacgggcatcacccatatgaccaatgacgagaccgtggccgaaaacctgctcaccctccagcgcgatttcctgcgcgacgcgctggcctgacaaatcgataacacgcgcatcccacccgaggtgctccaccggtaaagcacctcgggtggtgcgccgcacccatttccgccctgaatttttggatattttgcactcatcgtcacgtgaaagaccggttttttgtctcatattcccatcaccgcgtaggatgggtgaagattagaaagggaggactatgagcgttctcgaccgttttgaaaaaagcgtggagggtgcagtcaacggagtattcgccaagtttggctccaaagacctgcagcctgtcgatctttccagcgccttggagcgcgagattgacgccgaggccatgcccgtgggccgtgaccgcacggtggccccgaatgaataccgtttcaagctcagtactcctgacttcgaccgtatcgaggcatggggtagcgagaccctggccaacgaactggccgataacctcaccgagtacgcgaagagccagcattacgccttcgtgggcccggtgatcgtgatcttcgaggaagaccttgacctgtccaagggcaacttcaacctcacctccgaatccgtgcagggcaatgccgtgccggtcaccaccgatgcgcagaccgaggatagcccggtgctcgaggtgaacggcaaccagtacctgctcaccaaagacaagacggtaatcggccgcggttccggttgcgatatcgtcatcgacgatccgggcatctcccgcaagcacctggaaatcgacatcacggataacggcgtgatcgcccgcgacctgggttcgaccaacggcacgtacgtggagggccaccaagtgcccgccgccacgctgctcgacggcaacaccatcaccatcggccgtacccgcatcctgtactgggcctccgcccaagcccaggagtagtcgagcacacgcccgaaagtcgtccacttatgaccgaactgacattcgccctgctcaagtatggattcctgatcctgctgtggatattcatctggctggccgtacgttcgctgcgcaaggacatcgagacgttcagtccgcgaccttcgcgcgcgcgtcgtcgccgtgagcgtgaagtgcataaggccaaggccgaaacgccgcaggcagctgcgccgcgcccgcatcgccagcccagcgcttccgcgtcgtccgccgcctcggcgcagcctaccctgttggtcatcatcgatggtccgcttgccggcagctccgtgccgctggccgaagccgacatcacgcttggccgcgccgcctcgaacaccgtggtgctcgatgacgaattcgtgtcttcccaccatgcccgtgtctaccgtgacacgcgctccgggcagtgggccattgaagacctgaactccaccaatggcaccgtggtcaaccagcagcgcatcaaccgccccaccattctgcccgctcgtattcctgtgcgcatcggcgccaccaccttcgaactgaggtagccgcatgccaaaatccgccgcttcacaaccgctgttcctgtattccaccacggtgtccgatgtgggcaccgtgcgcgcgaacaatcaggattcctccttcgccggcgagcatctcatcgccatgtgcgacggcatgggcggtcacgccggcggcgatacggcatcctccatcgccatccggtcgctggcccacatcgagcaggatgacaccggtggcaacgtcgagacgatctcccgcatgatggaaacctccgttatggccgcgcatgacgccatcgtcggcaaggccaagcgcgaacgcaagcttgccggcatgggcaccaccgttaccgcagtggcattggtggccggctactgggtcatcgcccatatcggcgattcgcgcgcctacctgctgcgcgacggacgcctgagccgcatcacgtgcgaccacagctacgtgcagcacctcatcaacaccggtcgtatcaccccgtccgaagccaagaaccacccgcagcgcaacgtcgtgatgcgcgtgcttggcgactttgacattgacccgcgcccggatatttcggttcgccgagcccaccccgccgaccgttggctactgtgctcggacggcctgtgcggtgtgctggaagattccaccatcgaagagacgatgaccacgctgtccgatcagggcgaatgcgcgcagcgtctggtgcagatggcactgcgggcgggcagcaccgataatgtcacggccgttattgcggatgccacgttggcgttggatgccgatgcgttcgacctgccgcaccaaacgccgttggtcggcggtgccgccagccgtaatcttgagccgattgccgacatcgtcaacgagccggtggctaccgcgcccgcactgcgtgaggatgattcccccgcccagcgcgccgcagcattgattcagcccgccagcgcgcacgaggcggagaccgcgcaaaccacggccaaaccgtcgtccacacgcgtggtgcagccgtccaccgtccgcgaggagaccggtgaacgagccaatcccgataccggtgagattccggtggtgcaaaagccggatgggcgcctgtccgccgaccccaacgacccggatgtggccaaagccatccgcgatgagcaggtcgagcagaagaaggccacgcgtaccaagaagcgccgcaataagcttgcggtgattattacctgcattcttgccgtgctggcattggccggcgctggctggggcgcgtacacgtggagccagacgcactactacgtgggagatagcaacggcaccgtggccatttatcgtggcgtgccgaccaatctctttggacttgagctttcgcacgaagtgcagaccaccaatatcgccaccgcggacctgcctcagacatggcgtgaccagctgagccaaggcatcacagtcggttcgttggacgaagcgcagtcgcatgtgggtattatccgcaccgaaatgcgcaaactggccaagcagcaggaagccgacgccgccaagaaggccgaggcgtccaattccccggacagttccaaagacagttcccagagcgattccaaggacggcaccaaggattcgtccagccagtccggttcgtcaagctcatctgattcctcggataaatccggtatcggagcggccgacaacgcggccacgggggattctcaatgatcgctacccgtctacgtcagatttccttgttgctgattgccatggcgatcagcgcgttggcgttcatccagatgttccaacgcaccgccggcgaattccctatgcaatacgccggcatgctggcattggtcgtagtgctgtttctggtgctgtgggggctgattgtgcgcttccagccgtacgccagccagtcgattctgccttgcgtgctactgctgaccgccactggcgtgaccatgatcgcccgcatcgaccagagcgaaggttgggcggttgcccaacgtcagctgatctggctgtgcatcgccatcgtgctttccgcgctgctcatcatcttcctgaaggactaccgcgtgctgcggcgcttctcctacgtgtcgatggtggtgggcttggtgctgctgctcgccccgatgctgccgtttgtcggtcaggaagtgaacggcgcgcgcatttggatcaggattccgggactgggccagttccagccgggcgagttcgccaagctgttccttgcgttcttcttcgccgcctacctgttcgaccatcgcgaccagctggccgtgggcggtaagaagatgctcggtctgcagctgccgcgtatcaaggatctcggcccgatcatcgtggtgtggatcgcctcgatgggcgtgctcatcatgcagcatgatctgggcacctcgcttatgttcttcgccatgttcgtggccatgctgtacacggccaccggccgtaaaagctggatcatcatcggtctgatcgcgttcgccgcgggtgccgtgctggccgcaggcatgttcagccacgtgggtcagcgagtcgatgcctggctgcacccgttcagcaacgagcaatacaacaagacccccggcggctcctggcagctggtcaccggcattttcggcctggcatcaggcggcatgctcggcaccggtctcggccaaggccatccttcgctcgttacgtttgcgaactccgatttcatctacgcctctctgggcgaggaactcggtctgatgggcgtcctggccattttgatgctctacctgctcatcattgcctccggctttatcaccgccatgaaaatcaaggatggcttcggcaagctgctcgcttccggactggtgttcaccatggccttccaggtgttcaccgtggtcggcggcatcacgctggtgattcctctgaccggtctgaccctgccctatatggcggccggcggctccagtctgatcgccaactatattctcgcgaccctgctcatcatcatctcgaactcggccaatgcgcccgagccggagctgacctcggatacgttccagtacgaggctttggccgtgctgcgcaacaaggaacttgaggcccgagcccgcgccactgagccgatcgttcagcctcgcagcgcgtcggctacggcgtcgcagtccgaggcggaatcgtttgacgaccccattgtggatgccaccactccggcgtatgccggcgccgatgaaccgtacacgcctaccggtacgattcccccgcttcctcccgttaacggaggcactcgcgtatgaacaaatatcttcgtcagcttttcaccgccgtggtcgcgctgttcgtgattctcggcctgtcgtccaccatcatcatggcggtacgggccaacgcgctgaacaacgatccgcgcaacgcccgttcgctgtaccaccagctcggtgcctaccgcggtgccattctggcctcggacggcacggtcatggccaaatccgaaccggtcaacgacgcgttcaaatacctgcgcacctattccaacggtccgctgtatgctccggtcaccggcttcttctccatcaaccagaccgccgatcgcggcctggaagcctcccgcagcatgctgctcaacggtgaggccgattcattgatctggcagcgggccaaggccatgctcaccggcactacgaatcagggcgcgtccatcgaaacctccatcgaccccaagctgcagcaggttgcctacgatcagctcggtacgcgcgatggtgcggcggtggccatcgaagtcaacaccggccgtatcctcgccatggtgagcacgcccagctacgatccgaacaaactggcgacccatgacgccaaagccgcgtctcagtcctacaacgaactctctgcgggccaaaatagcccgctaatcaaccgcgccacctcgcagctgtacccgccagggtccacgttcaagaccatcgtcgcctcggctgcgctggaaaccggcgattatcagacggacacgaagattcctgcaggctccagctataccttgccgggaaccgccacacagctgccgaacgacgaggcacagggcgatggcgtcaacggacagatctccctgcaagaggccgtcgcatggtcgtccaacaccgctttcgcccagcttggcgtgaaactcggcgcgagcaaggtttcggacatggccaccaagcttggtttcggcagcaccatcaccattgacggcaccgaatccacgggcaccccgatgacggccaccgcgtccacattcccctctgatccgaccgacgacaagcttgcgctggcgtccatcggccaaggcgacaccacggccacgccattgcagatggcgatggtcgcgcaggcaatcgccaacaacggcaaactgatgcagcccacgctggtcgatcgtgtgcgcgccgccgatctcaccgtgctttcgcagaccaagccgcagaccatggccaacgcattcagcaaggattccgcagacaagctcaccacgatgatggagagcgtggtgaccgaggccaatccgcagctggccatcgacggcatcaaggtggcggccaaaaccggtaccgcacaaatcggtatcgacaactctgccatcgacggctgggtgatcggtttcgcgccggcggacgatccgcaaatcgccgtcgcggtgttggtgcataacacagatgtatacggttcgctcgccgctggcccgatcatgcgcgcgatgatgcaggaggctttgcagcagtgaaacttatcgaaggacagcttattcaccgccgatatcgtcttgattcgcgtcttgcgcaaggcggtatgggcgaggtctggaaaggctacgatattcagctcggccgtgaagtggccatcaaggcgctgcgctcggacatgaccaacgccgaggccaagctacgccgtctgcgtgccgaagcccataattccgccaatctggcgcatccgaatatcgctgcgttgttcgaatactacgagcatgacggcatcggctttctgattatggaatacgtcccctcgaaatcgttggcggacctgttccacagcaagggcgcgatggatcccatcgaactgctgcccatcctgattcagaccgcgcgaggcctgttcgtggcccactcgcacggcgtgattcatcgtgacgtcaagccggccaacatcatggtttccgacaccggcgaagtgaaaatcaccgatttcggtgtgagctactccacgggtcagggccagatcacccaggacggcatggtggtgggcaccgcacaatacatctcccccgagcaggcgcagggccagcaggccacgccgcaatcggacatctattcactgggcgtagtggcgtacgagggccttgccgggcatcgtccgttcaccggcaccactccggtcgatatcgccgcagcgcacgtgaacaatcccgtgcctccgctgccggactcggtggacgtccagttacgcgaatttgtcatgtcaatgctggccaaggacccgttggatcgcccgaaagacgcgctggtggtgtcccgtacgctggcacgcatcgaacgccgtctgctggatcagcagaccgaaatggccgacaccgccatggccacgtccggcaatcgactgccgcgccgagtgaccagcacgccacgcattgttttggaggccccggcctcaagattgggagggaataagcaatgagcaccagtatgcccaccgcattggccggcggacgctaccagcttggccagctcatcggtcgtggcggcatggccgaggtccacgtggctcttgacacccgtctgggccgtaccgtggccgtgaaaatcatgcgcgccgatctggccaacgacgacatcttcctggcccgtttccgccgcgaagcacacgccgtggcccagatgaacaacccgaacatcgtgaacatctacgattcgggagaagaactggtttcttccgaaagcggcgatgccgagcgtctgccatacatcgtcatggaatacgtcaagggccagaccctgcgcgacatcatcaaggtcaacggcgcactcagccagcgcgactgcgaacaggtgatgttgggcgtgcttaacgcgctcgactattcgcatcgcatgggcattatccaccgcgatatcaagcccggcaacatcatgatttccgagcagggcgtggtcaaggtcatggacttcggcatcgcccgcgctctggacgattccgcagccaccatgacccagtcgcagggcgtggtgggcaccgcacagtacctttctcccgagcaggcgcgcggcgagaccgtcgacatgcgttccgacctgtattccgccggctgcgtgctctacgagatgctcaccggccgcccgccgtttaccggcgattccgccgtggccatcgcctaccagcatgtttccgaagtcgccacgccgccatccgccgtggtgccggggctgccgaagatgtgggattcgatctgcgccaaggccatggccaaggaccgccagaatcgctatgccacggcctccgaattcaagaccgacatcctgacctacatgaacggcggcgtgccggtggcggccgcgttcaacccgttgacggacctgtcgaatatgaaggcccgcaaggaagccgaacgtgatttgcccaccacgccggtggaaccgcatcagcaacccacccaagcattcaacccggtgaccggtcagttcgagcagattccaccggccaatggtgccaactcagcggcgttgcagtcccgtgcgcagcagcgtgcggcggcggccaaggccaagaagcgcaagaagatcatcatcggttcggtgatcgcagcgattgttgcagtgcttgtcattgtgggcatcgtgttcgccatgaacggctccggcaacaagtcctcggaagacaccgtcaccatccctgaggtgtgcaacgcttccacatccaaggacagcatcgagctcaaactcaaggcatcgggtttgaagatgaccgaaaagcaagacaccgactccaccgagccggaaggcacctgcaccaagatgagcccggacgccggctccaaggtggccaagggatctgccgtgaaggtgtggttctccgcaggcccgcagtccactcaggttccggatgtcaaggaacgcagccaggaagaggcgcgcagcattctggaaagcgccgggttcaaggtgaacgccgccgtcaaaaccgaagacagcgccgacatcgccaaggatatggtgacgaaaaccgatcctgccgccggtcagtcggttcccaagggcaccaccatcaccatatatgtttcttccggcatgaccaccgtaccgagcaatttggtcggtcagtcgaaggacagtgtgctacagcagtatgagggcaagttcagcttcactgtggagcaggagagctccgatacggtggaggccggtctgattacccgtgtaagccctgattcgggctcttccatcgcacagggcgggttcatcaccatttgggtgtccacgggcaaggagaaggtcgctgtgccgaatatcaccgctggcactgactacgtcaccgccgaactcatgctcaaggccgtgggcctcaaggctcaggccaatggtccaaccggcagcaccgctgtggtagtcagcatcaatcctggcgctggcagccaggtagatgcgggatcgaccgtcaccattaccacgaaggccggcagcactggcggcggtaccggtaccggagacggtggcaacggtactggcaacgggggcggaaccggtgagtgaaccggtgagtagcaagtaagcgccgggcgtgtatgtgttgcgcatatgcaacgcaaatagcgcaacacatacacgcaacacaaaggggaagggcttctgcgcccctcccctttgctgtataaagagctatcccagcgcaacaatcccgggaagcgtcgcaaaaccagtacgcaagcctcgttctagcgacacattccggggagagtatcgccgcgcggaaaagctacttcgtaactttgggctggaggccggcggacttggccacggcgttgtcttggccgcagaccttaagccagttggccagcagacggtagccgtcctgggtcatcacggattcgggatggaattgcacggcgtacatcggcttgcccttgacacgcacgccctgaataatgtggtcgccttgcgtccacgcggtaaccaccagcgtatccggcaccgaatcgggctcgacggccaacgaatggtagcgggtggcggtcatggggttggccacgccctcgaaaatctcgtcatcgatatgttccaccaagctggtcttgccatgcatgatggtgggcgcatggtccacagtgcagccgtacacctcagcgagcgcctgcaagcccaggcacacaccaaacatcggcacgccgctggccgcgcacaggcgaatcatatcctcactggcaccggattcggccggagcaccagggccgggagaaatcagcacgccatcgtaaccgtccagtacacccggcgcggctgggtcgatagcgtcgttacgcaccacatcaacagtggcgccaagggtttgcagatagcctacgatcgtgtagacgaaggaatcgtagttatccaccaccaaaatatgcgcggaatcggtcatagggctctccttgagggacgtgtactgcaagccatagtactaggatgccgtcagctcgctgccacgaagttcgacatctgctgtaggaatgggatattggcggcggcccaagggaatccccactggaacagcgccgcggcggccgcgaacagcagcagagccagcagcaaccatcgaatcggtgccacgccgggctgcagacgcaacagtccgccatagatgctggcatccggacggcgacgctcacccgcgcgaatctcgcgcagcaccggccagcgccatgccaccgcagcggcaatgaacagaaccagccacactaccagcgcgccgaataccaccttgtccagcgagccaatgcgggaagcgatcgagggggtttcggtggtggagaacatcactgcaccggacgaatcagtagtagccagctctttgggcacaccgtcggacactttggcccagtacgccaactcaccatagctgatccatcgatgggtgggggtggagtatttcggctcacaggtggtcagtgtgatcatgcgtttggtgggattggcagtggagtcttccggattgggggcgatcacatgcacgtccgtgggcagcacaatctcgtaccgggtgtagtggtagacgtaccagtaatccttggtacgaacgatgatgggatcgccttcctgcaacttgtccacatcgcccaacggctgcccgtagccgttgcggtggccggcgacggcgaagttgccgacctgccccggcatctgggtggtgtcgtaatggcccagaccgtggcgattgagctgctcgagcgtggtgccttccacgatgttgcggtgccattgggagccgaagcgcggaatgtagatctgcgcaatcaagtcgccatatttcgcgtctttcggctgtaccggcgcatcgccctcctgggctttggcgatggtgaccgttcccccgttgttgctggggtcgctccagtcgacggactgggtggtttcgttctgggctcgctccgcctcgacaccggtccaccacatctgccagacgatgtacagggcgcaaatcacggcagcggtaatcagcagttcggcgcagatgccgagtgcctgccagaccgggctccgctggggcgaagacgcgccgcgtactgcggcacgacgggaccttgccctactggcgttggccgggtctgccgccattcgtgcggcatcgtcctcggggaagggctgtacgtccgacacggacgcgagatcaatgggcgccggtacgccgctgttgtgcctgccgtgtctcattgctgagtctgctcctcatctgtggtctttgacgtatcgaccgtggcatatttcaactgctgcagcaaggcggcggtagcggggaactgaaggtcctcggcattctccaccttgtagccaatgccaaacgcggtcacatattgcttaagaatggtaatggcttcggagtcgttcaacgctgcgcgaagtctttgagggtcaccaatcgcggaaatggtgaacggcggcgagtatttcttaccgtgcaacgacagcacgttgccggaacagatgaccgccgaattgaacagcacccgctgatccataatcatcagcgcatcggcaccgccggcccacaaggcattcaccaccgattcgacgtcctgctggtggatcacgtaatcgttgatattggcggtcgtgccgttgttgttgactgcgttctcccacaacggagaatcatccagcgttaccgttacgccgctgccgctgagcgcgggcagcatcaggctggaatccacattgctggagtccttgccttggttctgtgtgctgtcggtgccatcggtgccatcggccttgagcgcgtccgtaagattggcgacctgtttggtcagatcgctgacgtcctgctgcagctggttggcctcgtccacgccttgctccaccagatcggccgtatcgttggtggcggcaaccgtacgattgaccctcacgttggtgctcagcagaaaaccggtcaaggcaatgacgacgaataccgcgacaccaccccatagggagtgccgtgcaccgtgcttacctacatgtctggccatgaatttcctgtcttcttgccgactctggtcgccgctttcgagtgtagccactattatgacttttagcctattgaatggagactatgctgatggctgacgaagagctgcacgaaaccgactcgaacaaccagaaggactggcagagcgagacctcatccagcaccgttgctgacgagaccgccaacaaagacaccgagcagaacgcagagaacgcttctgccgaggaagacgcggcttacggcgtgaatatggagcaggtgcaggccgtgctcaacgccactgccgataaggccacgctgaccccgcagatgcagcgtatgatgaaccgccaggcggagaacaccaagcgcgttgaagaaaccattaagggcaccaagtcgaacccgcgttggttcgtgccgctgttctgcgcgtttatgatcatcggcctgatttggtgcgtggtgtactacctctccccgtccggttcctggccgattccgaacatcggtgcgtggaacctcggcatcggcttcgccctgatcatgatcggattcctgatgacgatgggatggcgctgagttccggctcgttgcgcttatctatcggtagattgttttttctatcgttaggttgtccttaattcttatgagaaaggccgacctcccgtatgcggaggtcggcctttttcgtgccttagcctgttcatccacagctatccaccacttatccacgacttatccactacgttatccacagcctgtggatgaattacacccatgtagttttccaccgaatgtggaaaaccatgtggataagtggtggataagcggcgtttctcggtgtatatctcgtgcataactttggcttggcatacatcgccacagcgagggaacagttatacacccgagttatccactgcaacaaacccaataataccgcggcattcctaacttatccacataagttatccacagtcttatgcacttttctacacacttgtgcacaagtcaccattgtggataactcattatcgtggataactcgtcattgcgcgcatctcattactgtggatatcttcatacggcacacacccactcgccgaacgacgatatccacatcgctaatatccacatcgtcgctttccgcacatacattgatgccgggcactgcatgttccgcaatacccggcatcaatcgtttttttttacagccatatcaagccatatcaagccatatcaagccatatcaagccatatcaagccatatcagtgcagggagccgaaactcatccacccgtaaggattggccatattgcacaacagaatcaacgcaatgaccagcaccaccatggcccagccgtacacctgcatgcgccatttcaggcttttaccgcgccacgccggcacaccacccaccagcagccatgtgagtattccacccactacaaagccgccgacatgcgcctgccacgccacgccaccgaccacgaacggcaaggcgaagttcaccgccatccagatcaacatggagcggatatcggcgccgatacggcgatataccaccagcaatgatgcaaacaggccaaataaggctccagaagccccataggctgccatctgccagccgatgcctcccggagccaccgcagcccacaccataagtcccagggagccgccaaggccggaaatcacatacagtcccaagaaccgccagtggccgatcattcgttccagcactgggcccacggaatacagagcaatcatgttgaacaggatatgcaatagcgagttcggcgcatgcaggaacatcgaggtgatgagcgtccacggctcagccaccagtctgaccggagccgccatgccgaggtacatcaaccaagccctcaggcccggggcaataaatcccaacaatacctccagtagccacactgccacgcacgcaacaatcagcgcccaggtcatcaccggaccaccgcgctcccactggtatcgaatctcccgttgtgtaggaatatgcatgcagcccactgtatcgaaggtctcggatgcgttccacgcgccgcgaagatgccgagccggccaagggcagacgggcgcggatgaatcgcccacgaatgtcattccacccaatcgtcacaaacagcggcctagaatagggagcagagtcggtctgaatgggcataccgaccagacgatccctagggaaaggagccgtcatggagaacaagtcttctaacggttggaagttcttcgcgctgctgttcggcggattgctcgccgcgcttgttggcctgtacatctacaagcagcagaacccggattacgatccgtgggaggagccgtgggagaacagctcctcgccggtcgacctaggtctgaataaggccgaggatgaggccgatgacgaggcgaaagccgccccggccgaagcctgatagggcggtctttcaacgcaagaagccccgcaaccgatggatgtcggttgcggggcttcttatgctccggcggccgtcaggccagaggagcagtgtgccagatacgttccaaatagtcttccatggagcggtcggagctgaagtagccggagttggccacgttgagcagggccttgcggttccattcgagctcatcagcgtagagggcctcgatctcggactggatgtccatgtaggcggagaagtcggccaaggtcatgaaccagtccttggtcagccagtcggccacgagcggggagtaggcgttgcggtcgccgttggagaaggtgccgtcggccaccatatcgatggcgtgcttcaggcgcgggtcggcctcgtagtaggaggcgggattgtagccctcggcgtacttcttctcgacctcgtcgacggtcatgccgaacaggaagaagttctcggcgccgacgcgctcacggatctcgacgttcgcgccatcgagcgtaccgacggtcatcgcgccgttgagggcgaacttcatgttgccggtacccgaggcctccttgccggcctgcgagatctgctcgtcgaggtcggtggcgggaatcaggtgctgggcgaggcgcacattgtagttccacgggaagtacacggccagcttgcccttgacgtccggatcgttgttgaccacgcgggagacgttgttgatgagctggatggtcatcttggccaggtagtagcccggggcggccttggcaccgaagaacacggtgcgcggggtgacgtcctcggccttgaccttgccggacttgatgtcggcgtaggtggagatgacggacaggatcttcagggactggcgcttgtactcgtgcaggcgcttaaccatggtgttgaacatggtgttcgggtcgagctcgaagccgtactcgcgcttggcgtaggcggcgaagtcgaccttgttggccttcttgacggcggcgaacttcttgacgaattcatcgtccttggccagcggctcgaggcccttgagcatctccaggtcggagagccacttgtcggtgccgaggccctcggtgatgaggtcggacaggcgcgggttggcgagcttgacgaagcgacgcggagtcacgccgttggtcacgttggtgaacttgtccgggtagacgtcggagaagttcttgagggtgacgtccttcaggagctgggagtgcagctcggccacgccgttgacgtgggagccgccgtaggtggccaagtaggccatgcgcacggcgtcgccagtgtagatggccatgtccttgatggtgttcttgtcgacgcccttggacttgagctcgtcctcgaactgcgcgttgatcttctcgatgatctcaaggtgacgcggcagcagctcgccgatcaggctggccggccagacctcaagggcctccggcagcagggtgtggcaggtgtagttgaaggtcttggtggtgatggaccacgcggtatcccagtcgtagccgtactcatcgatgaggatgcgcatgagctcggggatgccgatcaccgggtgggtgtcgttgagctggaagacgatcttgttcgggaaagtcgtcagatccggcttgtcctggcccgggtagaagacgcggatggcgtcgtgcagggaggcggagacgaagaagtactgctgctcaaggcgcagttccttgccgaccttggtggagtcttccgggtagagaatcttggagatgttctcggccttgacctgcggggtcacggcttccatgtactcggagcggttgaaggcgagcagatcgaactcgtcgtagctcttggcgctccacaggcgcagggtgttcacgcggccggacttgtagccggggaccaggtagtccaccggcacggcgcgcacggaccatgcgggctgccaggtcttggtgccgtcggcgttctcgacgaccttgccgccgaaggaaaccttctggtcgcggttgtagtcgatgtggccccacggctcttcgttggccagccagtagtccggggtttcgacctgcttgccgtccttgtcgaactcctgcttgaagatgccgtacttgtactggatgccgtagccgaaggccggcacgcccagcgaggcgagggagtcgatgaagcaggcggccagacggccgaggccgccgttgccgaggcccggctcgtattcggcgtcgacgacgtcctggaccttgaagccgagggcttccacggccttgtcgaactgctcggtcagaccggcgttgagcagcgcgttgcgcagctgcttacccatcaggaattctgcggacaggtagccgacggccttggtgttgccgttcacggtgtcggcctgggtcttgaaccaggagtcggcaaggtggttgcgcacggccttggatgcggcgacatacacgtcagcaggggtagcctgctcggtggtgacgttctgagtgtatttcagttgttcacgaatctcgtcggcgaattgttccgccgtgacaggagacttcggtgcggtgatttcggtcattctgactttccttccgggataagtgcccgtgtttattatgccgcgcgataggtatcgtcgcacaaacgtaagcatgaactctccgtaacgacgatggcggagcgttcttgcatacgttctcatttagagcgtagcacatgccccgatattccgcatcacaccgtatgccatcgtttgcattatggaagatcttccggctccggtgccatgatgggatgcatggcagtaattcttgaaaaagacctgaaacgcgggcatgacgcgctggtgcaatggcgtgccgcggcccgggagctggcggacaacacaccacatcgtctgaccgtctcccctgtcttgccacgcccggtgtgggcgatggccgtgcgctactcgctgtttctgctggagcggcgcgcacccggccctggcgtggaggtgcgtgtcgcgccgtggggggcggtcaaaatcttggacggcccggaatcggacccgcataacctgaccccgccggacgtcatcgagctggacccggaagtctggctgcggctggcctgcggcatcaccacatgggcagaggaaaaggacgccggccacatcagcgcggtcggcgagcgcgacgacctgagcgacctgctgccgctgtgaggcgcgaagcgtaagtaagccaccagcggcggcaccatcagccataaccacaaatccccttgtgctcaccaagcacaaggggattattacgagaagaccggcgttcagctcttcttgggcttgagcgcggaaggcatgggcatcggaatcggcttgcgcggggccggcttcggtgcggcaggcgcggaggccgggaactcgccgctggtcgcctttgcggcggcttcggcagcccacttggcgtactcgtcgaggtcatcctcctgcgtagcgggagctgcctcggcggcaccggaagcgtggtcatcagcagcggaatccacatccttgtccgcatactggtcatcgatgtcggcgaacgggtcaggagagcccattcccggctcctgctcgctcagctcttttgccagctcatcgtagtcggtatcggtggtcaggtacttgagctttcgggcaattttctgctgttttgctttttgacgtccgcggcccatctgaccccctgcgattactgtgctgttcgattcatcaacaatagagagtaccactaatagtggcttgttcgttgtcggctcacacttttaccataaaaagcgtttatttagggcatattcaaaggattttcgcatgaccgacgagcagcaactgacagcggcaggcaatgagatgagcgcgagcttcctcgcggccaaaaagcgttcggacgaaacgctcgccaagctggaggccaagccgtcgtccttcaccatgttgaccggcgaccgcccgaccggccggctgcacctcggccactacttcggctcgatccgtgagcgtgtcgccatgcaggagcgcggcgtcaacacgaacatcatcatcgccgactaccaggtgatcaccgaccgcgacaccaccgagcacatccaagacaacgtgctgaacctggtgctcgactacatggccgccggcatcgatccgaacaagaccatgatgttcacccactccgccgtgccggccgagaaccagctactgctgccgttcctgtccttggtcaccgaggccgagctgcaccgcaacccgaccgtgaagtccgagatggaggcgtccggccacgcgctgaccggtctgctgctcacctacccggtgcatcaggcgtgcgacatcctcttctgcaaggccaatgtcgtgccgatcggcaaggacaacctgccgcacgtggaaatcacgcgcaccatcgcccgccgtttcaacgagcgttacgccaagaagaacccggtgttcccggagccggccgccattctgtctgaggcaccggagattccgggtctcgacggccgcaagatgagcaagtcgtacggcaactccatcatgctgggcgccaccgccgaggaaaccgccaagctcatcaagaagagcccgaccgattccgagcgccgcatcaccttcgacccggttgcccgcccgcaggtctccgccctgctgaccaccgccggcctggtgaccggccgcgacccgaaggacatcgccgaggagatcggtgattccggcgccggcgcgctcaaggcatacgtcatcgaatcagtcaacgagttcctggccccgcaccgcgagcgccgcgccgagctggccaaggacatggattccattcgtgacatcctgcacgacggcaacaagcgcgccaacgccatcgccgaggagaccctcgaccaggtgcgcgaggccatgggcatgaagtactgattttcccgccgctcgtagcaagacgccgtgtcagccccaactgggcaactgacacggcgtttttgtattgcggcgtctgctgtgtcctatcttcacttcgaggggcggatttcttgtttttccgtgcaacgcggctatcaagacggacctctgttcacttcatgccgatggcttgcatcaatacgtacgctccccgcacagcaatgtcattacgacgtgttgcggcatagcgcgcatggcttccggagtatcggcggcgtatgggtcggcgtccagcaacaccacatcggccgggtcgccggatgcaaggcggtcacggccagtggcggtcgaggctgccagcgaggtatgcacatcgaggcactgctcgggctggaacggctcgcggtcagagctttcggtgccgagcacggcggcggaaatggccagccacgggtccagcggggccacgggcgcatccgagcccatgcgcagcgtggtaccggcgtcgtggagggccctgaacggataagggatgccggccgggttggcccagaaacgggtgatgacgtcgcggtcatccatggcgtgctgcggctggatgctggccgtgagccccagctcggcgaaacgcgggatatcgacgggtttgagcatctgcgcatgctcgatcgatccatgtgcgtgcgtggcggcgactgcgttgagcgcaatggtgttcgcttcgtcgccaatggcgtggcaggcaatgtcgaagccatgctcggtggctaggcgcatatagtcttcgatttgctgcggcgtgtagctcagcgtgccatacgtcagcggctcgatgcccgaatacggcgtggagcagtaggcggagcgggtgttgagcgatccgtccgagatgagcttcatggcgcccacatggccaagcccggcgctgcccggcaattccttgccggtatgccaacccgcgtcaatggcggctcgcaaccgctcggggtatacaccggcgtccacgcgcaaaccgttaatgccggccgcgaaacgattgatccatgtatcgatgttttcggccatttcataatcgcggatgcccaccacgcccttgcttgcggcgtcctgttcggcctcgcgcagcagacggtcagtctcttcagcagcgcccggcgccttgtcgaaggcggtgtaggcgttgaaccattcgagttcaccgaccagaccggattcgtccacatgtacgccaagcctgcgggccgcggcggaattcacccatccgcagtgcatgtccgcgctggagagggccaccggctgttcgccggtcacggcgtcaattgcggccagtgtgggctgctcgtcgtcggcccacagcgagtgacggaatcgcatgcccaccacgaaggcatctgggtcaagcgtgtcggcggcgcggcgctcatccagatgacggcgcaacatgtccatcgcttcggcggcggaacgggcattgatgaggtccagtcggcccagcgtcttagcccattgcgtgaagtgcgtgtggcagtcccacaggccgggaataacccacaggccgtcggcgtcgatggtggtttcgtcggcgggtgcggcggccgacgttgggattgagacgctgccagaagcaatggcattcgtcgcgtattccaacgatgtcgtatgcgccttagtctgcatcgtgctgtccgaagccgagaccgttccagcagggccgacagacgcaacaaccccatcgcgaagcaccacatccacgcggtcctgagaccccggaacaccggcattgacaatacgcaccaagctactcataccggccatcatgccacctttgcatgaacgccatggagattcgtccaagttgaatcgcgccgtcgacggcgattcccgctggctgcctgcaaacccctacgttccatgtaattgcgggatggcctgcaactgcgatgaacacccatagtttatccaccgacttatccacatttatccaccgaaaaattagggcggtagacagggccggtagccggactctacactgcgaggacaaagcgaacatcacgaaggggtgatcatcatgggtagctcaacggcattgaccgagctgacaatgcagaagtaccaacgaatgcagacgtgcgcagatgttcaacgacgaagcgcatggcgcccaccctatgccctgacaacagcgttggagcttttgtcaattgaagtaccccgcatatcaagcaaacacagaggccttgcaactacaaccattgttgcggttccacacgccaatgacaaacggcacattgtgggggtcaaagtggttgtatggccttttccactagacacggtcataatcgagggacaattcacatgcacttcaccagcttgcacatgggccatgttctccacgtatctcgaacttgaagaactcatcgttctcgctgattccatgatgcgacgagatcgaaggctctgcagaacaaccatcgacgccctttctctgtatctcgatgaggccgaggcccaggtgcgagccgacaaagagaatggcaccaattcgtatttgttccgcgggtataacaaatgccgtcgcgccctacttttggcgcgcgcgggcacagattcctccatggaaacacgaactcgtttggttctcttgaaatacggtctgaattgcccgcaggtgaattatccaatattcgtaggaaacaacaccagacccatatatctcgatcttgcataccctgaattcaagatatgtatcgaatacgaaggctctcatcatgccgggcaatggctgaatgacgcgagacgccgccagatgatcgaagatgctggctggaagtacattcaagtcaccaaattagatattggcgacgaagcgggagaagaggcccttgcccgaagagttgccgaaaggatacaggaggttacgggcaaaacggtccagctcacgatgcggcaaactacccagcaaattagcgatgtccgaaagctacgccgtattccactgtacaaacggctgaaattcgagcctctgctgccaattattccgacgacgcaggaataataagcccggtagagtcagtccgcaccgtccgcaccgcgctacggtattcaaaacccatttcaaggggctgatttggcctccgccggaggtctacttccgtttcaaggggctgatcatccgctagaccacgtgtatcaatgcctttacgccaacgccattccgccgttttggagccgcgtctactcaggcatcagccccttgaaacggaagtagacctctccagaacgtcaaatcagcccctcgaagtccgttttggcctcaatggttcctgccgaaccacaaaaaagccactcctctgccatacgaggcgaccgcacagcaggcacgtgtcatttgccgctgcggacctcggactccatggcttccatgggctcgtcgacgagcacggtgccggacggcaggatgccgggcagcggatcgtccatgtagtggtcgaactcgtagagcatacgctcgttcggcttggcggtcagcaacgaaaccaccacgatgaacagcagcgaaatgatgaacgccggcagcagctcatagatggcgaatacgccgcccaagggcttgacgaggttgtgccagatcagcacggccgccgtgccggacagcatgccggccacggcgccggccttgttggcgcgacgccagtatagcgagcacagcatcaacgggccgaatgaggcaccaagcccggcccacgcgtaagacaccacctggaagatcgacgagttctggtcgtatgccaccagaatgccgaacaggaacatgaccaccagcgtgaccctggccacaatcatgacctgcttgtcggtggccttgcggtgcagcagcccgcggaagatgttctcgcccatggccgaagcgccgatgatcagatacgaggagctggagctcatcgaggccgcgaaaatgccggagaccaccacgccgcacatgaagctcggcagcagggtctgcgccagcacgatgaagatggtttccgcatcggtggaggtcagcagttcggtgggcatcatcgcacgccccaccaagccgatgcacactgcgcaacccagcgaaatcacgcaccaggaggtggcgatgattcgggacttgcgcacttcttccacgctgcggatggacaggaagcgcaccagcacctgcggcataccgaagtaacccaggccccacgccagcatggagatgatggtgatgatgccgtagtcggagggcgcgccgaacacggctttgcccgcctcgacgagctgctggccggtggccgggtccagcttgggcgcggccacctgcgtgccggacaggtagccggggatggcacgcaggaattccacggtgttgtcgatgccgcccgcgctggccacggtgccgatgaacaccaccgcgagcgcgaagaacatgagcatgccttgaatgaagtcggtcatcaccacggacaagtagccgcccaccacggtgtagacgaacacgaccaccgcgccgatgatcatcatgacgtggtagtcgaaaccgaacaacgtggcgaacagcttgcccacggtcacgaagcagctgcccacgtacacgctgaagaacaccaggatgatcacggccgcgatggtggagaccacgcccttcttgtcatggaaacgcttggcgaagaagtcaggaatggtgatggcatcgccggccactaccgagtagcggcgcagtcgccgggccacaagcttccagttgagataggtgccgagcgccaggccgatggcggtccacatcgggtcggccgcgccggtgaagtaggccaggcccggcaggcccatcagcagccagccgctcatgtcggaggcttcggcgctcagggccgtgagccacggccccacgccgcgcccgcccgcaaagtattccttggaggaggagttggagcgtttggagtagatgaatccgatggacagcatggccgcaaaatagatgaccatggccagcagaatccagaaatcgttggccaactgcgacacctccccaatcatgacgccaagcggctaccgccatggcagaactatgtgctgatatgcgtgctgatatgcgattgacgccggagcggcgtcatacagaccgtcacagccgtgaatacggccgcaacgcacttcgcctgatggtagtggatacaagggctcaagcaccttccaccgtttccatactgagacgctgttttatccgagctccccccacctgaggagagccaagatgacggtcagatgtcgtagcgccaggacttgtcggtcaccacgcgggccatcgccaagccgatcggcagacagataatcaccatgaacgcacggaacgcccagtccagcgcattcatggtctggaagctgccgaggtaccacatggcacgatacatatacagaccgggcaccatgatcacgatcgacggcacggtcaggcagatgcgcgggtagccgaggtgcggcggtagccagccacgtcgcacggatgaacgccacaccgatgccagaatgcccgccagaaacgcgccgatgaaggtagccatctcgggtgccacgttgaagtcttgcaattccaagcgcagcgtgtccgtgatcgcaccgatcagggcggcggtcaggcacatgcgctgcggcgaattgaacagcacggagaagccccacacgccgacgaacgccgccacgaatcgcagcaatccgttgacccacgggtcaagccccagtggctcaaagccttccgggtgcaggtgcaccatcacggccacggcccagcctgccagcgtggccatcaggatgatgcacagcacgtacgccacgcgctggatgcccgaggggaagtcgattttcgccatgtcgagtccgcctgtgatgagcgggaaaccggggatcacgaacagcatggcgccgatgtaggccgtatcgtgcgagagcgcgactgggtcgaaaatgccgatgagtcgcagggtgccggtgcaggcgagcgccgccgcggccacacacacaaaggtgacgaagaactggttcagatggtatgcaaacagccggcgacgcatccactggccaaggcccgcgcccacgaacgcaccgatcatgtcgtatgggccgccgccgagcaggaacacgaaggccgcgcaggctagggcggaggccagaccggagaaccacggcttgtacagcggcttgcggcgctcaatcagatcgagtcgctcgtgcgcctgccgcacggtgataccgcccttggccttctcttcgtcggagcgctcgttgaagtgttcggcgtattccttgggcacgcgattcttacgcttcgtactgcttgcagcagggctttcggcggttgcgccgttcgccgcgttcgccgattcaaccgactcattggagtcaccggtaaacacttcggcatcgtcgtaggccttctcttcggccgctttgtcttcgaccggagtgacttccgcgctgtccgccaaaagtcggtgggcttcttcattgtcatcgtccaaggacttggccacggaggtcacgagtaccttggttttcgacgcaagatccagcgcctcgtccacgctgccgttggccgcctcagcctcgaccttggcacgttcgcgcaggcgcttggccagatcggccgaatactgcgaagcgtcacgttcgtccaaatgcttgaccacgccatcggacagttgcgaatcaacgtgatacatcgaccccttgccgagattcacggagaaccagtcggcgaaatgttccagcagccagatacgttcggtgttcacgccggtactcggcaaatccacgacttcggtgatgcggttacgaccatccgtgcaggtggcctcgatatccgtcaggttcacgtcggcgcgtacgtgcacgcccagcgggtaggcgatgcggtgcatcatttcacgcacgcggaaggagccggtgccggctcccaggtccaacatgccgactcgtacaatcacgctggctttggcggcgataccggcgtccaccaccggtttttcccaatcgcgtgcaatatcttccatgtccagcggaatggagtgggtgtggaatttacgtacagccgttgcgcctttcgcttcgggcgcactttttttcttctgttcgctcacatccttcattactactccctgccttccccgccagcaatcgtaaggcgctcaaatcttccgcgaatcggacagtgtctcatatgctgtccgatattcggtctctataggtggacaacttggcgcactatatggacttcgtaacgtaaaaagcgatttcgcggggatacactattgcccacacaacaaccacgttgaatatgggctgtgggctcgcaacgactggtctcaacaactgcggaggagccgcagacgaccagtagaccgagcaacctgttattcggcaaaggaggttatatggcaacacctgaagaacagatcactcccgctgacgccgccatcgtcactaccgggaccggccgaaagggcccggaggagcatgatcttcccgaaagcctgaagtacgacatggatctgtgtcttgagatcctgcgtaacgtactgggcgaatacaaccccgaactgctgtctacgttcgacaccgtgcgtcattacgcggtggaggccagcgccgagcatttcgccgagctgaaggatccgaaccccgaccaggatggcctgaaggaggccgtgaacgtcatcgacaacatgacgttgcacgacgcccagctgctggcccgcgcattcgccacgtatttccatctggcaaacctgtccgaggagaactaccgcgtttccgtgctccacgagcgcgagaacaacgtgcccgttgaccaggcggtcgatccgatcaacgagctcaccgtcgcctaccaccagctcatcaatgagactggcccggccaaggccaaggaactgctcaaccagctcgaattccaccccgtcttcacggcgcaccccactgaggcccgtcgtaaggccgtggaaggcaagatccgccgcgtttccgaattgcttgaggagtacaagcgcctcggcggctcggataagaaggaatgcctgcgccgtctctacaacgagatcgacgccctgttccgcacctctccgatcgcgctgaagaagccgaccccggttgaggaagcggacacgattctcgacatcttcgacaacacgctgttcaacaccatccccaaggtctaccgtcgcttcgatgactgggtcctgggcgataaggccggtctcgtcgagcccgcttgccccgcgttcttccacccgggcagctggatcggctccgaccgcgacggtaacccgaacgtcaccgccaaggtgagccgcgccgtggcccgcaagttctccgatcacgtaatcgccgcccttgaggaagccacccgcaccgtgggccgcaacctcacgatggaagccgagaccacgccgccgagcgccgagctcaagagcctctggagccaccagaaggaaatgagcgagcgtctgaccgacaaggccgccctgatctccaccaaggagatgcaccgcgcggtcatgctggtgatggccgaccgtctgcactacaccatcgagcgcgacgccgacctcatgtaccactcctgcgacgacttcctcgccgacctcaaggtggtccagcgttcgctggccgccgccggtgccaagcgttccgcttacggcccgctgcaggatctgatctggcagaccgagaccttcggcttccacatggtggagatggagttccgtcagcactccgtggtgcatgcccgcgcccttgcggatatccgcgagcacggtctgcacggcgagcgcggcgaactgcagccgatgacgcacgaggtgctcgacaccttccgcgctctcggtgccatccagaagcgcaacggcctcaaggccgcccgccgctacatcatctccttcaccaagagcgcccagaacatcaaggatgtctacgagctcaaccgcttggcattctcccacccggaggacgtgcccaccatcgacgtgatcccgctgttcgagcagcttgaggatctgcagaactcggtggacgtgctcgaggaaatgatcaagatccccgaggtccaggctcgtctgaaggccaccggcaacaagctcgaggtcatgctcggctactccgactcctcgaaggacgccggcccgacctccgccacgctggccctgcactccgctcaggagcgcatcgccaagtgggctgagtcgcacgacatcgacctgaccctgttccatggccgcggcggcgccgtcggtcgtggcggcggccccgccaaccgcgcggtgctcgcccagccggtcggttccgtcaagtgccgcttcaagctcaccgagcagggcgaggtcatcttcgcccgctacggcaacccggtgctggccatccgccacgtcgagtccgtggctgcggcgaccttgctgcagtccgcgccgagcgtggagaagcgcaacaccgagatgaccgagaagtacgccgatatggccgctcagctcgacgaggccgcgcacaaccgcttcctcgacctgttgaacaccgatggcttcgccccgtggttctcgatcgtcacgccgctgaccgaaatcggcctgctgccgatcggctcccgcccggccaagcgtggcctcggcgccaagtcgctcgacgacctgcgtacgattccgtggatcttctcctgggctcaggcccgcatcaacctggccgcctggtacggtctcggcaccgcatgcgagaagttcggcgatctggagaccatgcgcaaggcgtatgaggaatggccgctgttctccaccttcatcgacaacatcgagatgtccatcgccaagacggacgagcgcatcgccaagatgtacctcgccctcggcgaccgcgaggacctcaacaagaaggtactcgaggagatggagctcacccgcaagtgggttctggccatcgtgggcgacaagtggccgctgcagcaccgtcacgtgctcggccaggccatccgcatccgctccccatacgtggacgcactgtccgtcactcaggtgctggcgctcaagtcgctgcgcaagaaggtggacaaggaagagctctcgcaaagccagcaggccggattcatctatctgatcctctgcaccgtttcaggtgttgctgccggcctgcagaacacgggctgattcccggccgaccgatcgacaaaagcgagcggggaggttccgtgccgataaacggcgcgggcctccccgctcgcgtcatccggccctagactggccggcgacggcgcacgccgggcgggcgcgcagagaacggacgcgcggaacgggcacctcgacagatcggaggggacatgggcaagccagcgggcgggcgcgggaacaccgggtccacggacggcatcaaggcggggggcgacgccgggaacgaacgccacacttgcaaagcgaatccggctacaaccgatggcattgggaagaaacacggcacagaagatacgtcagaaaatttttccggcgagagatgtgctttggcaccgaaagcagctaccaaattccctaaggcgagtagatgctatgtggctttgggcaaggccaggcgtgcgctatggtggctgggattactgctgctttcaccagcacttattttgtgggcggaatggggcgccaatggcgatgatgatactataatctgcagagtcttaacgttctcttcctcttcgtgcatgaatttaactacggcaactgagtatgtacgtagacttaccttagtattgattatgggggtagtctgctggattgcggcgcttgtcatctttggcgtgcgttcatatatgcgatctgtatatccggaacttcgtgatcattcctcttccgcctcgcatgtccttgtgggaatcatatcgtttctcgtgctggtcatggtctttcccgttcttgtgataacactactttccgctctaatgactctatgacgttttaccagaggcgcattgcgtggaatggctgaatcattccacgcaatgcgatcacaatcatgattgattaacggttcggatttttcaagagattcagcataggataatgctaatataccagcctccgcttgactcgggagtcggtctgcatgtgacgcaatgagcagtgcttttttacttccggatacgttatcgaatattccaagatcgattccatcaacgagctttcgaaatgcgatgaccaggttgtccgcacttcccttgaaccgagactgatagaaccgtttaattcgattcgtctcgctttgcgcgaacatgtcccgcatagcggtggacaatgacctttcggaggaattgctctgcatggaccgcgccagcaaccatgcatcacagtccgcgagaacatcgctgtaactgaatcccatacgagcgtcttgctcgccgagatgagcgtgcagccatgacgccaggtcctcttccggggcattcgccaggtagcttccccaaatctgcagcaaatccagggcccatccgcccagatcaccgagaccatagtccattggatcgttcgtaacgccccatgtcaagtatcccaaggatgtggcggccatatgggcgatgtcccgattgggcagcgtgcctttgatgacaggctgtgcatcacatgcgacaccgcatgcctgacgcgacaaggccaattcgctgggagtaaccggcttcggggcgtacgcgtgccatagtgcctgcgtgccggaacttccttccgaccagtactcaggtttgcgaagccactgcaggatgagttgaccgatgctgtcctcataaaccgccacctgggtacccagagcggcaggggctttgtgacactcctgctcgggtgtcgccgccggtctgcagaacacgggctgatccgcggctgaccgaccgcttgacgagcagggaagttccgtgccgataagcggcgcgggcctccccgttcgcgtcgcacggccctagactggccggcgacggcgcgcatagaacgggcgcgctggccgagtgacagactcggatgatcgaaaggggacatatgaatgaggagaaggacacggacggaacgacggacgcgcacgagggggaccacacgcccgcggacggtgccgggacggagggcgaaggcggcaagccggacactaggccgggcgacagactcgcgaccatccgacgcacgctgtggtggataggactggcgctacagctcccattcgctttgactctgatccattttgataccccttacctgatattggagcgtatcctatgcgctattccgccaagactggcaagcgacccgtcatcaatcgtcggcattcccgcacttgaaacggaatggtgtcgagaattcctggcactagtcctgggcgcagtttgctgggttacagctggagtaatgagattagttgcggacagcccatcaaaccatggaaaagaaacccttcctgtacgcatcttcgccggaatcatcaccatcatcgtattgatggccaccggtattacaggactcttcctcggcatagcggccttttagaagtttccccgtatctggcagaggaattccaaatcgaaagcacaacagcgaatgtgtgggcagacgacacatctgcccacacataatgcattatgcgagctaccgtcttggctgatcaatgaatgcagcgaacgcccgagcactcacttcagcttcctgcttatcaggaagcttgtctgtaccggcagccttttttaggatgctttcgctcattccaatatttgtcaaaccaagtgcatcaagaccgtccgccattgttgaatatgcactcaccacattatctgcgcttgatgcaaaacgttcgtcgtagaatcgaacgatacgatgggtctcactctgcttaagaaaaattgaagcaaaacacgcagagccagcaggcaggattcatctacctcatcctgtgcaccgtctccggcgttgctgccggcctgcagaacacaggctgatctacacaccagcgcatatggggaagccccgctcgatgtgagcggggcttccccgttttgtgtacatctttcaccatcttgcaataattcttacatgtaaacagagagttcttacatgaaagaattattgaaaggtgatgaaagaacttactttcacgcgcgccaatcatcccaacacgtatcgggatgacggcccattcccctcgcggcgcaacttgcccgcatcctctagcttcttcaacaaccggtatgcactgatatagctcaggccaaacaaatccatgacatccgccgtagtgacgacaccatcatttttttcggcgaactccagaacaaggccactgcgccgggtggcatcgatgtcacgctggcgcacgtaagacgccagcccctctgaacgtttgtacactcgggcactcagcatatacgaacgagagctcccgctaccgaccccctctaccaaaccagcttccaccagattctcaacagcggacacgatgcgtcgatgctccaaatgggagaaatcgcacaattggaccacggtaagcctacgatgctcacgcagcagcgagagcacaatcagtgaccagaccggcaatggagccccacgtcgacgttcctcgtcgccaatcatggttacgaatgcctcgtcaggtaccacacggcgcaagaacaagataacttcctcagcactggactgtgaataatccgggaaagaaccacccgccgcaatcgacccggcatagatggtatccacgcctcgtccggtgcgttcaacatatccggcagctttcagaatcagggcaagctgcggattgcgggaacgcggttgtgcagtaagcaggttatcttcggaaacaccctctatgaatcctccggggttggctatggtcaacccatcatcatcaatcaggaatctcaccgaacccattcgtgcataatcgcgatggcagaaagcgttaatcattgcctcacggaatgcccctcgatcgaagtctggcagatcgacccgaatcaagccgctcatgacttcgtggctgggattccatggctccatcagctcgcctacacgatcaaacatatccaccaaaggcaacacgaacggatccatattgacctttggagacatgcctttcatcacttgaaaaacagccgatgcggctggaaccgatcgatgaatagcatcaaccgaaccaatggtgagcagaccagcaacagatggctgcaatccatacgggccatcaacaaccagctcaagtgcccgatcgaaatcctcatcagtaaaagacaacaacgagttttgcgcattggcactgcgaatacggcttctcaacttgttccgtgagtctggattcaaatcgtccaaccgagcctctggtgcaggttgcgcgctgaaatcgtagaaccgttgctgagataaacggctaatgaattgggaaacaaacagcggaacgacctcaggcgagccgtctgctttcagccggcgctgcaatgtcttcccctgactggtagacacgatttgctgactgttatccacctcaatactgactatcggcacctcgttctcatacaagagcgccacgcgagtgggaagctgcggaacagtcttattgaaaattagtaccgcaagtccattgatattgcgatgctcgtcacatacgccggtcacagtgccatcgtcttcaataccgagatacagtgtgccgccttcggtattggctagagccactacggtgtcaacaatttcatcatgcgattgaggacgcttctgctcactcttgaactcaaccgtcaaactttctttggccggcaacatgagcatcccctttcaccatcttgcaataattcttacatgttaacagagagttcttacatgtaagaattattgcaagatggtgaaaggggtaaagagcaatccatcctgtcatctccagcaacttaaatccgatcatcgctgctttcggcatatctgatatcagccgctggtgccagtccaatcacccaattgaagctcaacacggccaaagactctacgccgcagtggattcgcgctcgatgagcttatagcccacattcacggtctgcgggaagaattcatcgtccgggttctcgatacgccgcataagcaaggtcagcgcggtatccgccatgcccttgaaatccgtggccacggtggtcagcattggcacgctgtacgcaccctggctcaggccgtcgaagccgataacgcgcacatcgcccggcacgctcacgccatcatccgccagaccacgcagaataccgagcgcaataccgtcgttcaggcagtacagaccgtcgtacttgcacttgcctttcttagccaagccgcgcccggcctcgataccgccgtcaatcgaccacgaggatttgatgtaatcgcggcgctcgtcaaacggcagtccggccgcgagaatcgtctccttggcggcccgcatacgaatatcacgtgagccgggaatgatgttgggattgttgggatcgcgattgtcgccgacgatgccgatgcgcgcacagccgcgcgtaataagatgctggaccgccgcccgtgagccggcgtcgctcggcgcgttcacggtgtcgatgggcaggctggtgtcgtagttttccagcatgacggccgggtgccgcttcaggatatcgaccgcacgtggcgcattgatggcaatgatgccatccgaaaacgtgtacgacagatcgttgtcgtcggtaagataccgggacagttcgatgagcatgtgcgagccgcgcttgtgcacttcctcagccacgcacatggccagatgggaggaatagtcgccctcgatgcccgaggtaaggaaggtgatggtatcggaccgcccagaacgcagggaccggccagacaggttgattttgtagccgagtttgcgggcggcgtcacgcacgcgctgcatggtttcgggcttgacgtaatctttgcttcgcagggccgcggaggcggtggtggcggtcactccggccagttcgccgacatcctttaaggtcaccatcgttatcgtctccgcatatcacgaacctcatcgataagatacatcgtatcgcttcgctaaccgaccgactgcgttgccacatccgaaggacgcatcccccacccgcatcgacaacgagaccgaaaccatcgaccgttgcgccgcccgatacctgatggatgccatcgacgggcatccacatcatggtgtcgattatgtgccttgccgcctgatccagcgcgaatcgacgctgccgctggattgatgcttgcggctcttatccgaagagccgcacaagtcgtcgtttctcacagtcagcactatacgctcactaacgaggcgcgaccgtcagatcatagttgccaacggaatcgccatccgcttcatctggcacgctctcggaagaaaccaccggaatcacatacgaatggaattccggcgtttgtccggcaatcctctgttcaagcagatccacaatagtggcagccatctcctcatacggctgtatcaccgtaggaagcggcggatatgcgatcttatagacgaacgagccatcataaccaaatacaaataggtcatccggaatgcgacgccctcgcgaaagcgcctcacgctggaccgcgagtgcaaccagatcggccgcgaagatgccatccacgtccgggtactgatcgaggaacattttggcggtttgcaggtaggacgagaattcaaactggttgagtcgcaactcataggtaaagcattcgacaccgtggtcacgcatctgtttggcaaacaccttatgccgttgcgcggaaggagacagcaccttcgagtagcctacaaactgcaccactttcttacagccatgcttcaaaaacgcctcggccgcgatatgtccgccctgcgcatggtctgcatgcaccaccggaatgtcatcggccagggaacggtccagggatatgatcggcaaaccgatgccggagtaatcgatgtccacggaatggctgcccacgataatgccatcgaccttgttggcggtaagcatatccaggtatttgcgctcttttgccggggaatgcatggtgtcgcacagaatcatcttgtatccgcgacgatccagttcgtcctcgatgcgggaagccatggtggcaaagaacggctgcaccacatcggggatgaccaatccgacaaaattagtgcgcttggtggtcaggcttcgcgcaatctgattgggttggtagtgcagcaggtctatggcatcctgaatggcgctcttggttttttccgacatatagccgcgttcgttgagatagcgcgacaccgtgttcttggatactcccgctacccgcgcaacgtccgttatcgtggccatgagttttttcccccgttatagcaattggcggcggacgattccctacaagtctaatagggaaacgcccgccgcctatggacaagcccctagggtctgagcgcgtacccccggatatcggcaagcgcggcatcgccgccatgcggctcgaccgcgatctcattgcaggtcgcaggagcgaacacgttcagggaatgcaccacacggcctccgttgatgaagatctccagcgaactggtgtcgccgatcacttccgcttccattcgggggcttccggcgaccatcagcgggctatgggtcttccccttgctccacccatcggaatcgttgcggtcgacgctcatctcggcatgctccaagtcaaatgtgcataccgtgcgtttgccttcaccgcatcggagcagcaggtccacctgcttcgctcgcgtggcctcaaggtcaagcgcaaaggaaagatcgaaatgcacgccgtctccggcctggacgacatgcctctgcccgtcgcgcacggtcacgttttcctcggcgctcatgtccgcacgcagccgatcaagctccgccacaggacggaacgacagcgtcaggtcatcgttcaatatgacctcgcgcggcaccgaaagcgatccgcaccatccctgctggtatgtcgggccccagtctttccagaatggcatccaatcccagccgttggcccagccaacggcaatccgacgtccctgggcatccacgaacgtctgcggcgcatagaaatcgaagccccagtcggattcaccggtcaccgtgtagacaaagcggcccgtggcatagtcgatatcgccaacgaaatacaccgtggtacgctcgccggcacccatgggcgagcataggaacacccatttgtctttcagcgggaagaagtccgggcactcccacatgtatccccactcgccacgggactcgtgcatgacgttaaggaactcccaatcaagaagattctcggatcggtacaagagagcttgcgccttgccgtcgcgctgcgcgccgaccaccatgtagtacagcccttcatgctcccacatcttggggtcgcggaagtaatccgtgggaacaccgctgggggcctcgatcacgggattgccctcgtacttggtaaagtgcacaccgtcttcgctgatggctatgttctgtgtctgcacaaagccattgccatggttggcggtgccggtgtacgccacgtacagcttgccgtccttctcgatggcgctgcccgagaagcatccgccctgggggtggtcgtcgtatggctcgctgggcgccaacgccatcggcaactgggtccagtgcagcaggtcgtcgctgaccgcatggccccaatgcatctttccccagaacccgctatacgggttgaactggtagaagaaatggtactggccccggtaatagatcagaccattggggtcgttgatccagccgcacggccccataagatgataggtttggcgcatactggcctgtgctacctcgggggcgtgttcggcgatataggtcgaggccgtatcgatggcctgctgcatggactttgttgtcatgggaactctccttggtcccttaatggttagggttatgtcgccttactgcttcgcgtcgaattcttcgcgaagcttcttggcgaattgcgtgttcagctcggactcgcgacgggctttgtcttccttgatgcggaactgttcatcgcgcgcgggcttgtattccttccaccgtgccgcatatgcctcgcgggcggaacgctgctcatcggtcagctcaggctgaggcagcacacgttccggaagctgcggcactaccggcaaccggtcctcgaccggggcaatggtcagcggagtcgccgtgggcaatgtctgataccagtaagccgtggaactccaatcatcggacaggtgattggcgtgcccatgctcgatcgtgactttgagatgcttctcgaaacgcaccgggtccgtgatgtggaatcgatacgaaacctggaagccatccgtatctccctcatggacgatggtgccgaagaacggataggcattacgctgcatgccccatgcatggttgaagtaatcctcggtgccggtgccattgagcgagggatactcctccccgtcgatgaagaacatgtcgttgccctcaccccaccagctgccctggaaatgcttgacggtgagattgcagcccacgtaatgaccggtgccttcaacgtccagcacggtgtagttgtgctcgcccttgaagttggtgacgttgttgacctccgggctgttgacctgcaggtcgggaccccagccgtcgcacgggttctcacgatgccatgccgcatggaagtaagcggtgtcctcgggcagcggctcggcatacatttcataatcaatgttgaagtagagaatgaacggcagctcgttctcgttgatgatctcgatcttcgccttcttgttgaagggcatcgggaagtagcacgagaccgagcagggagccccgtaacggcctgcctcttccggcttcagcgatacgttgaacggcaacgatgagaagttgcccggatagctgttgccgatgcagaagaaatcaccgaacgggcatagcacgcttggcgtatcctcgtcatcccaggtgattcgaatgagcgccttgcggtaatagaacggatcatagtcgtcccagatcacgccaagcgcgggatggatctccattacgggagcggcagaggcctgcgcgaccggatcgagaatggagggtgcagcaaccctgcggcagctggaggtcatccacatatgcgtgatgcagcccggaccttcgatttctccaagcgtgatggtctcaccggcgggcacttcccagtagtcttggttcttgccccgctgatcccagctggcaagtcgaccattgcgagcatggtggacgctcgtcaggtctttgaacattcccgagattgcactcatggtgttctcctttgttattgattttgttgtttttttggggggtatcgatagcgacgaatgtcagcccttgaccgcgccggcgaccatgccgccgacgatcttcttctggaacaatccgtagaagatgagttcagggatgatgatcatcaccgatgaagcgactatgccgccgtaatccacggtgtaagtgcccttgaagaagctggctcccatggacagcgtatagtcggcctgattgcgcagcatcacggaagcgtacgggtattcgttccagatgtagagcacgttgaaaatcaccacggtagcgatcaccggcttggtcatgggcaggatcacccggaacatcagatcccatatcgaacagccgtcgatgacggcggcctcgtcgatctccgcgggaagcgctttgagataaccgacgaacagcagcgtgttgaaggaaatcgatgaggcgacatacggcatgatcaacgcccattgctccttgagcccgaagaacatgttgatcttgtagaccgggaacaggaggatgaacggagtcacgctcaggccggcaatgaggaaggcgtacaccgccttggtcaggccggggcgcttgtacgtcatgcgggccagagcgaaggagctgaagaaagtgatggtcagctcgatgatcagggagaccacgcacaccacgaacgtattgagatacagcctcggatagttcagcgttttcaaggcattgcggtaattgtcccaattcaacgccttaggccagctcaatgggtcggacatgatttcggcgttcgacttgaacgacatcatgagcatccacaggagcgggaacaccatcaggacggtgatcaccaccataagaatggtgaaccatgtttttgcacgtttcgacatcatggccgatcagcccctttccttggagcacaggaagtagattccggtgattgccagcgacacgaggaaggtcacggtggcgatggacatgccatagccgtactcgccggactggaaggccatcgagtagctgtaggtgaccaacgtctctgacatatggttgggcccaccgccggtagtctgctgcacgatctcgaagatcttgaagattccggtgatgatcagcacaaccacggtggaaatggtcgagcgcatcatcggtatggtcacatggatcgtgcgctgccaggcattggcgccatccacgcgcacggcttccatcacttcttccgggatcattttgagtcccgctatgaagatggtggtcaggtagccaagctgctgccagaaatagatgaacgcgatcgaatacggagacagcgtcgttccgccaatccactgctgggccaggtctcccgcgccgatggcccgcaggacgccattgatcacgccgatcttcgggtcgagaatgtacacccagatgatgcccacgataatcggagcgataatggccggcgagaacaccagcgccttggacgtatcggcaaatgccagtttgttgttgagcagcagcgccaacaggaacgaaagcaccaggagcagcaccgacgccaccacgaagatgatggcggtattggccagagatttccagaagatatcatctttgactagccgcacgtagttgtcgattccattgaaacgagctttgccgatacctgagtatttggtgaaactgtaggccactgcaatgccgataggcaaaatgatgaacactacatacaccgcaagcgtggggatcagaaaccctaccttatagcgcgttttgctaagccaatgcattacggcacactttccgcgaagaaaacaatgtgatgattaagacaacggcatggccggccggttgcgagaccggccacacccatcgaggagggagatatgcgttacttcgagttggccagcgcctcatccatcttggcgacggcatcggccggagtatgggttccctgcatgacgccgaagagcccgtcatacaacgatgcctgcaccgaggagggcaccgtcagatcaggagcggcggtaggcgacttccacccattgcccagggcctcgaccatggcattcatcgcgtacttgtccggagacggggcaagaccgtcataactggtggccgggaacatggagatcttataagacagttcagcggcatccttgctgtagtagaacttgaggaaggcataggtcgcctccttgacggcatcgttgtcggcaacggtagccggaactgcgataggcgcggaaggcaccttcatatcgatttcctgatcggccgaggaatccgtgaacttcggcccccaccagaatccgatgcgatcgccgatgttcttatcgaattcagcgcaatcccattggccggtaccgaacatcgcggctttgccatcatcgaactgctgcttggcatcgaagtattcgatggtggacatattctccgggaacgcaccggcatcggccaactccttgatcctgtcgaaggccttggccagctccgcatcggagaatgtctccttaccgtcgaggatggacgcgatgtcatctccccagccataacgagatagccaaatgttgaattcccacatggcatacgagctgttcttggaaccgatcgacagcggagtgaccccgctgtccttgagcttggcgaccatgtcaaggaactcgtcgtatgtggtgtcgtcggtcggataatcgacgccggccttatcgaaaacatccttgttgtagaagatgccctgcacattgctctggtacggcaatccatactggaccccgttgtcgtcctggaacgcggcctcggaaccattcagcgcatctttgacatcgctgttctgatcaagaaaatccgtaagatccatgagcacaccggcttcattgaattcggtgacctgtgacccctcgacccagaagacctgcggcaaggtgccgtcagaggcggcgagcttcatgttcttggcatgcgattcggtgtcagcggcaacgaactcgaccttgtacttgcccttgttggctttgttgaatgcttcaacgatgtcattggtcgccggctcctgcttggcggggttagccacattgatgccgaatttgatgacggtggcgccgctgtcgtccttggtgacctccgtgccggacccaccgcaaccggcaagcgtgccgacaacggtcaacgccgcgacgcccgcaccgatgacggacatcgcccgactcttcataatatgctgagtcatggtgctcctttgctccaatttccagttttccttttcccttgcgaccacggccgcacacaccgttccgaaaacctgttaaccgagtaacatagtacatgcatttcaacactttcactatgtcgtcgattgttttttaataaatccagaaatggcttcatttcagtctttatttgttttcacaccgctgcgttgaactcaacataacaccgtggtatcccatgtgtcaaccggttaacacattgcgtgttgcatacggcaaacgagcccggaggcttccctttttttcacctccggttttccttatgcctcaccgacctaagtccataagaattcaaggcgatattcacgcttcaggcctgcaccgatgttggcgggcacgtaaaatttctgtcatcctaagaatcataatcatgtcaaagtcggaaacgaaaacatgtcaaggttggaaacgaaactatgtcataataggaagcaagaacagataatcgttaatttttcaggagtttgccgcaatgaagcaatatagaaatcgaatttacgatacagtgctgcggcaccgtcttgaagccaaaggtgcggtattggtcgaggggccgaaatggtgcgggaaaacaacgacttgtctgcaattagcacaaagcgtgctgtacatggcacaacctgatatccgcgagcaaaacatcatgcttgcggatatgcagccttcgctgcttctgcaaggagcaacaccgcgactcatcgatgagtggcaaattgcacccaaactgtgggatgctgtccgcctcgaagtcgatcaacgcgacgaattcaatcagtttctccttaccggctcaagtgtaccgcccagctttacagacattacccacacaggaaccggcaggatcgctcgcctacgcatgaggcctatgagcttgtatgagtccggagattctacaggtgcagtatcgttcgcttcgctgttcgaaggtgaatccatgccgctctcccgggtggactccaacattgaacacattgctttcctgctgtgccgcggcggatggccgaaggcaatcgatcgaacagagcgcatcgcgctacaacagtctcgagattacttggatgccattgtcgagtcagatatctcccgagtggacgatgtgcaacgagatcctcacctggcacgtcgtttattgcgttcgtatgctcgtatggaatcctcacagtcgcaatcatcacaaattgccgcggacgtgcgaggcagtgccgaaagtcccagcgacaaaaccgtgcaatcctacatatccgcactggaaaaaatattcgttcttgaggatatgcctgcgtggaatccaaatttgcgctccaagagtgcaatacgcacttcagataccagacattttgtcgatccctccatcgcagcggcagcattaggaatcgggccagccggcctcatcaaagacttcgagacttttggactgttgtttgaaagtatgtgcgtacgagacttccgcgtatacgcagacgccctcgatggcgatgtgttccacttccgcgacagaactgggcttgagtgtgatgcggtccttcacctgcgggatggccgatacgggctcatcgaagtcaagctgggagggaaccgactcatcgaagaaggtgcggccaacctgataaagctcgccgacaaaatcgacaccaccaccatgccaaaacccagtttccttatggtggtgacgggcacaggtgaatacagtttcacccgccgagacggtgtcatggtggcccccatcagaacgcttaggccatagcattgccaggggtgaaacaacgattcttccggagtcaggcgcatcaatcgcatcaatcgatgcacgtcacgattttggcggaatcgttgttgttgctgttgggtacggctggggtcgcgcgcttacgcgccgaccagttcgagcatttggggaatgctctttttgccgaattcgacttgctgggtgccgtcggcgtgggtgatgacgatgcagggcacgctcatcgcgccgtactggtccttgagttcggggaagtgcgagacgtcgtaggcttcggcgcgcacggccgggctcagggaggcaatgcgctgggaagcaagcacggtttccgggcacatcgtgcaggtgagcgagacgaggatcatgatgttcagcgggtccgtgatggacttcgcgcgttcgatcaaatcgtcgcccagcggctggccgggaccggccgcgttgtacaggccaagcacgaacgagttgaactcatggccggaaggcacgccatggaaggccaggccggtgaagaccagcgaaccatcgcctccagccggcacgcagatgcgcacggccggacgggcgagcggcaggacgccggcgacgtcgaatgtggcgcggccggaatcgtccaacgaaccataagtgggcagttcggtgccgtccggcaaggtgacggacagcggttcgccgaccaccaaagaagtaggcacagaagcaccatccaccgccgtgatcagccctgcggcatcaacggcaaccgagttcagcttgccgccggacagcgcaaccatctcgccgatgaaaccctgcaattccgccgaaagcggagtgccgtccagttcgagagcgagcgtgaccgggcgggtcatgcgtccgaagaccacgccaagctgctgcttgacggcggcggagaacagttcgccgggcttcttggcggcgctggctgcggctgcggcatcggcgctgcgtttggcgggagccggggcgggcgtcgtgccagcggccgaggcggcggaggcggccttggcctcggactcctcataagcggaagcagtgggacgcggcggcaccaagccggttttctcgctcatctgcttggcgtaacgctccagttccacggcggcaatcgcaccgtcggcggtggcggtgaccacctggcgcaggttcttgacgcgcagatcgccggccgcgtacacgcccggcaccgaagttctgaggtagtcgtgcgtgaccacgtaaccgtggtcgtcgagctccaccacgccgcgcaccaaatcggtggcgggcacatagccggcgaacacgaagacgccgaaggtgccggcgtcggcgggcttccacgtttcggtctggccggtggcaaggttcaggattgaggcttctcgcaggcctccttggccggcggtgacgcccttcagctcgacctgataacgcacgtcgatcttcgggttgttcttggcttcggcggccactgcggcatcgcaggtgaagtccggttcgcgcacgagcacggtgactttggaggcgtatttggtcaggaacacggattcctcggctgcggcgaatccgccgccgaccaccagtacttccttgccggtgaagaactcgccgtcgcaggtggcgcagtaggccacgccgcggccggcgtactcggcctcgccctcgaagcccagcttgcgcgggctggcgccggtggcgatgaggatgccgaacgtcttgaggtcgccgcgtgaggtgtgcacggttttgatgtcaccatccacgtcgagaccggtggcttcggcggagaggaattcggcaccaaagtcctgagcctgctgacgcatggtctgggtgagcgcgcggcccgtggtgcggcccacgcccggatagttgacgacttcgttggtgatggtgatctggccgccgaaatcatctttttcaagaatcagcacacggtagcgagcgcgggccaagtacaggccggccgtcaggccagccggcccgccaccaatgacgacgacgtcatagagattgttggtctgagtcatgaaaactcccttacatacactggctcccctctctgaggggagctgtcgtagtgagactgaggggagcatatcggatcaggctagctctcgcgagcacccccccagtcgctttcagcgacagctcccctcagaaaggggggccaagattaccgcctattcagtgtcgatcacagctggccgacgaggtcgaggctgggctcgatggtttcctcgccaggggtccagttggcggggcagacctggtcgccgtgctcgtagacgaactgggaggcctgcacgcggcgcagcagctcctcggcgttgcggcccacgttggaggagatgacctcgtaggccacgaccttgccctccgggctcacgatgaagtcgccacgctcagccacgccatcggcctcgttgtaggtgtcgagatccttggccagcagggcggtcgggtcggcaagcatcgggtactcgatcttggcgatcttctcgttggcgtcgtgccaagccttgtgcacgaagtgggtgtcgcaggagacggagtagatctcgcaaccgatttccttgaacttggcgtagttctcggccaggtcttcaagctcggtggggcacacgaaggtgaagtcggccgggtagaagaagaacagggaccagtggccgagcacatcgtccttggtcacttcgtggaactcattgttctggaatgcgttcaccttgaaatcggtcagttcatgctgcagaagagtcatcatcggtcctttcgggaattgttaatcttcaagcgtttaccaccacctatcgtaatgtggtgagccacggctcgcgcgggtgtaacgtatgagccttatcacaccacccgcaacccttgtgcccaaatggccgttgccccaatcacgactatgcgcgaatactcgctaatatggcaatcagcagcccgctgataatggaggtttcatggctcagtcagactttgaacaggaatcgaccgcaaacgcaacgtggagtcgcatgctgcaaggcaaccggcgctttgccgagggcaagcccgaccatccatggcaggatcaggagacccgtcaaacgttgcttgatggccagaacccggatgccgcggtgctctcctgctcggactcgcgcgtacctccggaaatcatttttgatcagggcctgggcgacctgttcaccgtgcgcaccgccgggcaactcatcgatagcgcggttatcgcctcgctggagtacgcggtcaagaaactgcacgtcagcctgatctgtgtgctcggtcacgagcactgcggcgcaatcgaggccgccgagcaggagctggacgacctgatgcacaccatcacttccgaagccgacggctcactggaggccgcggatgcgatggacgacctcgacgagcacatcgccgccgccgaatcgattattctgcgccagaccggtatgtccgtctggcaggcgcgcgaagccgagctcgacgcgcatgaagatatcgagcgcgtgcatgtggcccacattattgaaactttggtggagcagtctcctgtcatccagcaggccctcgccgctgacaagctcatgatcgtcggcgcccgctatcagctcgattccggcaaagtggaagtgctgagcttctgagcgtgcgatccgcaatatcgccacctgcgtgggatttggcgaatccttggccatagccgcgagaaacagcctctctgcactagtaatgccgtccagcgctggaacgcatacggcatcgtcgaaggcgagcaacgcatcggaaacaccggtcgacacgtcgtccgcggtaatgataagagtgcccttccctttgccgagtttcttactgcccagccagcacaccccaatttgacgtgccactcccctagagttgaagccatgtcacttggtttgaacatcctcctgatttttgtatttctcgttatcggttccgtgttctccggcaccgagttggcattggtctctctgcgcggctcacagatcgagcaaatggagcaggaggacgctcgcggcgccaaagtcgccaaaatcgcacgtgacccgaacaccttcctgtccaccgtgcagatcggcgtgacgctctccggcttcctgtccgcctcgttcggcgcctcttccatcgccccctacctgattccggcggtcgaaagctggggcgtgcaccccggcatcgccggcggcctggtgaacatcatcctgaccctcatcatctcctactgttccatcgtgatctccgagatggtgcccaagcgcatcgccatgcagcgcaccgagcagatcgcgcgcgccgtggtgcccgccatcgacgccttcgccgccgtctgccgcccgatcatctggctcatcggcaagaacacgaacggcatcgtccgcctgctcggcttcgacccgcagcagaccgagtccgaggtgtccgacgacgagctgcgcgtgctggtcagctccaacaccaacctctccaaggacgaacgcacgattctggacgatgtgttcgacgcgtccgaaaccatcgtcgccgaggtgatgcgcccacgtgccgacgtggtcttcatcgagggcgaccagcccttggccgaggccgccgcgttcgtacgcgaccagccgtactcccgttacccggtgaccggcaaggatttcgacgacgtgatcggcttcgtgcatgtgcgcgatctgctggacgtgcgcgatccgaacgccaagatcgtgcgcgatgtggtgcgcgaaggcatctccctgcccggcacctccaagctgctgccaagcctggaactgctgcgtaagcgcggcatccatctggccgtggtcatcgacgagtacggcggcacggacggcatcgtgacgcttgaggatatgaccgaggagcttgtgggcgatattcgcgatgagtacgatctgcccagcgagaagggcggcgaacgcaccacccgcaccgcgttcgtcaatggcgtggccacgatcgaggccagcatgaccattgaggacttcgccgatctgaccggcatcgagctggaggacggcccgtacgagacggtcgccggctacttcttgtccaagaccggcaagatgggagcggtaggcgacgtgctgcattccgacgacggctacaacatggtcgtcaccaaggtggatggccgccgcatcgaaaccatcgaagtccgcaaagccggtgccccggaccatgcgccgctgccggccgaatcacaaagcgacgatgccaaatagtcgcgtgatattcaccacctattcgttcggcccggggcataaccaaaaaacgtagaatgaaagggcaacgttccacctactgaaagaaggaacattatgacacttgcatttgttgtgccgggccttgatgaagcggccagtgagaaggccatcgccatcctgcagaaccgactgagccaggagcaggaggccgctctggtcctgaagcacgcacactggaacgtgaccggcccgaacttcatcgccgttcacgagatgcttgaccccgaggtcgaggccgtgctggcccaggccgacgagaccgccgagcgcattgccactctgggcggcaccccggatggccgtgctgacgccatcgtgcgcaaccgcacgtggaaatcgttcgacgctgagggccgcgtgggcaccgaggagtatctcaaggcgctgatcgagtactatgacgccttcatcgccgacgaccgcaaggccatcgccgagctggacgagctggatgtgatcagctccaacatcatccaggaccacgtgcaggaactcgaaaagttccagtggttcatgcgctctcacctggcataagtaaaagccgtattccgtggctcccctcaaagaggggagccactttcgtctcacgtgaaatagagagtctccacatacataagttggaaaagtgtataaaactccccattttgaggttggaaaacgtagccaaaaccgcattcttatggttggaaaagtgtaaaatatgcgctataaacagttggaaaacgtgcccagcatagatgcaaggcctacaaatgactggagattctcatgctgcgaagaaaaatcgagacacagctggaagcttggagatccgcgccgaaacgcactgcactgctggtcaccggagcccgtcagattggcaaaacctatatcatcaggcactttgcccaacagcattacgaccatatcgccgagctcaatttcatcgagaaccctgacctcgttgcattattcgatcggccccgcgatgccaaaaacctactgatgaggctggaactggccgtaaatacgccattagtacccggcaaaaccctgattttctttgacgaggtccagcgttgcaaggaaatggtcaccgcaattaagttccttgtagatgatggtcggttcgattacgcgctttccggctcgctacttggagtcgagctcgaagatatacgctcggtaccggtcgggtacctgaccgagctggatatgtatccactggatttccaagagttctgctggtcgcagcatatcggcaacgacgtattcgatatgcttgccgaatgctttgccaagcaccaggaagtggatgagttcattcatcaaaggctcatggagctatactccaaatatctggtcatcggcggcatgcctgccgcagtcgactcgttcgtggcaaacggcagcgttgcggacgtgcgcactatacaagagaacataaagcgtgaatatcgccgcgatatcagccaatacgcgcgcaaagaagaccggctgcatatccgcgctatctacgatttggtgcccagcgagttaaataacccaaacaagcgctttaccttcgccaaaatcgaaaagaacatgagattccaatcggttgcttccgatttcgattggctggtcaatgcggatgtagccgtcgccgcgtacaacgtggacgaaccgtgcacaccgttggagatgagcaaggaacgtaacctcttcaaactcttttacaacgacgtgggtctgcttaccggctcgtttctcaagaaaaccgcgctcgacgtactcgacggcaaccctgatatcaactacggttcaatctatgaaaatgcggtggcccaagagctacgcgctcacggatttgacctgtactactacaacagtaagaagcttggcgagctcgatttcctcatccaagaccgcaacgatcacgtgctgccgattgaggtgaagtccggcaaatcctacaaacgccatcgcgcaatggacaacgtgctcgcccaccctgaataccatctcaatacaggctatgtgcttggcccgtgcaacgtctcagtcgaagggaatgtaacctacctgcctgtatacatggccggcatgttccataacgaatgacgggccgcacacttagtcaacaagtacatgtcggtcagatggttcggactggtcagagggcccgctctgatcagttaggtcggtctgaacggactggctgggctggtcggcctgagtagcccgtttggaccgatccggttcgcccttgctggccttcacactgcttcagctccagctgaagttcgctgatgcgccgttcgagttcgtcgatgcgccgcacgtgtggcgaagtgagactaaggggagccgagagatggctcacaggccgagggcaccggccacggccatggcctcgtgttcgggatcggcctggccgatgtgtacgttgacgtgaatttcgtcatcgcccggctcttcgagaatgtcggactgggattgcagcatgctcggcttcatgaagtggccttggcggtgggaaaggcgttccatcacctcgtcgaatgtgccctgcatgtagacgaacaccacgccttgacggcgcagcttgtcgcggtagatcttcttcaacgccgagcaggtgaccacggcgggctcgccggcggccacgcgctcgtcgatccacgcggcgatggtgtcgagccaaggccagcggtcttcgtcggtgagcgggtgtccggcggccatcgagatggtggcgcattcggaccatgcgaacgaatccgatcaggccatcagccacatcgccggcactgaagcctgacccgtcatcgtcacagcaccacgcggcggttgaggtcgcggcgcagcgtcttccagccgggtaggtaggcggtcatgcggcgctggaatccggcaccgtggccgctttcccacaaatgcgtcatctcatggaccaagacgtattccaggaattgcggttccatcagtcccaattgaaggttcagacggatgcggccggttcgcggtgtacacgatccccagcgcgaggtcatgacccgtagcgtgatatgcgtgggctgccggccgacgaccggcccccacttggccagcagctgtggcaacgcggcgttgatcgcggccgccgcttgtcgtttgcgttcgtcggtccagatttgggagcggtcaaaatacggttggacattcgtaccggcttggcctggcccggcgtcaccaattcccggacgactgatatcaccggttttcggacgaccggcaacgcctccatcatggccgctggcaccagctacaccacgacctccgttctcgaagccggcgccctcgttcaatgccatgatggagcgccgttgcgcctcagccatgcgctgctgctgggcgagaatccacgaatgtcgctctttgacgaaatccgcaatgcgactctcgctcatccgcatcggtgcggagatttcgacgcggccgctcggcggtttgatgcgcagatacaggtttttgatgggcttgcgcgtcaggtgcagatggatgccatcaatatccaacgactgcccggcggcagcggaccgaacggatttcggcgcaccggacttcggagcggtggattgacgacggcgataaggcacgcaagtcattctcgcacaacggcggacaacgatggcggcccgcccggaacctaacgttccgaacgggccgccatcagcaatgaacggtgctgtcggcaacggctacaaaccgtcaccgagccattgagtcacccaatcagcaaccggccgcggtcagcacctggtcgaggatctcgacgccctgggtcgcctcgtcggcggagatgacgcaaggaggagtgacgtggatgcggttgttgtgcacgccgagaatcaggccgcgcttgtcgccttcggccacgatctgcttcatcgtggcgtcgtccagcggctccttggtggtgcggtcggcaaccatttccacggcccagaacacgcccttgccgcgaacctcgccgatcttcgggtgcttgtcgtacagagcggtgagctgcgggccgagcacgtccttgccgatggtgtaggcgttgtcgatgctcctcttccatggcttcctgggtggccacgatggcgcccatggccagcgggtgaccggagtaggtcaggccgccggggaagacgatgtcgtcgaagcggtgggccaccgggtcgctcataatcacgccgccggcgggcacgtaaccggagttgcagcccttggcgaaggagatgatgtccggcgtgtagtcgtagtcgtcgagtgcgaaccagaagccggtgcggccgaagccggccatgacctcgtcggtgatcatcaggatgctgtacttcttggtgatctcgcgcacgcccttgaagtagtccttgggcggaatgatgatgcctgcggtgcccggcacggattcgagcagcacggcggcgatggtgtccgggccctcgaactggatcacgtgctcgaggtgagccagcgcacgctcgcactcctcttcctgggtggttgcggagaactcggagcgatacaggtacggggtgaagaagtgcacgtggccgcgagagtagtcgttgggcttacggcgccagtcaccggtggcgctgatggccgcaccggtgttgccgtggtagcagcggtaggaagacagaatcttgtcgcggccagtgaacaggcgggcggcgcgcatcgcgttttcattggcgtcggcgccagcgttggtgaagaacaccttgtcgaagccttccggagcgcggcgggccaccagggaggcggcgcggccacgggctaggttcgcgtagtcaggtccgacggtgcacaggagttccgcttgcttcttgatgccctcgatcaccttcgggtgctggtagccgatgttgacgttgacctgctggctggtgaagtcgagcatttcacggccgtcgccgtacttcagccacacgccgtgaccggttaccacttcagtgggatccaggttgcgctgtgcgtgccacgaatggaatacgtgtgcgcggtccagcttgtaagcgtcgtcccagatttccgcatcctgcgaaagatcatgccccatgatgtgtcctttcctcgatattttctcgaagtgcccgatgccgtctcccgtggatcggggcagggcagcaacgcgctgtgaatgtcattatgagagttgaacatttcgcgtcaaactcgaacatttaataatgttacagtagtggcgaatacgaaatcattttgaaacataggaacaagaacaataattgtatccagattatgtaatgtttatgttattcaaaaacatactcattgcacaatgcggcgctaacatttgactaccgttgccacagtgaccgttactatcggcagtcaagcagccagcaacaagccggcaaccgccatcgatcatcagccggcggcaatcggcaacattcacgcagacgcgcgctcatcacgctcgccgccaagatccgggaggcagatcatggatacgccatcgccatcaaccgcatcaacaaccgcacatgccgtcggctacaacgatgagccaagcattacggccgctcccctgcgttccaccgacgacctggccgttgatgccggccagttatcctcactcatcctcaccaccgaggcgacggccaccccgcaacgcatcgtcgaatcggtcacctcgctgacctcctccggcatacttgcggaaggccagcgcatgcccaccgtacgcgatctcgcccgactgctacgcaccagtccggccaccgtctccagtgcctaccatgccctcgccaggtccggcatactgcgctcccgcgggcgcgccggaacattcgtactgcggcagtcgcgcacgcatcgctacgatgccggcgacttgctggccgaagccccggccaccgcgccggaccgaccgattatcgacctgtccaagggcacgccggacctttcgctgctgccggacatccgcccgtttctcggcaagctcggcacgcacaaggcattcgtcaattcatacgacgggccgaccatcctgcccatgctggaacagattttgcgacgcaactggccgtatgagccggaggcgatgactatggcatccggcgcgggcgacggtttggcgcacaccatgaacgcttttgttcagccgggtgattttgtgattaccgaggcaccggaatatccgctgattctcgacatgatcgaggcacatggcgcgatggcgttcggcgtgccgatggacgggttcggtatgctgcccgacgcactcgaccgtgcgctgaccatgctggaatcgcagcgtctggcggtgccgcacggcggccatcaggtcagtatgatcctgctgcagccgcgcgcccagaaccctaccggggccagcttcagcccgcaacgcatcgacgctttggcggacgtgctgctcgcgcactacccgaatggcgttggtatgccgctgattgtggaagacgatcacagtggcgatgtggccaatgcgtatgcgacatcgttggcgcaacgattgccgcaacacgtggtgcatatccgcagtttttcgaagtcgcacgggccggatctgcgcttggctgcgctgtctgggccggaggatgccgtggaggcgattatcacccaacgacgcttgggatcgggatgggtgagccggttcctgcaagagattctgtatgaaatgctggccgacaaagaggcgttccacacggtgaccaacgcccggcatatctacgccacccggcaaaagacgatgcacgcgctgctgctgcgtcaaagtttggacgtgcataccggtgacggactgaatctgtggattccggtgcgcgacgagccggcggcgctgcgactgctggccgaacagggcatccgtgtggccgccggcaagccgttcctgccgagcctgcgtatcagcgccgacgccaccggagccgacgcgggggccggtgcgggcgtggacgcgcatgccagtcgaggcatccgcgtcaccatcgcacagcagggagccgtcaacgaacaagtggccgccgccctggctcaggcggcggccgtaacgccgaagacttcgacgaatcactcgtaattcttcatgaactgcgttcgtacgcgcggcgaggagccgccccgtctgtacggggtgatcaacgggctgctgcgcatgcgcaacgggctgcgcaggtcgcaggagctcgacgacctggtcgacgtgctggcctcctccatcggcgccctgaccaatccgcgtaccaactgcccacaccggagaaggtcgcgcaggagaagcctcgctgctcgagatcgacgacagcttccagaagatcgtcctcgtacgcgacgtggtcaaacccgtccgcgacgagcacggcatcctcacgatgagcgtctacgatttcctcctcgacccggacagcctgacgatgtgacgccgtggattggctacaacgtattagacagtccgatgagggacgaatgacatgagattggaggccgacgatggccgacccgaaacatccccgccactacgacgaggcgttcaaacggcagatcgtgcagttgtacgagagcggcaagccatcccggaagatccgccgtcgtggcccgacatcctcaggaccatcgagctgggctactccgacgccaggctcgaggcgtccgacaacaggatcaaggtcaccatccgcatggcctacggcttccaccacgcgaacagcctcatcgcactcgtcatgctccgctgcgccggcaatcatggcgcaagcgacaatcgcgacacgccgttattgacataccgccgttcaatggtattgtaatcacttgtgcgcttttgaagcgtatggatcgggcccgtagctcagctggttagagcgcatccctgataaggatgaggtcggaggttcaagtcctcccgggcccacaggaaaaatgaagcggccgcgagccgctctttttttctcacggggctatagcgcagctggtagcgcatctgctttgcaagcagagggtcgccggttcgaacccggctagctccacagacacaacaaaacccttggaatcagtccgattccaagggtttttgttcttgcattttctgcgtattgcaacaaaaagatgacgacacgccgatagcgtatctcacgagaaaagtcttattgcctcacgactgtcgaggccaccggaagtcggcataggcattccaatcggccactaaatcgaccgatgcccgatccctgagccaaacggacccgaatgccgttcatcatcgacaaagcagtccgcgcctcgcgacgaggatctgccaaaccgtcacgctcgactgctcgggttaaggtgtccatcacgcgatgttctcgtttttggtaatactcataggcaggatgatgctcgttcaacgattcgccttgtagcacggtatatacaaccgcaccatctctggctgagccgcattgcgctccataagggcagcacagatatcacgaatgccgaactgcgcgttgccgctccacatatcctcaggttcaacgccaagagaatgggcaaacgtagccatgtcttcccgatcacgatgctccagcacggcaatcagcaagccgactttgttcttgaaatggtatatgaccgccggctcggtcaatccgcatgcttcggctacctgacgaacggaaaagccccaaaacccgttctgtgaatcacatgcgacgtcacgtcgatgatctgttcacggcgttccgcacattctgattctgctcaagacagatccagctcgttgttgtccttggctttgctcaccgtatcagtcaaatcggggtcgtccacagacaccgcgttctgctggctgagcgtcaacgacagcgaacctttgtaggagtcgccgtattcgtccttgccggacacgcttacggcaatcgagctcatcagacgcttcctgccgtagttcagatccacggtgatagtcggcatatccggctcttcatccgtgccgaagtcccagttgcgcacattgtcgagcgcctgacggtactcgccttcagcatcgcccacaccggtatcctcgatctgctgaatcacccatgatttcagatgcggatactgcgcttcatggctgatccagtaattcacaaagtgctgggtcaatgccttgacatcgatttgatacgagagctgcgtgttgccggcagacttggcagacgatgtattcgggaacagctggctgcgcacattcttatcttccagctccacgccgagatattgttggatgaatttgctggcctcggccttcacctcggcagacgttttcgtgcccttggcccggtcgatgtcgttcgagtacccatcgtcgttcatcttgtccagctgatcgtagaacgttcgctccgcgccggtgatgtcccaagcaccgttcttgaccaacgcatccttgacgttcaatatcaagtccgccacatcactaccaacgccgttccttaagtcatcttcatattggtcggccgggtagtagatgtagtaggggtcgtcatcataccaaacgtttttcccggcgaatgcgcctttgtgccaagcgagggttgttgcctgttcatctgtcttgatggtcacagacgcggaggagtcattggtggttttgccccagcgaatacatgccagacatccgcgcgtcaagggagtcgtcagtgctgctgtgggttctgagttcgtatttggtgctgcgcagagtggacagcgagttgatcgcgtcgaaggtgacgaccagcggattggtgggctggaagcccagcatcgctttgacggcggtgaagttggggacgatgaatgccaaggccgccaccagaatcgtcgcaagcaatgcgcagagaacggcgatcagcttcttgctggatttgcgcggcggtgccaggacggcggttgcatcagtcgcctgatatgcggcaggagcgggaatcggcaaagctggcaagggagcagttggtgccggctgtggggcagcggacgcggcgtaaaccgatggggcaaccggcgcggctggtatcgatggtggtactgaaggcgctggcacagcaggtgccggtatcgacgcagtcggtacggctgacgatgcggccggcactggtacagacgcaaccggtgcgctgtctacagacgctccacatgccgggcaaaatcgtgccggcctatcaactctatttccgcagtggccgcagtacgccatcgtgtgcttctcttcctcaaatcggcttgattgccattgcttcaatgttactcttcagcattacgcctcagccagcccctacgcgtaacgatacgaaacgcggcagccttaatgcggttgttttgacgcgatgtcaacttgaggctagactgtgccgtgagagaaattgacgctgcgtcaacatagcggcgtctataggcgtctcagcaacccaatggaggactgcgaggcgcacagcgcacacacggaaaggaccgcttatgctgtttcaggtctacggcgacaacgccatctaccaatggatcggatggatactcgtcttctgctgtcttatcggcgccaacgaactggcccgccgcaccaaaaccggtggcgttatcgccttcctcgtcataccggccgtgctgaccgtctacttcatcaccatctacacggccgccgccatgggtgccgactgggccctcaacaacccgacctacgtacacatgaccagctggttccactatgccaagctgtacgcggccaccatcggctgcatcggtttcatggccctcaaatacaagtggggatccatcggcaaatcgcactggttcaagtgcttcccgttcgtgatcgtggccatcaacatcctcattgccgtagtgtccgacttcgaatccgccatccgcggctggggcaccacgtggatctccaccgaaggcgtgaccctgtacggtggctggcacaacgtcttcaacggcgtggccggcctgctcaacatcttctgcatgaccggctggttcggcatctacgcctccaagaagaaggacgacatgctctggccggacatgacctgggtgttcatcgtggcctacgacctgtggaacttctgctacacctacaactgcctgcccacccacgcctggtattgcggcctggcgctgctgctggcacccaccgtggccaacttcttctggaacaagggcggttggattcagaaccgcgccaacacgctggccatctggtgcatgttcgcgcaggtgttcccgatgttccaggactattccatgttctccacccagtccgtgaacaatccgaatgtgaaccttgcagtctcgttaatcgcgttggcggccaatgtgctggcacttggctacatcctgctacgcgccaagaagcagggcatcaacccgtggaccaaggaagtgttcaaaggcaccaaggattacgagcaggccatcgctcgcgccgacgagtctgaattggcggcctagcctcgctttaagcctcaggccaacacctccatggggtgataagtggcggtgtggtgtccggtgatggggttccatacccgttcggcgaatgcgcgcagacgggcgacgccctcacgcagctcgccggcatctccggcgtaggagaggcgcacgaagccgcgcccctcctcgccgaaggcctcgccggggaccacggccacgtgctcttcgtccagtagacggtctgcgaattcaccggagtcaaggccagtcaggcgtacgtccacaaaggcgtagaacgcaccttgcggttcaatcaagcgcaataccgggcatccggccagaccgtccagcacgatctggcgcttggcgcggtattcctcgcgcatggcggccacatgatcctgcggaccggccagtgctgccacgcctgcgtattgcgccaaggagttcaccgaggagtgcatgagttcggcgattttaccggtctgttcgatgaccgcttcgggtgccagcaggtagccgatgcgccagccggtcatcgcgtaggttttcgacaggctttccaccacaatggtgcggtctttcatgcccggcaccgcggcaatcgatggtgccacggctgcctctcccccaagcgtttccccgaacgtttccccaaacacgaacggatggtaaacctcgtcggagatggcccaaatattgtgctgcttgcatacttcggcaatacgcgccagttcagcggcagaagttaccgcgccggtcggattgccgggtgagttgatgattacggcgcgggtgcgcggggtgatcgccgcttcgatgtccgccgcgttcacgcgcatgccgtgctccggacgcagcgccacggtgaccgggcggccgccgcacagcatcacttcggcgtcataggaagtgaagaacggcgagggaataatcacttcatcgccggtgcctaccacggctttcagcgccagaaacaggccaatcgtggcaccgtcaacggcttgaatctcggtttcgggatcataagtgagtcccttcacacgggcggagtaatcggccacggccttgcggtattcggggacgccgagcacgttggtgtaccgagtgcggccagcctgtgcggcctcgcaagcggccgccacgatatgcggcgcggccgtggcgctgggctcccccacggtcagtgaaatcgcgtcaggcacgcgctctacacggtcgaatacgtctcggatgccggagcgcgggatattcagggcttcggcggacaagctcgcgggcttggcggtcggcacagcaacccgtctggcagcaggcacagcagcagatgcaacttcggacagaggcatgttggaaaacttctgcatatcatccctcctcaatggaattatttcgtcgttctcttatttcagaaggaattattacattcaattaggactttaggcataaacattccaccacacaacagaaaacacaggaagaactactgaaattaccaggcaaaatcggaaagccatcgcattccggcaacaggtacagtgaacacagagcacaacgaacggagaagacaccatgaccgcgattgacgagaccgaccagcgcatcctcaccatgctggaggccgacggccgcgccacgctcgcgcaactggcccaggcgaccggactgtccgtctccgccgcccagtcgcgcgtgcagaagctggagaagcgcggcatcatcaagggatacaaggccatcatcgaccaagagcagcgcggcttgcccatcagcgcgttcgtcaacgtgaccccgctcgactactcagccgaatcctcgattccggacaagctgaacaatatcgacggcatcgtctcctgctattcggtggccggcgcccccagcttcgtactggtggtacgcgtggcctcccccaccgcccttgaggaattgctcaatctcatccaccgcacggtgccggtaagcaccgagaccacgatgattctgcagacctacttcgcgcactgaccgcgaacccggtaacctgcgcgccgaagacctcggcccctacggcgcacgattcccaacgggcacatccgacatcacccaagtccacctttatgtccactatatgaacgcaccttcggtgtgatgcagcttccatttcgacccgattcacgcacagacagacatccagcaatcgccgaaaaatctaacaaacggaaacttgaaccaccccataaccacgccgatagctttcccgttatccgagcgagactctatgcagcaagggcctgcgcgcatagaataaaaccgtcttaattccctagcaaatcgaggagaatcatgctcactgacgagtacatcaagcgtgtctacgaccaggtcgttgcccgtgacggcgatcagccggagttcctgcaagccgttcgcgaggtcttcgagaccctgcagccggttgtcgagaagcacccggagtacgagaaggccggtgtactggagcgcatcgtcgagccggagcgcaccatcaagttccgcgtggcctgggttgacgacgagggcaaggttcaggtgaaccgcggctaccgtatccagttcaactccgccattggcccgtacaagggcggactacgcttccacccgaccgtgaccgagtccgtcgtcaagttccttggcttcgagcagattctcaagaactccctgaccacgctgccgatgggcggcggcaagggcggttccgacttcaacccgaagggcaagtccgacgctgaggtcatgcgcttctgccaggccttcatgactgagctgagccgccacatcggccagttcaccgacgttcccgccggcgacatcaacgtcggtggtcgtgagatcggctacctgttcggccagtacaagcgcatccgcgacgagtactccggcgtcctgaccggtaagggtctggaattcggcggctccctggcccgcaccgaggccaccggttacggcgtatgctactacacccaggaagccctgcgcgtgctgcgcaacgactccttcgagggcaagaccgtcgtgatctccggctccggcaacgtggccacctacgccgctcagaaggctgagcagttgggcgccaaggtcgtcaccgtctccgactccaacggctacatctacgacccgaacggcatcaacgtcgaggtcgtcaagcagatcaaggaagtcgagcgcggccgcatcaaggaatacgccgagcgcgttccgggctccgagtaccacgagggcagcaagggcgtgtggaccgtcaagggcgacatcgctctgccgtgcgccacccagaacgaggttgatggcgaatccgcacagaagctcgtggacaacggcgtgaccgtggtcgtcgagggtgcgaacatgccgtccaccccggaggccatcgaggtctaccagaagaacggcgtgctgtacggcccggccaaggctgccaacgccggtggcgtggccgtctccggcctggagatgagccagaacagctaccgcctgtcttggaccttcgaagaggtcgacgccaagctcaagtccatcatggaagaaatcgtcgccaactccctggccgccgccaaggaatacggtcacgagggtgacctgatgctcggtgccaacgccgcaggcttcgtcaaggtcgccaacgccatggttgcccagggcgtgctgtgacgcttgccgctgagcaatcgctgagcagtgctgagcaatactaagcagtactaagcagtagcgtaatgcccttgcttccccgtgaggaggcaagggcattgctatatgtacaacgagcaacaagtgctatcccaaatacgtaagcattacgcaccactatacgagtgaattcttggatatgatcatcgatccaagctaactgcattcagaggggtactgaatatgggaaaccccgagtataaacgccgtcattgcaacgcttatactcgaggtttcgtggttcaggtacccctttgaaagcagttggctttctgcaaagccatcaatgtacctctttcaacggagatagccccccgtctacaaggtcaccaggtccggttcgcagcaacgctttcaatcactgctggcgattgcggcgcactgctaccagcgccaagccagcaacgagcagcggcacggcgactacaaccaccgcaatgatggccgagccggtttccggcatggtgtcggccttggccgccgaatccgcgttaggcgaggcgttgccgcccggctgagtcggctgcacatcagtgccggtcgagtagttcgggtcgtaagcgaatggccacgcgccatccggcacaacccactgaccagccgccgagccgaagcccagtgccgcgagcaattcagcacgcttcgcctgcacctgagcctcatccaaagcagacatcgagccgagcacgacgttcttataatcagccggatcaagcagcgcgccggtttcatcgtggctggcgtattccgcgaatcgcacatcatcgtggaaggtcacgtccacgcttttgccgctctggttcttgctggtccacacattccaacgattcttggtgatcttgctggacatcgtgctgtcgaggtaggtcacggccgaggaagtgtccgtatacgccgagttcttcgtacccaaatccacgccggtcacatagctgctgccgtcgcccttacgcacctgcgtgtactgcgcgaacgtctgccacgggcggcccagcgaaagcttggcatcgtcgtcatatgctgcggcaacggtcaagttgcagcggtcaaacaccaggcccacgccggacttcttggtgttggcggcggtgaagtagccgttgttcttgccggcgaacgcggccatgtgcagctcggtgccggcgaagtaggcgttggcgtcgccgaacacgaaatcaaccgtgccttcgatgtagccgccgtccacgtacacgcggttgccggcgccctgcacgtacagagtgtcctgacggccgatgatgcggctgttcttcaggtacaccttgtctgcctgggtgttcagcgccacggccggcgtctgctcgcccgccgccgtgtgatccaccacgttgtaatcgttctggaaggtgatgccgtaggcggagaaacctgtggcacccgcgccaatggtcacggtggcgcacttgttggtgccaaggtcgaattcatcctgcggcacaaacttgccgtcggcatcgaatgtgttggacgaatagtagctggcgcgaatcgtcaccgcgcgcttggcggtcacgtcggcgttggcgaaggtgacgcccggcttggtcacggtgatcttctcgcgatagtcgcccggagtgatcttcagcactagtcggtcggtttcggaagagtcgttagcatccagagcggcttgaatggtccggtactggccgttcgggcccacggtgaccgtgtggctggtggcggcgggggagccggccgcgtagtcgatggcgatgccggtcaggtacaggctgcccgtgccttcaacggagagcggcacgtagcgcgtgctgtcggttgcgatggttacagcagtgccggtggtgatgtccgtaccgtcgagcttgagcgtaggaccgtacagctggcccttcacggtgactgtagcgccgccctcggcctgtgcgaccggaatgtacaggatggttccagcgttcacctgagtatcgctgccgccgcttgccgcggtagtacgcgggttgaacttggcgccttgcgcccgagcgtcgatggcgacgccttggtagttgtcggtaggccctgcacggccggtcgatcgatgccggtttccgtgaagtcccagttcgtgtctttggccgcgaccgtgggcgtaccggggaactcgggttccggctgctgttcggcaagggcgatgccgttgagataggtctgggcagtgaaggtgacgtttaccgtacgagccgactccgcagcaggcaaggcgataactgtgttgtcgctgctcacttcaccggcatccgcggtaatagtggtggtgccgccggacaacgcaagggtgatggtggctgtattggtgtgggctggcaccgggatgctgatgatggttccggcgttgatctgggtgtcattggcgcgcggcgcaaacttggcaccgtttgcagtggcatcgatggtcagcccgtcgaacgtctgggatccgccttgtatagtgccgagagccgccagctcagtgttgttcgcaggattcagcacccattcgcgattgatggattccgcggcttgcgtgctgctggtggtgccggtgctcggcgacgttgcttccgcggccgatgcagtggctgccgcaccgccaaatatcatgcttgcagccaacagcacaccggcagcacgaataatggtgtttttcatgggtgttctctcttatgtatcgatgtacaacaacgaaagccgctttcggaacacccgagtcggttttgcagcctgaaagcagggcttcacctgctgaggggaacacgactatcgggcatttcccagcctgtcttcgcgttcaaaatatcaccgaaaaaaatgcgactggaaccccgtagcacaacaagaaaaaaagggggtgcaccccatgtgttgggatgcacccctaagtggtcaataagggggagttggaatgggactcatgactcccccccccccccagcggcgccaagctggcgggttctagtgatcgttgcaacacctgacctaccgcaaggagggtcaggtgaccagaagccaccgaaacgaagaccgtggcggggaacaccgttggacgttcaacggcgtcgaatatccgacga

SEQ ID NO: 24 - DNA, 102088 bp, Bifidobacterium longum
gatcgtcgacgagatcaacaaccgccccatgcgcgtgctcggctaccgcacgcccgccgaggcgttcgccgacgaactgttagaattacaggaccaacaagggtgttgcacttctaaatagacatcggggtaggctccgcccgcaagtcacagtggtacaattttcaggtttgagactgtagcaagttgagtcgctttatcagtaagtctgtatttggaggtatcgatggcccatcgtccgcttatcggcgtggtcccgttgtgggacgacacactgaatagcctgtggatgctgcccggctatttcgacggcatcatcgaagccggcggcatcccggtgatgctgccgctgaccgacgacgagactacaatcgaacagctggtcagccaatgcgatgggttcctggtcaccggcggccacgacgtggatccagaacggtatggcgaggcggccggccccaagacggtcaaactatgcaaggcccgcgaccggatggaggagcgcctgatcccctccgtcatcgcggcggacaagccattgctgggcatctgccgcggcatccagagcctcaacgtcgccttgggtggcacgttgtggcaggatctgccggacgaacatcccagcccggtcgtgcatcatggcgacaagccgccgtatgacccggtggtccacgaagtgtcgatcgcgcccgattcgccgttggcccgcgcgttgtggccgctgggagacaacggcccgagtgaggcggaggccgatgaggtcgattccttcggcaggccgtatcatccgcgcgcctatacgctgggcgtcaacagttatcaccatcaggcgattcgcacgctgggccagggactggaaccgatggccactgcgccggacagcatcgtggaggcggtctggatgccggccaagcgtttcgtctgggccgtccaatggcatcctgagttctctcaccgcgccgatagcaaccaacgtcgcatcctcagcgccttcatcgacgcctgctgacgcaagctcccgccaatctcgacgaaacgtcttccaagaaatggcttgcccgcatccgcagccccctaccacgacatgagcgcccttgacaacgtcaccctcggcatgcgcttcacccgtgacagcaaacaggtcaggcagcgcaaggccaaggccatgctctcccggctcggactcggccatgtcgcgggagacaagatcatgaccctctccggcggtgaacagcagcgcgtcgccctcgcacgatgcatattgaagcccggggatttgatccctcgccgacgagcccaccggcgcgctcgaccgcgatctcgcccaacatgtcttcgacgaaatgctccgcctccagcacgaatacggcaagaccctcatcatcgtcacccacgatcttggcatcgccgcacaatgcgacaacaccatcgagctacaggcggtttgacggagatattccggcagctttggtctaccgaagtcacgtgttgcccttcaatctcctcggaaatctaggtggcccatttttcaaagaatgcgatcggacgtaacgccccgtaaggagacctgcaatatgaaacgttgaatcgtcatctaaagatgacgttttcgtagatcttccggaatcgccagtcatctgcgatccggatatggcaccggtccggctcgatcgagcccggacgaccatggagaaaacgaacgatcgaatccgaacgcgggtaaagagcctgcgcgacaccattgataaagccaaatttaagaaaacagatcagtatgcataagttttacatgccttcagcctcgtcaaccggcagcgggccccagaatccagtcacagccaggcagagcgtacaacatactgcgtagtacatggcgcgaatcccaatgaccaccatcgattgatgacggccacgaatactcgtactcagccttactgctttggctcatttctgttcacttcacgctggagtaccgagacacgttgagcggaaataccggtaattcacgtacggttaccgaccattggcctgaatggtactcagcatccgcagtcacttggggtatggtcatgacggagagccatcatgaccgatctctcgttattctgggatgaatccggcgaagccggaactgaatctaaatattaaaacgcatgatgcacacgtcgcggaattagtccaccagaacttcggcatattcggcaggttcagcgggttcgatgtgtcgggcacgcatggcatcgagtgcggcagccaagtcggccgggtactgggaccggaccgtggtccagacgcgggtgcggggatgacggaattcgagcttcatggcgtgcagccactgccggtcaagtcccaaggcctcagacagcaccggattggcaccatacatggggtcgccgcacaggggatgcccaatcgaggagaaatgcacgcgaatctgatgagtacgtccggtctccagattcacggataccagagtggcctcatggccgaaacgctccagcacatcccagtgcgtaacggccggtttgccggccggagtcacgcagaagcggaaatcggacactttggcgcgcccgatcggtgcctcaatggttgctttgttctctttaagaccaccctgcacgagcgcatgataggttttctttacctcatgctcggcgaactgccgacgcatctcggtgtacgcaaggtcggacttgcacaccaacatcaagccggaagtgcctacatcaaggcgagaaacgatgccctcacgcccggccgcaccataggaagtgatatgcacgccgcggtcacgcagtgatccgagcacggttggaccggtccagccaaccgaggcatgcgccgccacgcctacaggcttatcgactacaacgacatcatcgtcttcgtagacaacggccatatcagttgcgataggctcaggctcggcctgttcctccgccaaatcaaattcgacggtctcccccgcctgcaatgtgctggaccgtgcaacttcacgccctaaaacgcgcgcctgcccggagtcaaccagatcggcggctttagatcgtgaaatacccagcattttggccacggctacgtcgaaacgcttacccaccaatgcatcgggagcagggactattcgactcattacttgtcgtccgcctccggctcagactgtagggattcgtcggattgctcgatgagatccttgtgcgagaacggctcccccataagaatcagaatcaccaggaccacaccggcgactaccagatagatatccgccacattgccaacggaccagccatagttaaggaaatccaccactttgccgttgaggaagccgtcagcgtacataacacggtcaatcaggttgcccagagcgcctgcaaacgcgaaagaaatcgccaccgaccatttcatggagacagtgcgcaccccagccacagcaagggccacgcaagccacaacggccaacagactgattacccaagtagcgcctgatcccatgcccaaggacgcgcccggattacgcaccaaggtgaaggacagcagtccgggaatcactcgaatggtctgaccgttggataacgcggccatcgcccaagccttggtgagctgatcgacaatcagcgcagccgcggccacacatgcaaagacggccacgcgggtgcgcagccgtccctgttggttcgtcatacgacctgtacctgcctacgctcagttggtcttggacgaggtctggtcgacgtagttgttcgactcggaaacctgcgatgccagctggccgaggtactcggtgaggcgggcgcggtattcagtctcgaactgcttgaggctctggatgttgccctcgacgaccttggactgagcctgaaggttgtcgcgcacctgctcggcatacgtatcggctgcagagcgggtgttcttgtcgtacgcatcagccgcggaacgagtgttcttgtcatactcggcggcacgctgctgcacttccttctcgtagttgtcagcgtcatcgtgctgagacttggagtagttgtccgcatcctgacgagtcttgacggagtatgcgtcggcctcagaacgggtgttctgggagtaggtctcggcatccgcgtgagtctggtcacggtaagcgtcggcctcggagcgggtacgatccgaataggtgtcggcgtcggaacgagtacgagtggagtagtcgtcggcctcggaacgggtacgctcggagtagttgttggccttggtgaccagatcgttgtacttgttctggctggcctcggtgatttccttggccttgttcttgcccttctccacgtactgatcgtgcagctgcatagccagggtcagcatggcggtggcgcgctcgggctcggtgcccggcatggaagcggcgccagcgatcttctgcagagaaccggtctcggtgctcggctcaaccttggaaacctgagcacgaagctggttttcacgctgcttggcttcttcgagctgacgggacagctcagcgatctgagcggactgctgctgagcggcggaaccctgctgctgagcggcggcgagctgacgggacagctcctcattggccgcgcggaactgatcacgttcctgctgaatggcggcgatctgctgaccgacagcctcctggtcaccggaggcctgagcagcctgagcggtgagctgatcgatttgagcgttcagctgatcgacctgacccttgagctgctcattctgggaggacagcgcgcggttggattcctcggcttcgctgagcttggcagagacaagctgtgctgcctgatcattgccagcctgagcggcctgctgggcctgagccacagcgttcttcaaaccagcattctccgactcgagttgctgcacctgaccggtaagatcggagatcttcgcattaaggttggtcacgtcaggacccagagactgggtggcctgaccgccggctaccgcctgacgtccaagagcctcgacggtttccgtgacctgatcaaggaagtcatcgacctcgtcgacatcataaccttccttgaatcgaacagtctggaaggtatgctccctaatatccttcggcgtcaacagagccataaatcttgcacctcgctttggggcatcgcccgcacttacgttggtctcaagtcagaatgctatcacgaccccatcgtttcagaacattcgacgtgggtttttatgccagatatatgcctccggcgggtcaaaaacggcctcagaacactatcagaacaacactttccagtaccaccagcgcaaaatacagcacaatgaagctgacatcaagataaatcgaaccgagcggcaatgggcgaatatagcgacgtagccagcgcagagggggttcggtaatggaatacacaatattgatcagctgggccaccacaccacgtggataccagtttcgtgcgagaacggagacccagtccagaatcatgcgcacgaacagaaccgtgatatacgcgttgatgagccatgcaagaatgcggccgatcaaagagaacactaaggaaagcatgctgacagactaacaaccgcgcatgaaaagtttgctcggagcacaataagaatcggccgactccttgctgggagtcggccgaataccgatataacgtcgaatgcgaaaactactgaaccggtcagtcagcgaacaaatcgtgtgccgaggctggttttgtcggctcttcgaccttgatgttcacctgcgccgggctcaacaggaacacgcgcggagtgacacgctcgagggaaccacgcacgccgaacaccacgccggcggagaagtccacgatgcgatatgccacggcttcggccacaccggtgagattcagtacgaccggaacaccgtcacgcaatgcacggccgaccagttgagcatcctcatatgacttcggatggatggtggtgattctgttcacacgaccaccggggaacggcttggtagtcgacgatgcggcaggcgcggtggttgacgccagcggcgtgaccgtatggtcggaatcaaatgcggacttcgaagccggcttctgctcctcgtcctcctcgatgtagtcgtcctcatcgtccacaacgtcactcatgcccagataggacatcgcgtttttcatgaacccagccatggatcaatcctttcagcgcaggaagtcagggatgtcgagatcgccagccggatcgttcacggcgatattcggatgagcggaagtcggatcatcaaaaggcaacgatgcggagtcaccggtagccggtgtgaatgccggttgggcagtggcagcgggctgtgcagccggtgccggtgctggagctggctgtgccacgggagtcgcaggatcggcggcggttggcacaaccggcgtcaccgtgctctgagtgtcgtcatcttgagcggcgacggggtcaaaaccagcagcaataacagtgacacgcacttcatcgccataagcatcgtccagagcaagaccccaaataatctgggcttcagggtgaatggccttgcgcaccagttcggtggcagcagaggcctcctgcaacttcaggtcggtcggaccggcgatgttgatcagcgcaccgtgtgcgccttcgatgctttcctcaagcagcggagagctgatggcgatttcggcggcctgcgtggcacgatcctctccccgtgcggaaccgataccaaacagcgcagtaccagcaccacgaagaatggagttcacatcgttgaagtcgacgtgaatataggagttcatcgaaatcaggtcagtgatgccctgaacaccggcaagcagtgcggtatcagcggtcttgaaggcctcaatgatgccgatggaacggtcggaaagctcgagcaggcgatcgttcggaatgacgatcagcgcgtcgacttccttgcgcaggttgtcgatgccgtattcggcggaagcggaacgctgagggccttcgaagctgaacggacgagtaacaaccgcgatggtgagagcaccctgttgatgagccgcacgagcgacgatcgggctggcgccagtaccggtgccaccgccctcgccgcaggtgacgaacaccatgtcggcacccctaagcgcctcttcgatatccgactggtggtcctgggccgccttggctccacgctccgggtcggcaccagcaccgagaccacgactggacttatcggaaagggaaatcttgacatccgcatcagagcgcagaagatccttcgcatcggtatttaccgccacaaattcaacattctgtaatccctcggcaatcatgcgattgacggcattaccgccggcaccgccgacgccaacaaccttgatgttggtcttgtcgttgaactcattctgcgcgatctcgctcacgtttggctcctgtcacttcacggttacacccaagagtagcgcaaacaggctactcttggagggaaattcacgcgcagaatggcgcgtgttgcgtgtattttcagtattttctcagtaactggcgtccattgggtcgtcaccgaagagcgcctcacgctcttcgtgggtggtggtacgcgattccaaccagccatacggcaagtgcaccttcttggcgaaacgcacgcggccgcgcggtttgtcgaccacgcgtggcgggtattcgatagtcgggtcgagcttgccgatctcgcggtccacatcggccaggctctcgcattccataaaggccttgcgggtggagccgcccaccgggaatcctttcagataccaggcgatgtgcttgcgcagatcgtggacggccatcatctcatcgccctcataaaactcggtaagcagctcggcatgacggtgaatcacgcggcagacctcgcccagattcgggttgagccgttcgggcttgccctcgaaggcgtttttgatgttggcgaacagccacggccggccctggcatccgcggccgatggccacaccgtcgcagccggtctcgcgcaccatttcgagcgcatcctcggcaccccagatatcgccattgccgaataccggaatgttgaggtgttccttgagctcgccgatgcgggaccagtcggaatgaccgccatagtattcggcggtggtacgggcatgcagggttacggccttgcagccctcctcctgcgcgatgtgtccggcttcgaggaaggtctcatggttatggtcgatgccgacgcggatcttcgcggtgacggggatgcccgccggctcgcatacggcgaccacgcgctgtaatagctcagtgaaaatgtcggttttccaaggcaaggccgaaccaccgcctcgacgagtgaccttgggcaccgggcaaccgaagttcagatccacatggtcggccatgttgccgtcgaccacgattttcgccgcctgttcggtgatggaggggttcacgccgtacaactgcagtgaacggattttttcgcttttggcgaaatgacagaggcgcagtgctttcgggttatgcgccacgagggctcgagcggtgatcatctcggccacgtagagtccatcgggaccatattcctcgcaaatcacgcggaagggccagttggtcactcccgccatcggcgagagcaccaccggggtcggcacggtgatgttgccgagttggaccggggcgatatgcaccggggtcccggggcgcgccggcgcgtccgtacgtgggtcgaggttgtcggtctcgtgatgctcggtgagcactgtttcggattcggattgtgccatgtgattcctaagaaaataagtaggggctcccctgagagaggagccccggcgtctatcgccgccacttcgcctacaaacagcccactgggatgtcttccttacggctcagcccacagaggggagcccaagttgtgcgactccggcttagtacaggccgccggcttcctgaacgccggactcaggccaaggctcaccgcccatttccacaggcttcaggggcacgcgggtgcgcttctcgccgatgcgggcggccacgtaatcggccaccttgtcaagagcgacgcgctcctgggccatggtgtcacgctcacggatggtcacagcgtggtcctcgagggtgtcgaagtccacggtgatgcacagcggggtgccgatctcgtcctgacgacggtaacgacgaccgatggcaccggactcgtcgtagtcgatcatccactcgttgaagcgcaggtcgtcggccaggttctgggccacggtctgcagttcaggcttcttgctcagcggcagcacggcggccttgaccggggccagacgcgggtcgagacgcagcacggtgcgcttgtcaacgccgcccttggtgttcggggcctcgtccacatcgtaggcgtccacgaggaagcacatcagggagcgggtcaggccggcggccggttcgatgacgtacggcacgtacttctcgccggtggcctggttgaagtagctcaggtcttcgccggagtgcttggagtgcgcgctcaaatcgtaatcggtacggttggcgatgccttcgagctcgccccagtcggaaccctggaagccgaacttgtattcgatgtccacggtgcgcttggagtagtgggagagcttctccttcggatgctcgtagtggcgcaggttctccggcttgacgccgaggtcgatgtaccagcgggtgcgggcgtcgatccagtactggtgccattcctcatcggtgccgggcgtgacgaagaactccatctccatctgctcgaactcacgggtgcggaagatgaagttacccggggtgatctcgttacggaaggacttacccatgttggcgatgccgaacggcggcctggaacgggaagaggtcatcacgttcttgaagtccacgaagatgccctgtgcagtctccggacgcaggtagtgcaggctgttctcgtcctcgaccgggccgaggtgggtgcgcagcatcatgttgaagtcgcgcggttcggtccactggccacgggtgccgcagttcgggcagacgatgtccttcatgccgttttccggcatcttgtcgccgtgcttctcggcgtaggattcctcgagcttgtcggcgcggttgcgcttgtggcagttgagacactcgacgagcggatcgttgaacacgctcacgtggccggacgccacccacacttcgggcggcagaatgatggaagtgtcgacaccgacgacatcaggacgggtgacgaccatggagcgccaccattcacgcttgatattgtccttgagagcgacgccgagagggccgtaatcccaagcggaacgggtgccgccgtaaatttcgccggcggggaacacgaagccgcgacgcttcgcaagggatacgacttcatcgagtttggactgagccacaatgcaccttctggtttgaacggtttggggtctaataacaaccgcttcaggatagccgtatatggtgacaggtcaggcggcattgtccggtatatgttccgcgtctcacgagcgaccgttcgcagcgattcctatatcgcaacacctccatattgttcctgttgttttacccttcccgaatttgtgccactgacatcgcgtcagcgtcacaaattcgggagatgttgctcggcggaggcgtctatgtatcacgaatggacggggacgcgccagacctgacgacacgtatcgaacaaatccgtcacgataatgtccatgttggcgcatagcgtcggcactgtaatgcaggggaactcgcatgtggttcgcgagttgagaaaggcctgagcctgacccttagaacctgttggttaagaccatcgtagggagcagtaaatgagcaatagtgcatcatcgtttaccggcgtgtccagcggttataccgccgggactccggttccagccgattcacccatccgtgacaatatcgccgatgccgttcgccgcgtacgcgagacgactccgttggcccagtcattcaccaattttgtgaccatcaatttggttgccaacgcgcaactggcggccggcggcactgcggccatgagtttcctgccggacgacgtgatcgaaaccgcgaaaatcgcgggcgcgaactacatcaacgtgggcacgctgctgccgttctataaggacgcactgcccgaaatcgcccagcgactcaactacttggacaagccgtgggtgctcgacccggtggccgccggcatcggccgcacccgtaccgccattcttcaggccttcaaggccgctcccccgaccatgattcgcgcgaatgcatccgaggtaatcgcgctggcgaacatgtgggggctcaataccgaaaccgtgggggacgcttccgagcaccgccccgccggagtggaatccgtcgacgacgtggagtccgcaaccggcgcggcggtggcgctggcacagtatctgaccgaacagcacgccaagcattcctcccatgacgcttccacccgctgcgccgtggccgtgtccggcatcgccgatctggtgaccgatggcgaaaccgtgtaccgactgccgggcggcagcgcgatgatgaccaagatcatcggtgccggctgctcgctgggcggcgtggctgccacgtatttggcggtctccgatccgttgaccgccgccctgtccgcgtctctgctgtacaaccgcgcgggagaggtggccgatacaacttcgcacggaccgggctcgttccaagttgcgttccttgacgcgctgtggaatgtgaccgccgaacaggtggcggaatccgagatattggtgcagtagtttcagttccctctgatgagggagctcataacagttttttccaataagacttccacaagaaacaacaaaagcaggaataataatgagtaatgaatacccatacgcctccatgcgcgacagcttcgacctgtccgcgtacttcgtggtggggccggaggactgcaaaggccgtccgctgaccgacgtggtggatcaggctctgcacggcggcgcaaccttcatccaactgcgcgccaaggaggccgatgcctctgagctgaccgacatggctcgcgacatcgcgcaaatcatcgaggacaatgagaagtccgattccgtggcctttgtgatcgacgaccgtgccgacgtggtgtggcaggcccgccgcaagggcatcaaggtggacggtgtgcacatcggccagaccgacatggagccgcgcgaagcccgcgccctgctcggcgacgaggccatcgtgggcctgtcggctgagaccgaaagcctcgttcggctcatcaacgagctgcccgacggctgcatcgactacattggcgccggtcctctgcacgtctccaccaccaagcccgaggcttccgtgggcggcaacgacggctccggcaagacgctggacgccgcccagatcaacaccatctgcgttgccagcgaattcccggtggtcgtgggcggcggcgtgaccgcagccgatatggccatgctcgccgataccaaggctgctggctggttcgtggtctccgccatcgcgggtgccgagaacccggaagaggccgcgcgcaccatggtcgaaggctggaaggccgtccgcggcgacaagaagcacggctacgctccgcgcgtcgtaacccacacccccgctactgacactcaggctgctcaggaaggggccgcgaagcccggttccgaggccactgagaagaagttcaccaacgccaaggacgccaaggatgcccagaagcttgccaagcagcagcgcgtggacatcgccgcccgtggttccaagcagcgcgacaaggcgcacatccgcaagaccaagtccgtaccgttcacctatcagtatggttcctacgacctggaagtgccgtacaccgaaatcaagctgagcgacacgcccggcgtgggcccgaacccgccgttccgcgactacaacaccgaaggccccaagtgcgacccgaaggaaggcttgaagcccctgcgtctcgactggatccgcgaccgcggcgacatcgaagactacgagggccgccgccgcaaccttgaggacgatggcaagcgcgccatcaagcgcggccgcgccaccaaggaatggcgtggacgcaagcatgagccgatgcgtgccaaggaccacccgatcacccagatgtggtacgcccgccacggcatcatcaccccggagatgcagtacgtggccacccgcgagaactgcgatgtggagctcgtgcgctccgagctggccgccggccgcgcggtgatgccctgcaacatcaaccaccccgaggccgagccgatgattatcggatccgccttcctgaccaagctcaacgccaacatgggcaactcggccgtcacctcctccatcgatgaggaagtggagaagctgacgtgggccaccaagtggggcgccgataccgtgatggacctgtccaccggtaacgacatccataccacccgtgagtggattcttcgcaactcccccgtgccgatcggcaccgtgccgatgtaccaggccctcgaaaaggtcgaggatgatgcctccaagctgagctgggaactgttccgcgacaccgtaatcgaacagtgcgagcaaggtgtggattacatgaccatccacgccggcgtgctgctgcgttacgtgccgctgaccgccaaccgcgtgaccggcatcgtctcccgcggtggctccatcatggccgactggtgcctgcgccaccaccaggagagcttcctgtacacgcacttcgacgagctgtgcgacatcttcgccaagtacgacgtggcgttctctctgggcgatggcctgcgccccggctccctagccgacgcgaacgacgccgcgcagctttccgagctcatgactctgggcgagctgaccgagcgcgcctgggccaaggacgtgcaggtgatgatcgagggcccgggccacgtgccgttcgacaccgtacgcatgaacatcgagctggagaaggccgtgtgccacaacgccccgttctacaccctcggaccgctgaccaccgataccgctccgggttacgatcacatcacctccgctatcggcgccaccgagatcggtcgttacggcaccgctatgctgtgctacgtgaccccgaaggaacacctcggcctgccgaacaaggatgatgtgaagcagggcgtgattgcctacaagatcgcctgccacgccgcagacatcgccaagcaccacccgcacgcgatggatcgcgacaatgcgatttccaaggctcgcttcgagttccgttggctcgaccagttcaatctgtcctacgatccggacaccgccatcgccttccacgacgataccctgcccgccgagccggccaagatggcgcacttctgctcgatgtgcggcccgaagttctgctcgatggccatctcccagaacatccgcaaggcattcggtggcgaggccgctcagcagcaaatcgtgaaggaggctgctgcaggcatcgactccgaggcactggctacggccaaggccaatgtcgataacggcgtggtgtccgccaacgtgctcagccccgaagaaatcctcgccggcatggatgcgatgagcgaaaagtacaccgcccagggcggcaagctctactccaccgcccaggagtaaacctctctggctcccctctctgaggggagccaattattatgcccggtggtgtcttaattcgggacgacgctcgactcgctcgaaggcggtgccgaagtgtgcgccatctggaccgaggccgtcggaagtctccaggaccacgccttcgttgagcgcacggcgcacgatgcccacacgaggcttcaacggccacacatcatgcggcactttgcgatagaaatccgtaccgacgagcaacacgtcgcccacatcgaacacttcctgacgcggaaatgtgagctgtgtggtgtgtccgttaggcattacgccaaaatatgcggtgcgttccggtgatgcgcaccaagacgccgtcacggcgcagtacatcgttatcagccatgcctcctcccgaacatttcatgaatcaatcgcaatcagcaaaccttccccgtctcaccacaggagcggcaaaacatcaaggaaaaccgctccgaaaaacatcatgggccccacttagaatgaacactatggcacaaattgcaacatctacacttcccgctgttctcgcgatctccggctccgactcgtccggcggtgccggcatgcaggccgatctgaagaccatgctggcctgcggcgtgttcggcatgagcgccatcaccgcgctcaccgcacagaacaccaccggcgtgcgttccattcaggacaccaaaccggacattctcgccgaccagatcaacatggtgtttgaggatattccgccggtcgcggtgaaaatcggcatggtgtctgccactgacatcatcgacgtcatcgctgaacgactcaccttccatcacgccacgaacatcgtgctcgacccggttatggtggccacttccggtgccaatctcatcagtgacgatgccattgcggccttgaccggcaagctgttcccgatggccacggtcgtgactccgaacattcccgaggccgaagtgctgaccgatacgctgattcgcgatcaggaggatatggaggccgccgcccaccgcctcgtggagcgttatggctgtgccgcgctggtcaagggtggtcatggcaccgaggatgccaacgatgtgcttgccgagacggatggaaccgtgacctggtttgatggcgcgcgtatcaataatccgaacacgcacggcaccggatgcacgctgagctccgccatcgcctcgtatctggcgcttggcgacacattgcccaaggccatcaagcatgcgaagaagtatctgaccggtgcactgaaggcccagctgaatcttggccacggctccggcccgatggatcatttctggaagtatcgctgagtcctactggctctcctctctgaggggagccaagtaataaaaggagaattatgattattgaccgtaatgccgttactcaggaagtgccgatcgacccggaaaccggcaaaccgtacctcaataccgtggccgccattcaggtgtcggccaatggcgtgggctccgaggtttcgccatacgtggctcaggccgtcgaggtgattcgcgaatccggcctgccgcaggaaaccaacgccctgttcaccaacgtggaaggcgatctggacgacgtgctcaaggtggccggtgaggccgccaagaagctcgccgagcagggctaccgcacttctctggtgctgcacatggatatccgccccggcttcaccggccagctgaccgaaaagcccaagctggtggatgagatcctcgccgacaagcaggcgaagtagcaaagcatcgcttccaccagcaagggcatgctttgttattacacgtttcatggggcggtagctcacccatggggtggtaaaaccctcatggggcggtagtcgaaaacggctctattctacggaaaggcataatccgctaaccgccccatgggccaaataccgccccatgagtgttttaccgccccatgggaatcacggttctgccttctttcgacggggtaagagcgtaagtggggcatatataggagcgtcacaacctctgttatcgttcacgatgtgaccgcaacgcggcgtgccacaaaatcgaacctatagttaagccccatgtagtgagctatctcacaacgattggctcgctacgtagaattcaagacttggatcgcaaacgtcgttcatcccacacaatgggagggcgaacggaacacacagtccaatcaagagttcgctcgccgcaacaccattgagcagttgcacgcgggcaggtttgcaagaagagggctcaaatatgactgctgctgaacagcagatttccggcaatcccgcggctatggaaaacgcacaagcacgtaccaccgtgacggatcaagccaaggttcaggatattatctcgcgcatggatcgcgcacatgaaaccccgatgttccatcgcatcgtgacgctggtcgccgctggcatgctgatggacagcatcgacgtatatattggcagcgccgtcgcctccagcacgttggctacccgctggtccaccgttgcgcaaaattccacctttatgtccgcgggcttcctgggtctgctggtcggttcgctgctggccggcttcgtcggtgacctgaagggccgccgcgtggcttaccaaatcaacctgctgctgtttggcggcttcaccttcctcggcgcattcgccccgaacatggctgtgctgtccctgtgccgtctgggtgccggcctgggcctcggcgctgaaatcgtcaccggcttcgccatggtcaacgagttcgcaccgatgaaccgccgtggccactggtgcgcgattgtctcgctcgtggccaactgcggtgtgccaatcgctatgctgctgtgtgcatggatcatcccccgctggtcctggcgtccgctgttcgtggccatcggcctggtggccgccatcatctggtggctgcgccgcgacatccccgaatccccgcgttggctcgccgtgcgcggccgttacgatgaggccgacgccatcgtcaagcagcttgaggccaacggttccgaaccgatcgacgcagccgccaaggccgacaccagcgacacccgcaacgccggaggccgttcgctcggcatctgcctgcttgtggctgtggttgctgtggccgccacgaacgtgtgctcctacgccttcacttcttgggttccgacgattctggtcaagcgtggtattaacctgtccagctcgctgctcacctccacggtgatgatgctcggtgccccggtcggctgcctgattggctctctgcttatcgaccgtatcggccgcaagcgcacgattgtgccggccttcctgttcactggcgtgttcggtttgatgtatgccttccagacctctaccgtgagcgcaattatcgttggcttcctgctcatgatgtgcctgtacgtgcttatggcttccgtggtggctgtgtacgctccggaactgttcgccaccaaggttcgcttccgttgcgtcggcttcgcgaacgccgtggccaagctgctcaatgtgttgatgccgatggtggtgggctggatgcttacctcgcttggtgccacgtccatctttgtggccatcagcgcgattgctattgcatcgatgctgattgtcggcttctttggcgcggagactgcgcagaagtcggttgggtgatcggtttcctcacagtggaataactgctgataatgtccattcggcgtcttgcgtggtgatatgcagggcgccgttttgttgttctagtaattgttggtaacggttgaggccggtgccggtggataggtctgcgtctccagcggacaatcagcgtctgtgatgtcacatgcaatgccaggagcggcatcaacggtcgaatcatgcggagtcactgcactgtgcgccgcttctcccctgccttcaatcacatcaatgacttgatgcgtgcgatccaatgcgcccatagacatatccgtaaccagcacgtcaggccgcttggtggggctcaggcatcggctgatggccacagcacccaaatcgcaggtctatatcacggcaaaatcgctggacatacgttcgattagcgcgccgaacactttcagcgcatatgggtcattgtccacaatgccgatgcgtatgttgcggttgcgcgcttcttccattacattcaccccttcagtgtgcccgacgccgaactactccgtcctgacacgtcatggtcactatgacaactatcattccacatttcctgcgtgatttacgatggaatcatcatcaatccttgacaaggcggtaaaggaggacggcaatgaaccgtgcacaagcactcagcaagctcaacaggagcgatatgcgcaatgccgccgccgagcgcgggatgcaacgactgttcacatggaaccgcgcgcattggattggcatggttgtactgatagcggtgttgctgctactgcagtggagctcatcaatgtatctcatgcccgacgaggttcttgacagggctgccaaaaacctgttcgtatggttccccggtatggttctgcactggccattggtgttgggaatcaccaacttgatactcggttcgacacgatccggcagtctgtctttcccgttggcgagcgcaatcatcggaccactggcattcggctggaccaatcttcgcttacggccggggttcccataccgttcctgggctcaagggaaagccgcaatataatgaaaacagcgatttcatgcaatgatgcacgagccgatccaagcaaaggggccaaccatgagcgagcaactgatggaacagtaccggttgcgcggacaacgcaaatgccgtaacgcttgtatcgccgccatcgtgacagtagtgcttgtccttgccgtcgccggcggcgtatggtggacggccggcgatggcagcgcattggttcgcaatatgttcaagccgaaggccacgcctgccacgcagccggtagtcaacagcaccgcaaccttcgcctaccgcaccgcaccggaattcctggcgatggaagccggcgaccgaggcaccggcaatgtgaactactctcctgcttcgatgtggatggcgttggccatcgccgcgcagggcgccaatggcacgacccgctcgcaactgaacgaactgctgggctccggttcgctgaccgatagcgactaccaatcgctgctaagttcgatcaacgggcaatattcgggggcgaaatccgagatgagcgccgcgaactcgctgtggattgatgacgactactctcttgccagcgattaccaatccaccgtcaagaagatgttcgaggccgaagtcaccacgttaccgttcgacgatcaggccgccgcaaagatgtccgattggatcgccaagcatacgaatggttcgctcaagccgaagatcacgctgcgtgaccgtgaagtcctgtccatcatcaacaccgtctatgcggatggccgttggaaggatccgttcgaagagcagtccaccggcaacggcaccttccacggcgaagccggagatgctcaggtgccgatgatgcaccggaccttcagccaaatggcttacggacatgatgagtacaacacttggcagcgggtggagattccgttcgacaacggcggcaatctggccatcgtgctgccggccgaagggcatttcgacgagttggccggcgatgccgagaagctcagttgggcgttcggtacatgctcgacggcttcccttggcgagggcgcaatgggttgcgccgcggacagtatgcccggatggggcgtctccgtcaactcggtcatggtgaacgtcacgctaccgcgattcaccatcgacagcatgttcgactcggaagccaccatcaaggcattcgaaaaactgggggtgaccgatgcgttcagtgcaggcgacgccgacttcaccaagatgatcgacaccggttcgcacggcgagaacctgtatatcggctcgattctgcaaggcacgcgcatcgaggtgaacgaagccggcgccaaggccatgtccttcaccaaggtcggcgcagactccgttagcgcgccggtggacaacgtcgagttcacggtggatcgcccatttctgtattcgtacgtcaccccggacggcataccattattcatcggtgcggtgcgcaacctcggcggagtcggtggagaaaactgatactttcctggcagtccgtcaattagggtgtatcgtttgacgcatggttacgatgaaggaaatcgcgaacaaggcgggggtttccgtctctacggtatcgctggtgctcaacggacgcgacgaggggcgcgtaaagtccaaaattgcggacaatgtgcgcgccatcgccaccaagctcggctaccagtcgaatccgctggccagttcgctgcgtacaggcaggacgcacatcctcggtttcatcagtgaggaggtggccaccaccccgtacgccggcggtatgattctgggcgcgcagaccgctgcaagccagttcggctatatgctcatcaccgtgagcgccgacggcgagaacagcgagagcgaggaaatcgccgcactcaagcgatacggcaccgacggctttctgtacgccaagatgtcgaaccgcatcacccatgtgccttcctcgctggccaagacgccactggtgttggtggatgccaccgactcgcttggcaaaatcccgagcgtggaaccggacgagttccaaatcggctacgacgccaccaccagattggttaaggccggatgcgcacgtatcgcctatgtgggttgcttggagccgctgattgcgcaggacgatcgtttggaaggctatcaggcggcgctcagggacgccggcctcgactatgacgatcatctggtcgtcaatgtgctcaacaacgggccggcactgaccgcagtcagcgatttgttcgatgccgagcatccggacggattcttctgcttcaacgatgcccgcgcctggtatgtgtacgaatgcgccgcacgccgaggactcacggtcggcaaggacatctccgtggtcggcgtggacaaccatcgcgtgttcgccgaaacgctggaaccgatgctcaccactgtggaactgccgcatttcgagatgggctactgggccgtggccaagctggtgtcgattatcgaaggacgctcgatggacgacgtctcatggccagcgaccaccgctcccctgccgccgatcgacgcgccgattccggcgaagatccactgcacgctgatcgaaaaggcctcggtgaagtaaccgagtcccacacgatttctcaaggcctccgttcagcacggaggccttttgcgtgtcgaacggatacgacacgccgatttacgccaatcgattgacgtaaatcgattgacgtcgcataataattactacgcaacaacttctacaaaggcacggccgcccgagcagaagcgttacataaccaataaccaaccaagtagtaatcaaaggatgattatggcaagtgcaaccaaatctgcatggaagaatccttcctatctgcagagctctttcggcatcttcatgttcttctgctcctggggcatctggtggtccttcttccagcgctggctcatctcaggcgttggattgaccaatgctgaagtcggcaccatctactccatcaactcgctggccaccctggtcatcatgtttgtgtacggcgtgattcaggatcagctcggcatcaagcgcaagctcgtcatcgtagtctcggtaatcgccgcctgcgttggcccattcgtccaattcgtttacgccccgatgatcctcgccggtggcaccacccgctggatcggcgcactcatcggctccatcgttctgtctgccggcttcatgtccggctgctccctgttcgaggccgtcaccgaacgctactcccgtaaattcggtttcgaatatggccagtcccgtgcttggggctccttcggttacgccatcgtggcgctgtgcgccggcttcctgttcaacatcaacccgctgatcaacttctgggtcggctccgcattcggccttggcatgctcctcgtgtacgccttctgggtcccggccgagcagaaggaagagctcaagaaggaaaccgacccgaacgcagcccccaccaacccgtccctcaaggaaatggtcgccgttctcaagatgccgaccctgtgggtgctcatcgtcttcatgctgctgaccaacaccttctacaccgtgttcgatcagcagatgttcccgacctactacgccaacctcttccccactgaagaaatcggcaacgccacctacggcaccctgaacggtttccaggtcttccttgagtccgcaatgatgggcgtggtcccgatcatcatgaagaagatcggcgtgcgcaacgctctgctgctcggcgctaccgtgatgttcctgcgcatcggcttgtgcggcgtgttccacgacccgatcaccgtctccatcgtcaagctgttccactccatcgaagtgccgctgttctgcctgccggcattccgctacttcactctgcacttcgacaccaagctctctgccacgctgtacatggtgggcttccagatcgcttcccaagtgggtcaggtcatcttctcgacccctctgggtgccttccacgacaagatggctcagattctgccgaacaacgacatgggatcccgcgtgaccttctgggtcatctccggcatcgtgctgtgcgcgctgatctacggcttcttcgtcatcaagcgcgatgatcaggaagtcggcggcgacccgttctacaccgacaagcagctgcgccagatggaagcggccaaagcctgaaaggacagccatgactgacttcactcccgaaacccctgttctcacccccatccgcgaccacgctgctgaactggcaaaagccgaagccggcgtggctgagatggccgccaagcgcaacaaccgctggtacccgaagtatcacatcgcctccaacggtggctggatcaacgacccgaacggcctgtgcttctacaagggcctctggcacgtgttctaccagctgcacccctacggcacccagtggggtccgatgcactggggccacgtctcctccaccgacatgctcagctggaagcgcgagcccatcatgttcgcaccgtctctagagcaggagaaggacggcgtgttctccggttccgccgtcatcgacgacaacggcgaccttcgcttctactacaccggccaccgttgggccaacggccacgacaacaccggcggcgactggcaggtgcagatgaccgcgctgccggacaatgacgagctcacctccgccaccaagcagggcatgatcatcgactgcccgaccgacaaggtcgaccaccactaccgcgacccgaaggtctggaagaccggcgacacctggtacatgaccttcggtgtctcctctgcggacaagcgcggccagatgtggctgttctcctccaaggacatggtccgctgggaatacgagcgcgtgctcttccagcacccggatccggatgtgttcatgctcgaatgccccgacttcttccccatcaaagacaaggacggcaacgagaagtgggtcattggcttctccgccatggggtccaagcccagcggcttcatgaaccgcaacgtcagcaacgccggctacatgatcggcacgtgggagccgggcggcgaattcaagccggaaaccgagttccgcctgtgggattgcggccacaactactacgccccgcagtccttcaatgtggacggccgtcagatcgtctatggctggatgagcccgttcgtgcagccgattcccatggaggatgacggctggtgtggccagctcaccctgccgcgcgagatcacccttggcgatgacggcgacgtggtcaccgcgccggtcgccgaaatggaaggcctgcgcgaggataccctcgaccatggttcggtcacactcgacatggatggcgagcagatcatcgccgacgacgccgaggccgtggaaatcgaaatgaccatcgacttggctgcctccactgccgagcgtgcgggtctgaagattcacgccactgaggacggtgcctacacctacgtggcttatgacggccagatcggccgcgtggtggtggatcgtcaggccatggccaacggcgatcgcggctaccgcgccgccccactgaccgacgccgaactggcctccggcaagctggacctgcgcgtgttcgtggatcgcggctccgtggaggtctacgtcaacggtggccaccaagtgctgagctcctactcctacgcctccgaaggcccgcgcgccatcaagctcgtcgccgagtccggtagtctcaaggtggattccctgaagctccaccacatgaagtccatcggactggagtagctctttcacctccctctgacgagggaggtttttttgtgcgccctgtcgttcgccttcgcctatactgatggacggcatataacacaatccatcacacgaccggcaggcgcgcaggctcctcaccttactgttccacgccccggccgcaagcgccaccagcaaaccggactggcgcggaaagcaaggtgacatcccatgtccatcgccaagcgcctcaagcgccgcatgcccaccgtcatcgccgtcatcgtattgctggcagtctgggaaacgtgggtggatctaggacatgtctcccccacgatgatctccgcgccaagcgagattttcgccgccaccatcgaaacatggaacacgctcggcccggccgcggcaatcaccggctatgagggcgtggttggattcctgtttgccgtgttcttcggcattatgatcggcattgcactgtactgctcgcacacgttcaacgcggcgttctatccgctgcttgccgccgcacaaaccatgccgctgatttccatcgccccgttgttcctgatttggttcggttttgagatttccggcaaaatcgtaatcgtggcggtattcggcctcttccccatcgccgtgcagactgtgcgcggactagaagcagtgccccagttctattccgacgtcgcattgacctgcggcgcgaccccggtctggacgctctggcacgtgaagctgcgcgttgccgcacgtcagatctatggcggtatccgagtatctgccgcatacatcttcgccacggcatccaccgctgaataccttggcgcacgcaagggccttggcatctggctgcaggctgcctacaattcattccgcacgccgctgatcttctccgccaccatcgtcattatcctgatgacatgcgtactgatgctggcggtaaacgccagcgagcgcatcctgctcggcccgcccggcgacgacgaagaccccgacgcggaccagtagttctttttttaccgtcaaaggcacgagccggcggccaggaccgactgaacgaagcggcttctcatgaggtctccaaccctgtctctataatggaacagctttaccagcgtgtggcaaaccggctttcccgagctttcatagggaatgtcgggggcgctggtcgaacggaaatcaaggccctccatatcgttttctgccgacttccgttcgaagcaatcccagagaacgatagagagacaacgaattagggaaccatcattatgaagaaaagccttgtatccaaggccgctgccctcgtgggcgcccttgccatgactttcggtttcgccgcatgtggccagaccaacaccgccggctcctccaactccaacacctccgacctcaagaaggtcactttcatgctttcctgggcacccgataccaaccacatcggcgtgtacgtggccaagaacaagggctacttcaaggacgccggccttgacgtggatatcgtggccgtggcccaggccggtgccgaacaggccgtgaacaacggtgtggccgacttcgccctgtccaacctgaccaacgtgggcgtctacacgctgaagggcgctcacatcaagcaggtgctgcaggtgcagcagaagccgagcgccatttggtgcgcactggcgtccaacaccgccatcaagtcccctaaggatttggatggcaagaccttcgccaccttcggctccaacgagtccgatgccgtggtgcgccgcatgatccaaaccgatggcggcaagggcgaattcgacaaggtgaccgtcggcacctccaccttccagaccatggaatccggcaaggccgatttcggcggcttctacgccacgtgggaaggcgtgcaagccgacatgtacggcccgaagctcaactgcttcaccgagcctgactatggcgtgcccggcaacgccgacaccatcggcatcatcaccaatgacaagaccatcaagaacaatcccgacctggtcaagaagttcactcaggccactcaaaagggttacgagtacgcgtacgccaacccggatgacgccgcgcagattctcgtggacgaagcccctgacgccaacctcaagcccgaattcgtcaagaagagcatgcaggttatcgtcgacggccagtactggggcgatccggccaagatcaaggacggctctttcgtgctcggcaccaacgacttcaagggcgctcaggaatacttcgacttcctggctgaagaagacgcatacaccgacagtcatgacaagataattcatgaggccccgcaggccaaggaccttgccaccgacgaattcatcggcaagtaatttccgatattccgagtttgaatctacgcaaaaatgcgtccttcccatgaggaaaggacgcatttttgcgtatcggccgataaggttattcatagcggattacgctaacaaggagacgattctatggtccaatgtcctgaccgcattattgccagcatagatacgggtgttgatgatgcgttggcgttggcgtatttgttggggtcgacggatgagtgcgagttgggtggcgtgattgccagttatggcaatgtggatgcgaacacggcttatgccaatacttgcgcggtgcttgatttgtttggtcgggcggatattccagtgtttttagggtctgagcatccttcttgggctgatgcgtttattcctgatgcagggtgtgcccagttccacggggatgatggactggggaatactcggctggcagggtccggggctctggctgatggagcttgtgtgcctggtgatgatatgtctggtgatgatatgtctggtgatgatatgtctggtgatgatatgtctggtgatgatatgtctgtggatgtgcccgatgaggttgtttctgttggcgggtatttggcgggggatgttcatgctcatccggcgttgggtgcttgttctcgtgtgaaccgctctcagtcggtggaccatccccagtcggctatgccgacagctctcgccagcgggggcaaaaggaggtgctccgttgatgctgcggatgggattgagtatctgattgagcaggttcgcgagtttggccgagacgttaccgtgctggctaccgggccgttgacggatgtggatgcggctattactcgagcaccggatattgcatcgaaactcaggctggtgatgatgggcggtacgcttacccaacccggtaattgttgggatgcggtagctgagacgaatatcatccaagaccctgaggccgcgaatcgtgtatttcattccggcgcagacatcacaatggtgggacttgatgtgactcaccagtgtttgctaccgcaatcggcggccgaccggtggcgtgcgacggggaccaagcgcgggcggttcttggctgatctcgcggacttttccatcaaggcaaatttggaagccgaccccgcactgttctctggcggcatgccgttgcatgatccgttggcggcggcggttgcacttgattcttcactggtcgattgttttgatcttgcgttgcgcgcggagaccaataccggtgatttcaatggagtacgaggccggaccaccggagacccggttgggctggtgaatcattccatgccgcatgtgcatgtggcacttggtgtggattcgggacgttttttggatgagtttgtagagaggatggctgaggtgtgccggtaactcccctcagtccgctacacgggcagctcgaccgcaattacggacaagctgccgctcgcattcttctggctcgactctcgtctcgccttcgcctacaaacagtccaccgggcgtttgctttacggctcagcccgtcagagggggcctaacaaggactatttcacacccccagcaatcaaggaccggcttcgccggactcatcattacctggtcatgtcctatcggcctcggccaggcggcgtgaacgaacagtccactggactgttctttatttcacgccgccaaatcggcgatcgcggtggatgtaatggtcgatggagcgccatagcacgtcacggccgcagtccgggaagagttcgggcacgaagtcgagctcggcgtaggcggcctcccacggcaggaagttggaggtgcgctgttcgccggaagtacggatcaccaagtcgcaatcgggaatgtccggattgtacagatggtcggcaatcatcttctcagtcacacggtcgccggaaatcttgccatcgcgcacttcgcgagcgatggcggcgcaggcgtcggcgatttcagcacggccaccatagttgatgcagaacaccacatcgatgaccttgttgttcttggtgcgctcctcggcggcttcaagctcgtcgatcaccgacttccacagcttggggcgacggccggaccagcgcacgcgcacaccccactcgtccatctgttccacacgacggtggatgatttcacgcgagaaacccatgaggaagcgcacttcctgtggcgagcgcttccagttttcagtggagaacgtgtacaggctcaaataccgtacaccggcttcgatggcaccggcgatagtgtcgaacaccaccggttcggcggcctgatggccattggtgcggaccatgccgcgctgcttggcccaacgaccattaccgtccataatcacaccgatatggcggggtaccttgttcttggggaagtcgggaatacgagcggggtcgctgaacggagctgcgggaatgtccaacgacgtgtaatcaacgttctcaaaagccatactcatgaatctatcaagcgcagcgaacgaatcgggcgttcgaggtaatactccccccaatcttcaaccaactcctgcacaacccgctccacaggcgcggcatcaagcaccgaccaatcgccacgaatcagtgcatcgaactggtttaacacgaacggtgcgatacggcgcgcatcggtagtgtggtcggcttcgcacatcacaccgccggacgcgatggacaggtacgccggctccgccttgccgcataccacgcaagtgcccaatcgtggcgtccaaccggccaaggccaaggcgcgcatcacataggagtcgcctatggcttgcggggcgtgggattgtttggcgagcgcgttcaacgcgccgatgagcagccgatattggttcggcagctgctcatgttcggtgctggcgattttatcgatagtctcaacgatgacgttggcggcctcatacgccgcataatccgccgcgatcggagcaccataagcggcgaccgcttcagcttgggagaccacgtcaagcgagcggccttcagcgataagcacatcgactcgcatgaacggctcgagcctggcaccaaagcgtgatttggtgcgacgtacgcctttggcgaccgcccgaatcttgccatgcccacgcgtcaggatggtgatgatacgatcagcctcgcccagtttggaggtgcgcaacaccacaccttcgtctcggtacagcgacatctcatctcctttcccgcgacgcctggcagactctactcaatgaagtagtcagtaaataaacagaccccagaaggcgaacaccaacagtatgtacagcatggtgaaggccaccagccagaacaggattcggcccagacgggtggaggccagtaccgggtcagcaccggtgacgatgtctcgaacggattcgcgacgagggggtatctgaatcaggccgcggacggaagcgacttctatcagatgcataaagacgcgggaccaagcccatagcaccagcacggacaccacttggatgaccggccagctccaatacatgacacccggcgtctcggtaggtgcgccaccccatgcaagtttgaccacgcccatgatcacctgcccgagtccggcgaagaagatgagcaatgtggcaagagtggtgagggtcaaagtcagcagcgcattgccgaaaccatgtgcgaaaccgagtaccacaggccgttccggtatcagcatgcccgcacgtttggcctcgcgcttctctcgccgccatcgggcatccgccgcgattttgcgacccagcgccaccagtgccagcacgatggatgcgagcagcagcagtaccaccgtgacgtgcagaatcacaccatatatggtgccgacgcgtcttgccttcaaagcgcccggcagaccgattgattggtacagattggcgccggccaccttttcgctggtctgcgtgagtccggcggaagtgccgacggcccagtcgatgagatcgtccacataggcgtccgcaaacggggtgcccgcttcggactcatctcccaaacgcagcacatggttggcgaccgggtagctgcgcacggtcacattccagttatcggctttgtgggcgttgtagagaatcgcacgcacgccgtcgacctgcgctgtcatcacgtctttcgaaccgtaagccacataggtgggtacggcgtaggcggcgggtttgagtgtggcgaggtcgaaattgttcagtccgaacaggcctgtgtccgcgctgaatacacgttggacgatggattgatagccttcgttcgcgccaacaagggtgaagtcttgggtgacgaaaaatcccagcgattggcgtgggctgaacaccatcgggctcaggagaatctggaaggcgacgtccggatcgtcctcgagcagatacgaggagatccatgtcgattcggaggtggcatagatgccgaccttggcctcgtctacatcgctttggtctcgcaggtattcgatgacctgatcataagccttggctgaggccggataatcgcggttgatgtcggtggtgttccagacgggtttgtcgagcactgcggtcacaaagccggccgaagccataccggaggccacgtcgccaaaggagttgtcacaggtgccgtatccggcaccgtgcatgaacaccacgccggggcgcttgcctgatgcgttctgaggttcccgaatcaataccttgatggcttggacgccgtccgcattggccttgccccgagcaccggactccttggtcagattgccgtcgccggtcatgttcagcgtgatgtatcgctcggtgacctcatacgtgccttttgccggcagcgtttctccggacgggttatcgaaggtgacttcggtatcgtcggtgaacgtggccatcgactggccggtgggttcgatgttccaaggcaccgtggtcagattggaaatggagaccagcacgccaatcaggataatgaagatgggcaggctgaccatcagccggtgggtgctggtccacggcttggatcgaacagtcaggcgatgctcttcttcttgcggcacgtgcgctattgtaatctgaccgcgatatttatgccgagggcctattcggccgaatcagtgaccggggtgctggattgggaccacgaccgggccggtggaattgacggggacttgaccgtcggcctccatttgggcggcgatatcgttcgctatggtgagcagcgtgtcgacgatctggtcttcgggcacggtcttgatgaccttgcccttgatgaagatctggcccttgccattgccggaggccacgccgaggtcggcttcgcgtgcctcgcccggaccgttgacgatgcagcccatgacggccactcggatcggcgcggtcacgtccttcaggccttcggtgacggcggaggcgagctggatcacatccacttgggcgcggccgcagctcggacaggagatgatgtcgaacttgcgggggcgcaatcccatgtattccaagagtttgcaacccaccttgacctcttcggccggcggcgcggagagagacacgcgaatcgtgtcgccaatgccctcggccaagagcgcaccgaacgccaggcaggatttgatggtgccttgccaagcggggccggcctcggtgacgccgaggtgcagcggccaatcgcccttggaagcgagcagtcggtacgtttcgaccatggtgatgacgtcatggtgtttgacggagatcttgaaatcgtggaagccgacgtcctcgaacatgtgcgcttccttcaaggcagaggccaccaatgcttccggagtcgggccaccgtatttggcgtagagttccttgtccagcgagccggcgttcacaccgatacgcagcgagatgcccgcgtcggtggcggccttgcagatgtccgggccgacttcgtcgaacttacggatgttgccggggttcacgcgcacggccgcgcagccggcgtcgatggcctggaacacgtatttggactggaagtggatatcggcgatgaccggaatcggcgatttgcggcagatttccggcagtgcgtcggcatcgtcctgactcggcacggccacgcgcacgatgtcgcagccggcggcggtcagttcggcgatctgctgcaacgtggcaggtacgttggccgtgagcgtgttggtcatcgactgcacggagatgggcgcgcccccgcccaccggcaccgggcccaccatgatgcggcgggacttgcggcgcgggtgcaagggcgattcgctggtcaggtcgaccggatcaccggttttgcggaacggcttttcgatgggattttccgtattcaaggtattcatcattgcttgtttatcaggtcgtcggcgcgtcggcgggcttcaagctcaagctggttcatttcctccacgtccgtgaacagcgggttaccacgaagctcggcgtccatctggtccagcacggctttgaccgtgtccacgatgccgaggtatggcagacgatgctcgaggaaggcatgcacggcctgttcattggcagcattgagcaccgccgtatgcttctcggaggcggccaggcagtggcgggccagttgcacggcagggaacgcctcatcgtccaacggttcaaaggtccaagttgcggcttgcgtccagtcgcacgcggcggccacattggtcatgcggtccggcgcggacagacccagcgcgatgggcagacgcatgtctggcggcgaagcttggcaaatcgtggcgccatccacaaattcgaccatggaatggacgatggactgcgggtgcacggtcacatcgatgcgttcaggcggcacgttgaacaagcgggacgcctcgatgacttcgaggcccttgttcatcagtgtggaggagttgatggtgacaaccggccccatgttccacgtcggatgatgcagcgcctgctcgggagtgatgttctccatgtcggcacgtttccagccgcggaacggtccgccggaggcggtgaccacaagcttggcgacttcggcgtgggttccggagcgcagggattgccagatggcggaatgctcggaatcgaccgggttgatttggttctcgcgcacttgcgcgctgaacagcagatgcccgcccgcaactacggactccttgttggccaatgccagctgggaaccggccttgagcgccgcgatcgacggttcgaggccgatggagccggtgatgccgttcaatacgacattcgcaccggagccggccatggcgatgaccgaatccggaccgccggtcacgcggacaccttgtgcgccggcctgtgcgagagctgcttgcagcgctggaaccttggtctcatcaaacaccgcgacttcggacacatggaactgtgcggcctgttgcgccagcagctcgatatgtgctccgcccgccgccagaccggtgacggtaaatcgttcaggatgacgcgagatgacgtcaagtccttgggtgccgatggatccggtggatccgagaatgatgacagtggagttggaggctatgctcactgttccttcttcgtatcgtcattgttcagtgtggggaacgacaggtcggggatatccgaatcgaagttaccgccaagcgggaacagcagcgggaacgaatcgctggaatcgtgcttatcctgtgacggctgagctgcttccgtgtcatgggaggcggcaacgtattcagatgattccgcagccggacgggagatcgtgctgtctgcaggctgactatcggatacgcgaaccggaatagagttcgtgttacgatccggcttgctggtgggagcaaaggagaccggcatggcagcggacgcagcctcgtcagcagtgctattcacaggctgtactgccggggcggagggtgccggggatgaaaccgaacccggtacctcattcaatttcagcgcattcggtgcatcaaggctgggcatcttaggagcgaaggacggtgcatccactgccggaagttcctgagaaaccgcagccatgtgggcgagagcggccaaagaggaatcgttctgcaccatatccacgggctgttccgcgaacaccgacggggtcgatgacggagctgcgggttcgtgagctgcctgtgccggagcaaacgaggggacgctgccagcggtcacaccggaaaccggcgcggacggggcactgacgggaggctcagccgcagcaactgcggtaggagccacggaaggcgtctcggagacgggcttcgccgcagactcgttggacgcatgcaccgggtatgctgcgggagcaaaggaaaccggctgttccgcattggtgctattggtgcttgtggaagcatcgaacgatgcaggagccggcgcataggagatcggcgccgccgcggccggcgttgcgggagcaaccggagccggagccgtgaacaagctctgctcggcctgatgcagggcatcgaatgattcgtcatgagcaacggcagccggagcaaaacgttcgtcagttgccgggcgctgcgttccggaagcgaacaacggtgagacgccgttcgcttgaacggtcacgttcgtggcggtctgggcaggaaccgcaggctcgccggacacgaaatcggccacacgggcataggattccaagcgactcagcaactgcacgcaggcgttcaggaagtaatcgacctgtcgctcgtcataacctttcttgcccttgcgctgggtgaagatcacattgttgaccgtattcgcattgagatcggccaaagaccgtacatcgtcttcggtaacgccgtcaacgcccaatgcggccgccgccttgtccacaatctggtcgaccagacgatccacctgcttcttatcgtacgaaggctgcttgggcgctccggacttgaagcgttcgcgctcgttacgctccgcatggttctggacttcgtgatacagcttctcggtcttcgccttccacgtcacacgcccatgctgtgcgatctcccatgtggtctgcttatcgaccacggcacgttccagacgtccaagcgcggcgtcaacctgtgcgatcacatagccgttcttgcgcaaatcaaaggacacgttctgaatgtcatgctgggtgagattcatgccctcgctgtcatacaaagcatgggcgcgctccaggaaagcgtccacctgagcggggtcatacccccacttgcgcttgcccgcacgtgcgatgcccgacttgccgtccccttcacgaagttcctgcgccatcggctattcgacctcctgctggatataaacactctgccacaactttacgtgactattgagacgcatctgaccaagaagaccgaaattcacgattttgtagcagtactgccggtttccttctgcacgcatctcattgagatttcagaacccttgccgaagactgtcagggaatatcgtcacagcctatatccgtggaatgaggggattccatgaagcgatgaaaaatgaaagtgggcaatgagggactcgaacccccgacatccaccgtgtaaaggtggcgctctaaccaactgagctaattgcccgcaaatgacaacaatagcgtatggccagcactgcgcgacacgtggtgtcgcatacgcgtgccgtagcgctcaatcgcaatgacattcagtcacgcccagcagcactacgcagcacacgacgccggtcaacacgcttaaagtcaagcgtattgattgaggcttatcagcggcccttgccgaatgcgcgcaggcggatgccgttccagtccgagctgacggtcagcggggtggcggcgttcataccggcggtctgtgcagcggactgcacggtggacgagctggcggcacccgggcggccgggcttgggagtcagtatccacagcgggccgtcattgcccagtaccgcgtaggcgtcaacgatcgtatcggacaattcgtcctcatcatcgccgtcgcgccaccatacgatgacgccgtccacagcggagtcgtagtcctcgtccacgagatcctcgcccgtgagctcttcaatctgggcacgaatggaatcgtccacgtcgtcgtcccagagccactcctggacgatatcgccgggctcgaaaccaaattcttcagcgttctgtgatgccgtttgattcacaggggacacattagcaagtcttcgcgaacaaatgcgttaacgcggccgaaaatcgccgcattgtgggcagacccatgcgagtcgtctcaccagaaacaacgactggccgcgcgtgtcatgcctcgcaatgaggcaaatcgtcggcctgccccttgccgatggccaccaacgcctgatacgcctcgttcagcgtggcgaccttgacgtcgcgcagaccatccggcacgcggcctgccacatccaaacaattcgacgcgggggccaggaaccatgtggcgccatcgcgcttggcgccaagcatcttcagctctatgccgccgattctgccgactttgccgtccttgtctatggtgccggtgccggcgatggtcttgccgccgctctcgttggcgggggtgagtttgtcgatgagaccgagcgtgtacatcatgcctgcggacggcccgccgatgctgtccacgtgcatcgtcaccttggcgtgttgcaatgcactggcgtcaatgtccagttcgtccgcatgggctttggcatacgccagaccgacggcactggccgaatcctgggaaccggccatgtcttgttcgactttcttctgatactggtccgcactctggcccaccggtaccgtggcctcacgcggcatgacctccacctgcggattgccccaaccccagacggcctgcgcgttgatgatcgggtacccgggcacgccggacgcgttcaccgtggtcagcagcagcttgccggaatccttatacgtcgtcacgccggtaccagtgatgtcgataaccgcaccatcctcaactttgcccagcacatcctgggtgggtccgggcatctcgatgacgtacgggctgggcagcagcagaatcaccacaccaagcaacacggcgaatgcaccgacgaaatggcgtttcgaacgagcggccgcataggcccgagcacggctgattccacgagataggcgcgaatcatgcttcacttcgaacgatggcatgtgctcatctcccgcttccgaatccgcagtcgggctctcctgctcctggacgaggtctggttcctgattcctgtggcgtgcaaacataccctacagtgtaagcggagggccgaaatcggccgaaaacgaacataaaccgaaaataatgctcggccacaagcgaacaggcccgggcagaccctacacttggggtaacacaccgcggcaaagaaggatacgcatggacgacaacgcgattcacgagtggctgatcaaatgcttcggccccattcagggtgagatggcctggcagcagatcagccagttgcctgaggagatccgtgaacagctgatgagtcaggaccccagccgactgcccaatccatctgaagtccagcagatgatggccgcgttcagcgccggcggactcaacacgatgggtgatatgcagcgcactgtcgaggaagggccgatcaacgtcaagctcgccaagtcgattgccttgcagcaggccaacgcctccggttctgcatccagcgtgtccgccgtggatggcgaggcggctcgccgcgcgatgagtgaggcgaacctgtggctggataccgcctgcgagttcaatcccgcacccggcgatccggatgtgctgacccgcgccggctgggtggaaggcaccatcgaccagtgggcgaagttcgcagctcctgtggccgagtcgatgaacgacgctttggcttcggtgatttcggagcgtcttggcggcgcgttcggcgatggcgagattgccggcatgttcgccggaccggtgccgattccgattcccgacggtatgaaagacccagcccaactgatgaagctgctgggcaacacgtcctttgccatgcagttggggcatgcggccggcaatctgagccatgaagtgcatggcagcttcgatcagggcatcgcgttgctgaagaacccggctggtggactgattgcccagaacgccaccgaatacgcgaagatgctgaacggtgaggcttctgcggccgaggccgacacggccggcacttcaaccgactcggtcaatccgttctccacatccaccgacgcttctgccaatcccattggcttcacttcggccggcaacagcgatactccggcaactgacggtaccgcccaagtctccggctctgatgcttccgccgataccgccgacgccgccgcgttcgaggctgcgctctccggattcgagaccaccgagaaaatccccgaatctgaagtgctttccttcctggccctgcaggaaatggctcacgcccgcctgtatgcctcggtaccgtggctgatgccgcgtttcgaggcgctcatcggcaagtacgcacgcggcatctccattgatctggatgcgatggaggaacagctgcgtgacgccacgtcaatggatccggagtcgatttccggcgcggtgaatctcaccaaggtcggcatccccgacactcccgaacagcgcgaggcgctggcttcgctggaatcgctgctggcgatggtcgagggctgggtggattgcgtggtgtggcgcgccggtatggcccatctgcctcatatcgaacagttgcgtgagatgatgcgccgcgagcgcgcgatgggtggccccgccgagcgtacgttcgaaagtctgctcggtttgcagctgcgtcccaagcgcatgcgcgaggccaccgggatatgggagatgatcaccgccgccgaaggccctgaaggccgtgacgccaagtggtcgcatcccgatctgctgccttcgctgcctggcgacaagcccgcagatggcgcgtctccgtcatccgacgccccttcaggttcttcttccgatgccaacggttccgcttctcaccctgccgcagatggcaagaccggcgatatcgattgggatgccgaactgtccaagctgctcggcgaagacggcgaagacggtgaaaacggcaactcggaggatacgcaggcatagtcaaccggccttcagccaattcccgctcctgaacgttcaggagcattcagtatgcgttacagacgcccgtcacaaaaatcgtgatgggcgtctgtgctgcgctccataaccatccttggtccgcgcatacgacaaatgcagcgaatcctcagctcgggtgatgcccacatacataagccggcgttcctcttccagcgtattccccgtttccggcgaaccgtacggcaagagcccttccgaacagccgatcagaaacacgtgcttgaattccagacccttggatgcgtggatcgtggaaatcgtaaccccgggatcgtcgtttgcggcaagtccggtggcgtccaaacccatcgcctccaatagtgcgcgtttggacgcggcatcgtcggcgagcgcggatgattgccatcccgaatccttgcggacgcgatatttcagtctcgcagcgcgcaaggcggcaccgaatacaggctgttgggcgttgatgcgggtgaggatcgcgcaatcggacggcttggccccgttggcaaccaaccgggctatgcgtgccgccacgccctgtgcctcttccatatcgctctcataagcggttcgggtaacgcgcgggccggattcacgggcggaaaccagtttcaggtaatcctcacggttcggcgcggccgcaagcacccggttggcgaggttcacgacttccggcgtcgaacgatagtcggtgttgagattgacatcggcggcaagcggcccgaattcatcggcgaaacgcagcagatcccagctggaggcaccggcaaacgagtagatggtctgggccggatcgcccacgacgcatacgttgcggttcattgcgctcttgccgtcaggtcctcccccgcccagccacagggtcagcagcctgtgttgcaggggcgagacgtcctgatactcgtcgacggtgagccagccgatggtggaacgaatttgggcggcggcttcgggaaaaccatccatgatatggcatacgagcaacagaatatcgtcaaaatcgatttcgccacgcgaggtcttttcctgctcgtaggcgctgtagacgtcggcgaaccgagcggtgtcgagtccggcgggcggctgcctatgggcgatggcacatgcccgggcataatcttccaccgccaccaacgagattttggcccaattgatttcggcgagcacatcgcgaacggtcagcggatcggcatcggtacgtgcggtggcgcggatgatcgcgcgggagacgacgtcacgctgatcttcgatcacatgcggaaatggagcctcgcatatgtctgcccagacgctgttgagctgatgcaatgccgctgagtggaaggtcgcggccgtgactccggcagttcccgcacccgaaccggaacgtccagtacctccccctacgccgagctggcccaatcgtgcgcgcatttccgccgccgcttttaccgaaaaggtgacggcaagcacccgctccggcttccatgccccggtggcgcaggcataggcgattcgccgcgtgaccgtgcgtgttttaccggcacctgcgccggcgataatgcgcaccggcccttgcaacgtagtcgcggcggtacgctgccgctcatcgagcccctcaagaatcccctgcgcctgttccatgcgtccattgtggcacgattcgcgctcacggcacgactcatgcctatggctgaatcgggctcacgacaaaacatcgccagaatcatgcgttttgcgtgtcattctgcggtgcgaatcgccacggatgtattagtgtggaagggtgatgaaacgtagcgattatatgttggcggcactcgcctcagccgtcctgccgaatctgggggtggccggcgtacgcgagaacgtgcaggccagcgcaaccgacgaggccaaaggcatcgatcagaccgtgattcaagatgcctcaggcaagttgtacgacgtatacgccactgacaccaaggaagggcgtacgcgtctgattcgccgtgtgaaagcggcgcagacactggcagccgcgcgcgagcctggtggcctcggcttcgatatggaccgtgtggtcgcgttcgccccgggagacgtttcccgacccggccagacggccaccgcacaggccgtggggcagcagactcaggcggagtccacaccgctgaccccgcgcaagcccggtcccacaggcgagacgaccgtgatgattgccgtccaccgtgatggccaggcgcggcctctcgacctgttgacattggatgactgcgcggccgtcggcaccgccatcggagccattcatcgcctgccttcgacttttctggccaatgccaaatatccggtagttaccaccggtcagattcgttcgcagctgaccgcctggattcgccgcttacgctccgccggccatgttccccaagaaatcaccgacagctgggcgcgcatcatggacaccgagggattgtggtcgttctccacctgcacggttcacggcggattttccgacggcgacttcctgttctccggttccaccatcaccacggtgaccaactggcaggatatgcaggtcaacgatccggcacgagaccttgcctggattttcggcaagctcgacgaatcccatcgcaacgccgtgctttccgcatacggccgcatgatgggctctcgacttgacgatctcatcatgctcagggccaacctgtggctgcagatggaacaggtgggcgaattcattcaggcgttgaaccgtgcggacaacgatcacatcatgcagttcaaggcacaggtcgaacgactcgcacaccagttgggcgtgatcaagcacactccggcaccggccccagccgcagggtcgaccgccgcctcgtcaacgaagcccggtttgccttccacaatcaccgtcggcacattgttgcaggacgaccgtcatcaggcacccgcacaaccgcagcagtccgacaccggtaccgcggcggccgaggtctcggacgacacgcccgatcccgatcgcaccggttccgctgatatcgtggccgctggcgacgtggatcttaccccggaagtcgaacccgatgctgaccggaccgccaatcacccgcaagcgaatgtctccggcatcgcaaccggtacgggatcgaccaaaccgcagccctcacatggcgcttcccattcttcggtgacgatcacgctgaaggagctcctcagtatgaacgggcatagcggcacgacgtcaaccgacgcttcccctgcgtctcaatccgccgccccgaccgacgatgcggtgaatgacgatactccggacagtctcgttcagtacggagcctcgagtgcccaaaccacggtgattccgctgttggagcgggaagaacgcgctctgcgcgatgcccgtgccgggttggacgggtatgacagcgagggcaatccgctggccgaatcgtccacatcatccaaataatgtcgtgtacggtgttccgcgccacgccgagcgcgtaacaccgcacatgacgacgcagacacgcggcacaatagagtacagaacctcggccggcgacggccacttaccatgatgttcgtcacaaagacggcagaacaaggagccttatatggatatcgaactgggcattcagaacgtggcacgaccggtgaacttcagcaccgacgaatcagccgacaatgtgagccaggccatcgcgcaggccgtggccgacaacacgacgatcgatctgaccgatgacaagggccgtcgcatcatcgtgcccgccaaggcactcggttacgcgatcatcggctccgaaaccaagcacgccgtcggcttcggcacgctgtgaccatgaatcgcgcataagcggccttgggcattatctcaaggccgcttttgtattgctgaatcaccgatatagcggaagcacgccgcgatgaacgatctcttcgacagtggcctcgtcggtgaggttctcccccagtttgttcggtttgcctttgccatgccagtcagacccaccggtgaccagcagctggtgccggcggcagatggtgagcagccgttctcgttgctccggtgaattgccacggtgccatacctccagcccgtccagtccttcgctgatcaatgcctcgatctggtcatcggacaacagtctgcggttacggctcacatcaccggcatgggcgatcagaatcacaccgcccgctcccttgacggcggccaccacttcatgagaggtcggcgaaggcgtgggaatatagtatttggatgaggcgctgaccgcatccgcaaacgcttccgaacgagtccgatatacgccggcactcaccaaagcatcagcgatgtgaggccggccaatggtggttttgccaccctccttgacttgggcgagcacggattgccaggtaatcggataatcacgagacaacaattcgaccatgcgctgcgtgcgttgcaaccgtgcggctcgagtattggcgaacaagtccgtgatgcgctgattcgtgggatcatactggtagccgagcatgtgcacggagacgttctcatccgtggcggtgatctcggtgccgcggagcaacggcaaaccgaccctatgagccgcggcttcggcctccggccagccggcggtggtgtcatgatcggaaatggccacgcccttgagtcccaatgccttggattgttcggccaacgtggccggcgtttccgtgccatccgagaaggcggtatggcagtggatgtcccacccgacggcgggcggttccaaaggcatcacatatccagtcataccttccatcgtaacctcatttcagcattcccacgcaaggcgcagacaggtcgtcaccttctgccaacggccgaaaccagacattcggcacccagctgacaaccgcagaggctaatctggagcgcagcgctatcgaaagggacatgatgactcgtaacaccgcaaccgacacatcatccagcaccacgaacaccacgccgcttggcttggcggaggcacgaccgttgattggatggcgccacagtgccacttggacatatctcatcatgctgattgcctcggcagtggcgttgggggcctcgctcattctgtccgctgagactttgcaattggctcggcatccggagtccgcgctcggctgcgatctgaactcggcggtgtcctgttcggcggtggcccagtcctggcaggcggaaatcgtgaaattcggcgggctgagctatccgaacgcgttcttcggcatcgccgccgaatcggtgttcattaccatcgcggtgatcggtttggcgcgtgtgaaggtgccgcgttggttcgcgacctgcacgtggctgggcggactggccgctttggcttactcgtactggctgagcacgcagtcgctgttcgtgattcacgcgctgtgcccgtggtgcctgaccctgatgttctccaccaccatccagttcatggcgttgagccatgcgaccgtggccgtgcagggattgccgtcgcgtaaggctgtggcggctgatgatagcgacggtgaggctgaggtcgcggcggtgccggccggactcaataagtattaccgcctcaacatcgacctcatggtcgacatactgtggatcgtggcgatcgtggtactcatcatcgtcaccgaaggcgcggccctgttcgctgcctgattcctttacaacaaatcgatatcggcgaccagcgtggctgctccggtcagctttacgtcgctgtcggtgacgtccacgcgcagggtgccgccacgtacggtgatgtcccagtggctgatgccggtcttggcctgcagcacaatgcctgtggcgcacaggccggtgccgcaggacagggtttcgccgcagccacgttcgttgacgcgcatcgtggcttcacccacgccggtgctctgatcgatgtcgtcgacccgcacgaattccacgttctggtcggattcgatgaccggagccaccactggtttggtgaccaaatccagtgattcaaccactggcagggacgcgaaggcatcctcgatcaccgcgaccacatgcgggttgcccatatccacaaacgtaccgcgcgccgagccctcagtgccggggatggtgacctcgtaggcgtcggtttcgccgatcttccactcccccatttcgacctggaacacgttggctccgtacggcctcatattgccgcgtggcgtcagaatcttgacgccggcacgggtgccgaggcggaacggctcggtggagtcggccaccccctcacgctgagcgaacaaggtgatggcgcgtgtaccgttgccgcacatctccgccaacgatccatccgcattgcgatagtccatgaaccatttcgcgcccccggccagtacgtccgaaagctgatcatcgcttaaatcagacacgaaatcaggccgtgtcaggcgaatcaggccgtcaccgccaatgccgaagtgacggtcgcacaggaatcggacctcatcggcggtaggctcgaatttgccggacttgtcgaggtataccacgaaatcattgccggttgcgtgtgtcttggttactcgttgcggaagactcatggctttcagagtactctagggagcgaaacaacaccacaaaacaatcggctttgtgatcggtcgcggcaacatacggttgcaggcatggctatagggaggattcaggcatgagctcttcggctccaatcggcgtattcgattcgggtcttggcggtatttccgtggctcgccaaatcgccaaggatatgccggccgagcatgtgctgtattttggtgattcggccaacgcaccgtacggcatcaagacgcctgaacaagtgagggccctgagtttcgatattgtcgaacggttcgtgcgtcaaggcgtcaaggccgtggtcatcgcatgcaacaccgccacttccgccgcggtgaacgatttgcgcgaacactacgatattccgatcatcggcatggagccggccctgaaagtggcgtgcgaccgtggtgacgtgccttccgacccgcatcatattccccagagggtgattgtggcggccactcccctgaccttgcgtgagcggaagttcgccaaactgatggatcgattcgattccaacaacacgattttcaaggagccttgccccgacttggtggagatcgtggaatccgggcggctcggcgaccatgacctggtgatgcgcacgctgcacggctacttcgaccagtacgacatggagcatatcgactcggtggtgctgggctgcacgcatttcgtgttctaccgcgactacttccgcgagctgctgcccgaacgggctgctgtcatcgacggcaatgagggtaccgtgcgccatctgggcgtggtgttggagtccctgggcaaactggcacccgaagacgcgaccggcggcgtggagctcgccaattccgatccgtccgaacggattgccgagttgtcacgcaaattgctgaacgtatgagccgttcttggctcccctctctgagggaagccaaggaagaaccagacaaattcacagcacactgcccatatcgttgtccgtgcagcacgcgtaagctcataccagattcaagtgaacagggggttggtatgacaaagacggcgatgattgatgtcggcggcgggttccgcgcgattttcggctgtggtgttatggaccgcatgctggaggacggcatcgacgtggatatgtgctacggcgtttccgccggcgcggccaatatgacctcattcatcgcacgccagcacggccgcaaccacaccttctacaccaagtacgccttccgcaaggagtacgcgagtgcggaaagcttcttcaagaaccacaactttgccaacctcgactacatctacggcacgctgagcaatcacgatggcgagaatccgttggatttcgcggcgttcgaggccaatgagaccgggttcaccgtggtggcctgcaatgccgaggacggctcgaccaagtacttcgacaaatcgcgcgtgcgttttgatgatttcgacatcatcaaggcttcgtccgccgtgccggtggcctgcgagccgtatgtggtggatggtgtgccgtatttcgatggcggcatcgccgatccggtgccggtgcagaaggcgctggaggacggctacgatcgcgtgattctgattctgtctcgcttgcgtgacgaagtgcgcaagcagcagaaggatttggctccggcccgcatcctcgaacgctcccaccccgccgcggccgagaagctgcgcatgcgctacaagacctacaacgacgaactcgaactcgccaagcattacgaggcggaaggcaaagtgctgattctcgcacccgaagacctgtatggtctcaacaccctgaagaagaacttcgagggcctggaaatgatgtatcgcaagggatacgcggcggccgaggccattccggcattccttcaggcatagcgatagtgaagtccctcgcttggaggggcttcactatcgatggatggggattcgcaaacggggtgattacttcgtctcggaagcggtgagcatggccttggtgacctgctcgtagagatcctgataaccgccgggcgtggaggcgggcagcaccacggtcttggtgttgttcgattcggacagcgagcgcatcacgtcgaggtactggttgaacagcaccacgttgttcacgtcgttgatgttcatgcccacagcctgcagactcttgatctggtcgacgataccgttggcgatctcgcggcggtaattggcctggccctcaccctgcaagcgagtcttctccgcatcggcggcggcttgggtctcgatctggatacgctgggcctcggcacgctgacgggtggcttccttttcacgctgggcggcattgatggagtccatcgcgttcttgacctgtgggctcgggtcgatggcggtgatcagcgtcttgaccacggtgaagccgaaacggctcatttcggcgcccacggtcttctgcacgtcgaacgccacatcgtccttgcgggcaaaggcatcgtccaaagacagtgcggggatagcggaacgcagcgcgtcctccatgtaggagcgcagctgaccggccgggtcacgcagctcgtagtaggcggtggccacatcgttcgggttcacgcggaactgggtggaggccaccacggtgacgaacacgttgtcgagcgtcttggtttccagctgcacgttaagctggttgacgcgcatgttcgttttcatggcgatgcggtccacaaacggaatgcggatatggatgccggcgaactgcaccttaaggaacttgccgaatcgctcaatgatgtaggcctgctgctgcggcacgacgaagagtgcggcagacagcagaacaatgagtagcacgatgataatcagcggaccagcaaagaatacggccatgatgttttcccttcacccacgtcgaaaccgccctcggcctcgactcgtgatttccatcgtatcagcgttcaaaacaaagcggtagacatcgtacgcatatgtgtacaactgttcactatgtgtgcatgctggcttcttataaaaaagtgcggcatccaatcagtatgctgcggccatgcctgagccgacagccacggcgccgataccgtcctccagcgcggcaagccgcttttccagtgcatcgacagtgggattggccacacgggagtactcgaagccgtcgatgtcaccgcccgcgagcgcatcgccgcgcgccgcgtcacccaggtcgaatgcggccgaggcatagattggcggcacagcggcacggccgttatccagcggctcgtagccggcgtggatggcttgcgttcggaaatcaacgcccattaatccttcttcctcatgccgctctattgtggcgggctcgactctattcccgaacttagcaagtcatggtacgcgacaccggcacatcggtatcgcaattgtcaatgcgcgcttataagcaatggctatagaatatccgccgaatgccggaacacaccaagctgcctagccctctttcagcacctcggccgcaatattacgctgcctcaaataattcaaagccgcgtcaatccgtaccggttcatcatcgaaaatggccacgatgccctctaccggagtatccgcgacgatgtcgatatctccaaagattatgttgacatcgatgccgacccctttagtaatttgcgacaccaacgcttcagaaacttccttggacacatattgcatccggaccaatcgttggccttcagacaatctcatcaaaagggagtcatggttctcttttcatatctggcgataacgcatatcaaatcagcaatcagcgcaaagacgctcggtcgctccatccggataacaactttgccgtttcgcctaaggtgtcgatgacatggtcaaccggtgcgtcagaaagagcttcagcatagttctcgatgcgatagtcgaaataacgatcggcgcccagcgcgctgctctccgaaagcaccgggacgaacgccgtcagcattcgtaacgccttgggagcgctcaaacgcgcggggctcatcaccgtggcacgcggaaccggcggcgccgaacttgcccacaccccccaaggaaatcactctgctcgatatccatcaggcagtggaatccacgaacctcgatgatgtgatcggcatccacgagagagggaatcacacatgccccgtggctcggaatatccacgacgttctcaaagatgcgtatgctccagtggccaaagccatgtcggattccatgagggaagttacgcttgccaatatgcttgccgactaccgaaatcgcattggggtcaaagcccggcaattggaacagtagtgggcaccgaagcgtaagccccccctactctctgatccacataaacagataaggcgtgcgccatcaagaccgatcgatgacgcacgccttatgcagctcagaccacggattcctagtcagccagcagccccagctcctgcagcttgttcttgatatccactgcagagggttccacttggaacgagccgtcatcgtaccgcaccaccggaatgtgcatctggccgctgatcgccacggcacggtcggcggcaccttcctcttcctcgatgttgtgccaagtgtatgccgcgcccagtttgtcgagagtgttctttgcctggcggcagtcgccacaccatgtggcaccgtagacgtcgatggtcatatcgggtcctttctttgttccgccgcgcttgacttttacgcggtgcactatcaaaccgtattcatcgtaacggggatgctgtgatatcgcggttggcataatgcgggcggtccgcttaaccaccccagtcggctacgccgacagccctctgccagcggaggcggaaccagagcataaaaaagcggctccggtgtggcacaaccgacgccgctccccaggagtagaaaaataggcagaaaagaattagatcaggcaaacaccccccgaagtcagctgttggaacacgtcgaagtcggcatgccgatcgatgtaacgggcgtaagcgatatcgaacgcctggccgagatcttcgatcagatcgttggcgtcctcgatgccaacggcgagacgcaccaattcatcggtgatgccgatcttcagacgctcctcgcgaggcagttcgaaatgcgtcatacgacacggcagctcggcaagagactccaccgcacccaacgacacagcaagacggaacaggtgcaggttgttgagcacgtcagccggatcaacgccaggcacgacctcgaagctcaacacgccaccggcccccttgagacctttggcagccagacgctggtcgcctgcgccgggcagacccgggtaatgcaccgccttaaccagcggatgcaccagcaggtagcgggcgatggcattggcattctcctgctgacgatccatgcgaagggccagcgtctgaatgccgcggcgcaccgcgtcgcactcagcaggagccaacacaccacccaaacggttctgcgcgaagtacacgcggctcgccagatcctcaccggaaacgaccaccagaccggcgttcacatcagaatgaccggccagatacttggtggcggagtgaatcaccacatcggcacccaaagcaagcggcttctgcagatacggggtcacgaacgtgttatccacaatcgaaagcgccccgaaacggtgggccaccgtggagatggcgcgcacgtcgttcaccttgagtagaggattggtcagggtttcaaagtagacggcttgggcaggcacgatgccgttcgcgcggtcgcccttgacggcggcctccaatgctgcgatgtcctgagtgtcgacggcctcgacgaggattccccagcgagtgaagaactcattgagctgggaatacgatccgccataaatattgtcaccgaccacgatgcggtcgccgggcttgaaaatgctcagcaccgcgtgaatcgccgcgagaccggaggcgaacgcaaaaccacgcgttccctgctcgagctgggcgatctgctgttccaggaagtcacgtgtgggattgccgctgcgcgcatagtcgtaacggggcatcgcgtcgaccttctcgaaggcatatgtcgttgagttgtagatcggcgggttcacggctccggtgttgttgtctccaaccggcagtccgtggacgagctgagtgttgaacctggtcattgcgcacccccttaaagtgttgcgtcatctgcgcgaagccgttccccgcgcggcacgattacgaccttaacgcaaaacgccggcccgaaggccggcgttgctatatgtgttggttatggacgggtataatcagacctctccgtcctgcaagaatggacggcctgacgaccggcccaacacacctcgccgctgccgcggctcggcgtcgcctacggacagtccaccggactgtccgtcagacggctccgccttctaccacgatgtcatcggggttgacttcgttgccgtagaccggctccagagtctcctggtaatccttgtggaagaagttgtctttgccgagcttgacgatctcgtcgttcacgaagttcagcagttcggtgttgcccttctgcacggcgggcgcgatggtgtcgtcgtcaccaaggtgggtgatgccaaccttgaagcccttgttggacttggcccaggcgagcacctcggtgttgtcggtggagaaggcgtcaccacggccgtccagcagcgcgttgtaggcatcggcgtactggtcgtacttctgcagcttgacgttcggcgcgttcttctcgaaccaggtttcggcggtggtgcccttagcgatgatcagggtcttgccgtcgagctgactgacatcggtgatctgggcgctctccggggagaccacaccaagcgccaccttcatgtacggcttggcgaagtcgaccttctccttgcgctcatcggtgacggtgaaattggcgagcaccagatcgaccttgttggaggtgagcacgtccacacgggcagccgggtcaaccgacgtgtattccggctccacacccagatccttggccagctgttcggcgaagtagacgtcatagccctggtacttgccgtccttgtccacgtagccgaatggcgccttgtcggagaagacggcaatcttgatcttgccgctcttcttgatctcgtcgaggctgcgggccttggcattggcgctggagctggtgcccgtgtcagaggacttcgcttcgctcggggtgcctgccgacggaccgcatgcggccatggacgccgccattaccaatgccgcgcctgcggcaatcagtgctttgaatgatttcccaaccttgatactcattgggttctccttctcttgttgttattgatatttcttctcaaatacgtcgatatggcacaatcgaatcactcgaattcgaaggtgtgcaggaactgctgcgcacgttcggtttgcgggtgttcgaagaacgcctgcgcatcatacgattcctcgacgatgcgcccgccgtccagcaagatgatgtggtcggcgatggctcgcgcgaactgcatttcgtgggtgacgataagcatcgtctgcccggacttggccagttcgagcaccacgtcgagcacttcacgcaccatttcggggtcgagagccgccgtaatctcatcgagcagcagtacttccgggtgcagaatcagcgcacggcaaatggccacacgctggcgctgaccgccggacaattcgtgcggccaagagtccttgcgatcggcaagtcccacgcggccaagcaaccggatcgcttcagcctccacctcggacttatcgcgtttctgcacgagcaccggcgccatggtgatgttgccgagcaccgttttgttcgggaacaaatcgtagctttggaacaccatgccgatacgcgtgcgcagttcactggaccggtcggatcgtccggctcgttccgtgccaggcttgccggcatcgatcacctgattgttgatggaaatcgtgccgccctgaatcggttccagaccggcgatggtgcgcagcagcgtcgacttgcccgagccggaaggacccagcaccacgagcaccgaaccatgctccaccttgaaggagatgtcatccagcaccggcttgtcggcattcgcatactgtttgaccagatgattcacctcgaaacccttgcaggtcgtttcgggttcagtcattcgaccacctcttttccagtcggcgggccacaatggacagcggccagcacacgatgaagtacataaagaaaatcacgccataaatccacaaggttccggtcgggaactggaatcggttcgcgtcgataatctgctggccgaccttgatgacctcgaccacaccgagcagcacggccaatgatgtcgttttgacgatacgtgtcgccaagtttacggatgccggcagcatacggcgaacagcctgcggcagaatcacccgggagaaggtctgccacgggctcaaccccagtacgtagctcgattcgtactgcactttgggaatcgactgcaatgcgccacgcaccagatcgcccagctcggcgcctccccacaggatgaacaccagcacgcaggcaccggtggcatcgagattccaatcgaaccatcgagcaaaaccgtagtaggcaaggaacagcaacgccagctgaggcataatgcggatgaagtcgaggtagatgcgcatcgcggcccggatcacgggattcttcagcgtcatcaaccagcccatcaacaggccgaccgggatggacgcgcctacggatacgccggctatccacacggtgacccacaggccttgcaacagacgtgggaatacgcctggctggagcagtatttcagcgccgctcataatcgaacctccgctccaaccatgtgccgaagatggaaatcggcagcagaatcaccagataggccacgaccagcatgaacaacgactcataggtgctgtaatacatgccgatcagatccttggccatgtacatcacgtcggcgagcgcaatggcggagacgacgctcgattccttaaacaggaagatcacattggccactacgccgggaatggcggtggacactgcttgcggcagaatgactcgggtgatggtttgcgtggaagtcagtcccagcacgtacgcggtttcgcgctgcacgttgggcaccgcttccaatccgccgcgcattgcctcggccatgtaggaaccgcccaagaatccaaggccgactatcgcgcaggtttcggcggaccatactacgccgagtttgggcaggccgaagtacagaaagtacagctgtaccagcaatggcgtattgcggctaagttcgatgtagattctcacgatttgccgggcgaccgggatacgcgcgatttccacgccagcgcagaccagacccaccgcgatggcaagcaatatgccaaacacggatatgaataaggtcatcaatgtgccgttgacgaagaaaggcgcgtaacgctgcacgaacgaccaatcgaatgtcattgggcgcgctccttcctttgcttctcgtttcttctcctgcgcataaacggccttagccacccatgtacgatttcgggggccgaacatacctgtccccctgccgtgtcatcgtagagtatcagaacacgtggcacggccgctgcgctatacgcattacttatgggacgttactcgatgggcgaacatcagggcattattgtcgcccaaacggtggatacactgaggctatgaagatcaccaaagctctgacccgtttgaccggtcctgaaaccaccccggtgttcgtgctgttgcacggctggggttccaatgaatacgatttgcccgatctgctgaactattgcggtgccggttcggctgattatgccagtttgcaggcacccatcgcctatggcatgggatatacatggttcggtgcgtgggcgcatgaaggtgtgccggagggcgaatcattggacaagcaggcggctgaggccgcccaagccattgatgcatgggttgcggagcatattcccgccactcggccggtggttgccatgggattctcgcagggcggcctcttggccgcgcatcttttgcgatgcaatccgcaacggtatgcggcagcggtctcctgctccggctggttggctccggggccggtctctggagacgccgagctggctgcgttgaagccgccggtgttctacgggcatggtgctgcagacgacatcttcccgaaagccgatgtgacggcgatgggtgagttctggcacgagcacggcacgttgaccgaacaagtgtatccgggcatggcccattccattaatatgccggaaatgcgcgatattcaacggttcttggagaccaacggattcattcggccgcagatttggtagtcaccacctcacatggcgtagtcgacgtgggcgaattcggggactttataccatttgacggggtagccggcaccgtgggcgcagaagaccgagtcgggggtgttgtccagatctgcttcgggatcgtaagcggcggctgcgatgacctgttcggcgtcatggcatggcttgtagccgctgaaagtggcggagaaacggccatggccgtgcgtgtactggttcacatccatcgcatagtcgcgcatctcggacaccggcgcctcgccttcgatcacggcgtattcgccatcggtgaccggggattcgaaggtgccggccatgcgctggatgtcgctcatggcacggccgatcatgtctgctggcacttcgagccggaaccgataccacggttccagcagtcggcagttgccctcccctgcggtgtccggacggctctcgaccggcgtctcgggccggccactgactccagctctggcttccataagcccctgacgaatcgcacgataggtggcttggcggaagtcgccgccttcggtatgcttcagatgcgcgcggccagccaccaaagtcatcttgatatcggtgagcggcgcgccaacgagcacaccgagatgctcacgctcggtcagatgggtcagaatcagccgttgccaattgcggtccaaatcgttttcggacagggccgaggccacagtgactccgctgcccggctcccctggttccagcaggatatgtgcttcggcataatgacggagcggctcgaaatgacctgcgccttcgatcggcgcagtgatggtctcacggtacaggatggagccggggccaaacgacacatccagaccgaaccggtcgtgcagggtctgctggatgatctccagctggaccgcgcccatcaattgcacatgaatctcggccaaccgctccacccagaccacatgcaacaacgggtcttcgtcttccagctcacgcaatgcggtgatgaccttatgcaaggtcagatcatcgaactggggacgggccggcgagctattgtccgccgcggtctggccggcggtgtcgttctcctcattgcggccggttcccgacttggcggcatcatgctcggcatcgtcctgattcacgttgttatggccggcgtcaccgcgtttggccgctcccgaggtgccggccgtatcggattccgctccggcgggcaacaccgtgtaggtcaacacgggttgcagcgacggtgattcggcgtccggttccgctcccagcccttcgccggggaaggtccgcgtcagtccggtcaccgcacacaccgatccggcaggcacctcggtgaccgtctcgaatttggcgccattgtagacgcgcacctgatcgactttctcggaccataccgtgccatcatccccctgtaccggcgacggtgctgatgacgccgcagcgcacgaggatgaagagacgatctccttggctttgagcgcaccaccggtgacgcgcagccacgtcatacggttgtgctggccgtcgtgggcgattttgaacacgcgtgcggcgaaggcggccggccattcacgttcgcgggtgaacgtctccagcccgtccaggaattcctcgaccccttcgagtttcaatgccgagccgaaatatacggggaacagttcgcgtacggcgatcatcgctcgcaatctgcccacggacagcgcgccatgttccagatagtcgttcatcgcctcctcgtccagggtggcaatgtcttcggcgaacgcgtccaacggtaccgcgctgccctcagtggactgctccattgccggcagcggatatatcgcatcgctcaggcgtttgcgcaactgtgccagaatggcctcgcggtcgaatccggcggcgtcgcacttgttgacgaagatgaacgtcggcacaccgtatctggccagcagacgccatagtgtctcggtatggccttgcacgccatccgtgccggagaccacaagaatcgcgtaatcaagcacacgcagcacacgttcggtttcggctgcgaagtccacgtgccccggcgtatccagcaaggtcaggcgcaggtcgccgtgttccaccaatgcctggtgcgcgaaaatcgtgatgcctcgcgccttctccaaggaattggtgtccagaaacgcatcgccgtgatccactcgccccaatttgcggatctcaccggtacggtagagcagagcctcggacagcgtggtcttgcccgcgtccacatgcgcaacgatgcctgccactatctgtttcatcagctgtgctcccttcccgatgcgccgcgcaattgccggccgcctaaccaatatatccgagaaaatccgggagggaaaaattgtaccgacagaccgggctgccggtacaataagtcaccgaacaccgactgatatgaggagcctccgtgaccacttccggcattaccgttttcggccaaccatcccagcccaatcatggtgccggcgggcgaatcgccatggacgatgccgtcttccccaccgattatgtggcgctggatttggagaccaccggcttttacccgaacagttgcgccatcacggaaatcggtgccgtgcgcgtgcgggaggggcatatcgtcgatcaattccagcagctggtgaatcccttgcggccgattccgcgtcagatcaccacgctgaccggcatcaccgatgcgatggtggccgatctcgatccgattgacgaggtgcttccccgattcatcgcatggctcgctaccccggctgccggtcccgccgttgagccgattgtcggccataacgtcagcttcgatctgcgattcctggattacaacacccggcatatcgccggctgcggctttgcctgcgcggattatgacacgatgcagatcagccgcgccctgttccccgcgcagcggcatcaccgtctggccgacctgatcgtacgcttcggcatcgcggacaatgaggagcaccgcgcattaagcgatgccatccaaacccagcagtgcttcgaatggatgcggcattacgtcaccgagcatcacgaaaccgaagcaatccgctggaagcaggcgccggccaaaaacagcgccgaaatcctccaccagcagttggtggtaaagaggtagtttacagcccgtattccttggcgatgacggaccagaggtcggcagcggcctgatcgacggtttcgttgacgatggtgacgtcgaattcgctttcggcggcgagctccaccttggcggtctccaagcgacgggcctgctgttcggcggtttcggtgccgcggccgatcaggcggcgctcgagctcttcgaagcttggcggcgcgatgaacacgtacaccacttcgaggtcgagctcggcggcgcgctgcttgacgcggcgggcaccctgcaggtcgatttccagaatcgtgggcacaccggcggccagatgttcctccacaggcttcaacaaggtgccataatgggccatgccgtgcaccactgcagtttccaggaactcaccggccgcctcacgggccaggaactcgtcttcagtgaggaaccaatagttgacgccatcaacctcgcccgggcgcggagcgcgtgtggtggcggagacggacacccacacttcggggtggtcggcgcgcagcttggcttccacggtgcccttacctactgcggtggggccagtcaggacgattagacggccagcatgggtgttttcagtcatgggttcctccggagatgatgtggtgtgcagcgattatgaatccaacgtggtaacggctcaccggcgagatgaccggtaactgctacagccccgacgaacagggaagaatatgaatcgtgatgcgacgtacgcgatgagatagacacgtacgcatgccgcgacatctgattccgttctgattactggttttccgagccttcgacagtggcttccatcagcgcctgacgtacgtcaagcgcaatcgactcggtggcttggctcagtgcggcgatatccggcccatgcgaggcgataaagcgggacacggtgaccagcacgttgccgcgcgtaccgcggaacacggttttcagatccttggcctcggcaccctgccaaccgtaaccgggggaaagaatcggaccggtgaacttggaggggtccacgccggaatcctgcatccattggccgatggtggcaccgatgatcagacccaccgagcccatgccttcgatatccacgttatgcttctgcgcggtggaggcgatgccgtaggccacggtacgtcccttgtaatcgccgctctggcgcaacgcggtctgcagactcatgccttccgggttggaggtcagggaggcgatgaacacgccgcgtccgttttccagcgcttcggtaatcaggccgttcaacgaacgcgcgccatagtacggcagcagcgtgatggcgtcggccagcaacggtgcaccgggcttgaaataggcgtctgcgatggcggaaatcgtggtggacaggccgccgcgcaggcaatcgacgatggtgatgacgcccatttgtcgtgccgcgtagagcacgcgctcgagcgcttcgaaacctttggctccgtagcgctcgaacatcggcgtctggaatttgactgctgcggcgcgcccgttggcggcctgcagcatacgcatggagaagagttcggcgccttcggcgtcgacgttgtatccccagtcggtgaggagcttgcgatgcgggtcaatgcccacacacagcggcccgtatttggccattgaattgcttaatcgcagaccgaaatccgaacgttgtgcctgcaattcctcactgctgagtgtagtcatcagaactcccgtcgctccaattcgaacagctgcttcgaatgctcctgaatgctcatgatctgataatcattatgcttcacggcctcgatagcgagcagtgcggcctggaactcggtgatggtggtgaactgcggcagatcggcggcaatggcggcggcacggatggagtagccgtcggaacgggagccgcgcgagttcggcgtgttgaggatcatgtcgatcttgccttcctcgataagctgaaccacgttcttgcccacggatccggcagcgtgatgcacctcgaccggggcttccggatcggtatccacgcgggtgctgatcttgtccacgatgttcgactcgatgccgtaacggcgaagcacggaggcggtgccctcggtggcccagagcttgaatccaagctcctcgagacgaacggcgatcaacggcagctgacgcttgtcggtgtcgttcacggagatgaacacgttgccgtgggtcggcaggccaccgtcgtaggcggcgagctggctcttggcgaaggcgtgcgggaagtcacggtcgaagcccatgacctcaccggtggaacgcatctcaggtccgagcaggatgtcgacggtcttgcccaccggggtgcggaagcgcttgaacggcagcacggattccttaaccgcgacctgctggccggggtggatgtcgccgccgtcgcccttgggcagcagcagaccgttggcacgctgatcggcgatggtttcgccggccatgatgcgggcagcagccttggccagtgccacgccggtggccttggaggcgaatggcacggtacgggaggcgcgcgggttggcttcgatcacgtacagcgtgttggccatgaaggcgtactgcacgttgatcaggccctgcacatggcagcccttggcgatggcgtaggtgccttcacgcaggcgacgaatctggtcgtcggacagggtggacggaggcagggtgcaggcggcgtcaccggaatggacaccggcctcctcgacgtgctccataatgccgccgatgtatagttcctcgccgtcgaacagtgcgtcgacatcgatttcgatggcgtcttgcaggaacttgtcgatgagcagcggggagggcaggcggccggagaccacggtatcggccttggcctcggcaagtgcgcggtccacgtacttgttgagctgcttgtcgtcgtagacgatttccatgccacggccgccgagcacgtagctcgggcgcacgagcaccgggtaaccgatgcggtgggcggcttccttggcctcttcgaggctcagggcggtgccgtaacgcggggcgttcatctccgccttcttgagcacttcgccgaacagctcacggttctcggccaagtcgatggattccggggtggtgccgagaatcggcacgccggcggccttcagacgcgcggccaaggacagcggggtctggccgccgagctggacgatgacgcccttgaccgggcccatcttcttctcggcctcgtagatctcgagcacgtcctcgaaggtgagcggctcgaagtagaggcggtcggacatgtcgtaatcggtggacacggtctccgggttgcagttgaccatgatggtgtcatagtccttgccaagctcctgcacggcgtgcacgcacgtgtagtcgaactcgatgccctgaccgatgcggttcgggccggagccgaggatgatcacagcctcgcgttcgcgcgggcgcagctcggtttcgtcggcgtagcagctgtagtagtacggcgtggcggcgtcgaactcggcggcgcaggtgtcgacggtcttgtagaccgggcgcagaccgtaggtccagcgcagttcgcggatggtgttctcgccttcatcgcccaaaccacgcaggtgggccacctgcacgtcggacagaccggcgagcttggccttcttgagcagcttcggggtgagggtttcagcctcgcgcaccgtcatggcggtctcattgatgaggaagatctgcttcaggaaccacgggtcgatcttggtggccgcgaacacctgctccagcgtggcgccgccccagatggcgcgcatgagctgcaggtaacggtgttcggtcggggtgtggatggtctcaagcagttcggccacttcttcggcggacggcttctcgccatcccaattgaagcccatgtggcgcttgtcgatggagcgcatggccttgccgagggactcctggaagttgccggccagggccatggcctcgcccacggacttcatggaggtggtcagggtggggtcggcgcccgggaacttctcgaaagcgaagcgcggcaccttggtgaccacgtagtcgatggtcggctcgaaggaggccggcgtggactgggtgatgtcgttgcgaatctcgtcgagcgtgtagccgagagccagcttggtggcgatcttggcgatcgggaagccggtggccttggaggccagtgcggaggaacgggagacgcgcgggttcatctcgatgacgatgatgcggccggtgtccggatgaacggcgaactggatgttgcagccgccggtgtccacgcccacgccacggatgatggcgatgccgatgtcacgcagcttctggtattcgcggtcggtcagggtgaagcagggggccacggtgatggagtcaccggtgtgcacgccgaccgggtcgacgttctcgatcgggcagacgaccacgacgttgtcgttgcggtcgcgcatgagctcgagctcgaattccttccagccctcgatgccctcttcgatcaggacttcgtcggtgggcgagtaatggatgccggcgccggcgatgcggtgcagctcctcctcgttgtgggcgatgccggagcccaggccacccatggtgaagctcgggcgcacgaccagcgggtagccgaacttctcggcgatcttgtcgacttcctcgatgctgtgggcgatgtcggagcgggcggattcggcgccggcctcgtcaacgaccttcttgaacagttcacggtcctcgccacggtcgatggcttccagggaagcaccgatcagttcgacgttgtacttcttcaggacgccggcctcgcccagcgccatggcggcgttgagcgcggtctggccgcccaaggtgggcaggagcgcgtcggggcgttccttggcgatgatctgctcgaggatcggggtggcgatcggctcgatgtaggtggcgtcagccatctccgggtcggtcatgatggtggccgggttggagttgacgaggatgacgcggatgccttcctcacgaaggacgcggcatgcctgggtgcccgagtaatcgaactccgcagcctgaccgatcacgatcgggccggagccgatgaccatcacggatttgatgtcggtgcgcttcggcatatcacttaccttccttggagttgttcttcataagttcgcagaaacggtcgaacaggtaggccgcatcgtgcgggcctgctgcggcctccgggtggtactgcacggagaatgcggggatgtccacgcactgcaggccttcgaccacgtcgtcgttcagatcgatgtgggagacgaacaccttgccgtacttgccgttttcaaacggcgcgtcgacctgcttgccgatcggggcgtcgaccgcgaagccgtggttgtgggcggtgacctcgaccttgccggtggtcagatccttgaccggctggttgatgccgcggtggccgaacttgagcttgtaggtgccgaagccgagtgcgcggccgagcagctggttgccaaagcagatgccgaagaacgggtagccggcgtcaagtacctggcgcagcagctcgatttcgggaccggcctgttccggatcgcccggaccgttggagaagaagacgccgtccgggttcaggttctcgatttcggcgaaggtgatggtggagggcaccacgtgcacgcggcagccgcgttcggccatgcggtgcggggtcatgcccttgataccgaggtccacagcggccacggtgtacagcggctccttgccttcgtactcgccgcacggttcgatggtgtaggtctccttggtggacacctcgtcgtacaggctcagaccctgcatctgcggggtgttcttgacgtcttcgagcagctgctcgatggtcttgagcgcgccggtggcctgatcggtcagggcgtcgccggagaagatgccggcgcgcatcacgcctgcggaacgcaggtggcgcaccagcttgcgggtgtcgatgtggctcaggccgacgatgccgttcttggcgaggtcgtcgtccaggctgccttcggcacgccagttgctcacgttcggagagggatcacgcacaatgtatccggcaacccagatgcgggaggactcagggtcttcgctgttgacgccggtatcgccgatgtgcgggaacgtctgcacaacgatctggcgatcgtagctcggatcggtgagcgtctcctggtatccggtcataccggtggcgaagacgatctcaccggtcgtctcgccgagggcgccgtatggctcccccacatatacctgtccgtcttccaaaacgaggactgcatcgtccttgtcatacatcggaattgcgatggtcccggactcgttctggctcaccaaaacccccttatgtttttcgggtattcgtaccaaggttaacggccagcgcagactcacacgccgttggacgcaaagtctcacccccgctggcggggctgtcggcaaggtgccgacttgagaatgtacggcggcacaagtgtccgcccatgaaaaagcctcccgaatggggaggctgaacaacaaatgactaatcgaccgtcggctgaatctcagcggacggggcagcaggctcgtcggatgcaccggacgaatcgggcgaatcggaaacatcgccctcatcggtcggctcggatgcggcggcagcggaatcggacgattcctcatcggcctcttctgccacggactccggtgccggtgctgcattcttggcggtgcacaccgcagacagcaggccatggatgaaagcgggcgaatcgtcatcgcacagggtcttggccaatgccagagcctcgtcgatggcgaccttgtccggcacatcatcggtgaacagaatctcccaagcggcgatacgcagaatgttgcgatcgaccacgcccatacggcggaccttccaacccgtggagtgttcgtccagggtcatgtcgatctgacgacggtgctcggccacgcccttgacgatttcaatggcatagtcgggaagcggggtctgggcaccgggatgtgcgatgcgctcgtcaagcagggagagaatatcctggcttttttcgtcggcttcgtacagggtgttcagagcccttttgcgcgcggtggaacgtgccatactgctgctgtcctagtcctttatacggtcggtcgtctgttgaggatgcggagatcagttgttctcgcggccggtgtaggaaccgtcctcggtgttgatcttgacgcggtcgccctcattgatgaacagcgggacctgaatctcggctccggtctcaacggtggccggcttggtgccggcgttggagcggttgccctgcaggcccggctcggtgtgggtgatggtcaggaccacggagcccggcagatcgacgctcagcggggtgccgtcgtggaaggagaccaggcagtcggtgccttcgagcaggaacttggccttgtcgcccagaagggtcttcggaaccatgatctgatcgtaggtggtcatgtccatgaacacgaagttgtcaccgtcctcgtaggagtactggagagtgcggttgtccacggtctcgaattccatcttcatgcccgcgttgaaggtcttgtcgacgatcttgccggagagcacgttcttgatggtggtgcgcacgaaggcggggcccttgcccggcttgacgtgctggaacttcatgacggtccacagctgcccgtcgaggttcaggacggatccgttcttgatgtcgttagtagtctgtgccacgttattcacctatttcaaattcaaactagcttaggcaaagcccaaaaattgcctcggctattatgccacaccgggtatacaggaagtgaacgctggggtttcccatgtgcccccggctagactggatgaatatgcgatccttcttcgaagccatatccgtgtcctgcgtcatccccgcgcaatcgccggcggacgacgaacgcacggtgttcgagaacctgtcctttgctgtggagcgcggcgagatcgtcgatctggtgggaccgtccggctccggcaagtcgagtctgctgaccgcgtgcgcccggctcaacccgcatgcgcacggcgcgttcgcccttgaaggcaagggcagcggcgagttcacgccgcagcagtggcggcgggatgtcgcctacctgccgcagaagccgattctgacgggcaagaacgtggccgaggcgatccgcctgccctggacgctcgcgattcgcggcaagggcggcaagggcgagcatctgctgcccgacgagcgcatccgcacgacgttggacgcgatgggctgcgaggacatcgatctggagcgcgccccgcacgacctgtccggcgggcagacggcccgcgtggccctggcccgcacactgctcaccgacccgaaggtgctgctggccgacgaggtagatgccggtctcgacgacgacaacgcagccaaggtggctacgatcatggcggatgccgccacacgcggcatggcgatcatccgcatccgccaccgtccgccggacggacgggccacccgcacgctgacgctggacaaggggcggctgaccgaacgcgagatgacggattcggcggcgcaggacgcgaacgcggtgcctgacggcgccgatgaaaatgaggagacgcaggcatgagcggcgatctgggcaattcctacaacatcgatatctggggtctgctcatcgcgctgggcatggtggccgtggcggccatcatcagcgaactgatgcacatgggcatcggcaagaccctgatgtggtcgtcgtgccgcgcattggtgcagctgtgcgccatgggcttcatcatcggctacgtgatccggtcgaacaacgtgtggatggtgttctccctgatggcggtcatgctggtggcggccgtgcagatcgtgatgtcccgcgcacgcggcatccccaagggccttgccgggccgatcttcctgagcctggtcatcaccatgctgctgatgctggcgctggtcaccgagctcatcgtgcgcccgcacccgtggtacgcgccccagctggtggtgcccctgaccggcatgctgctgggcaacaccgtaaccgccttggcggtgggattgagccgtttctacgagagcatggaggagcggcgtgacgaggtggatatgatgctggcgctgggagcgaccccgtgggagtcggcccgcccgtccatcgtctcgtcgattcgcttgggcctgctgcccaccaccgcctcgctggcgtccagcggcatcgtgacgatcccgggcatgatggccggtcaggtgatcgccggcggcgacccgctcaacgccgccaagtaccagttcgtggtcctcgacgccatcgccgcgctgaccctgctggccgacggcctgatcatggtcatgatctaccgcacctgcttcaccgccgacgaccaataccgcccgcccgaagcgcgctaatcagctaagctccctctgataagctccctctgacgagggagctgtcgagcgcaacgagactgagggagagaccaccctacgcgatggtgaccagcgtgccgtccggcacctggtcatagaaccattgcgcgtcggccacggccaggcgcacgcagccgtgcgaggcgggctggccgagtttggcaccctcctccggcagatagtcgccgaaggcctcgccggtcggcaccgagtggaacaggtacgaaccgtagaactgcacccaatagtcggcgcccatgccttcttcggcattgtagaagtgttcaccgcgcgtatcgatggtgtacgagccgtgcggggtggcgtcgtcgacgccggtactggcgatcatcgtataaatggtctggccaccggacttgacgtacacccgttgtttggcgagactgacctccacgctcaggtcggagtactgggataggtcgggctgtttgccggtcggtcccttccagtccacgctttgcgcggctttgtcatcgccgttctgcgtgttctgcgtcttccgcgacccgccctgtttgccgctatcgggaacctgcttgcgggtaacggccgtgggctcgttcgccgctgcggttgcggcggcggttgcggtgtcggctcgcggccagctgcgctgcgccgccgcggtctcgactccggcgccgatcaggcagaacaggatacagcaggcgaccactccgcgccgaatcacgtagacccgatcgcgactccaattcacgttcaacgtcggcagcctcaccatatgcctcttctcaccacaaagaccattcgggtcgattgtaaacaggcattgcgacgccctacgcctcggtttcagccgtgatctcgactgcaggaacggcatcgtccggggaatcttcgcccgacgccggcaccgtccagcgccgccgcagcagcatccacaggccgatgatcatggtcaccgcaccaagcccgatgccgaacagtcccgaggattgcgccgcatatgcaaatgccatcgcaatcggaaacagcgcagcagccagcggcatcaccgcaagcccagtagcgaggtcaacccacagctggcggcgcgggaaacaggtcgcgccgcccagtacgcgaatccggcgagcttctaccgagtcgcgaggaagaagaaacgtgggaaggggaagatgatgctgccgtccgactgtgtggggtattcctcgcggacttgggcgaacacttcggcctcgaacttcttgcgcccggcgtcgtcaagcgcttgcagatacggcctcatgccggtgccacgataccagtccataatcgcctcatgcgagggcagcgtgtgcatgtacgtgaccttccacatgcggaaggcgctggcatgcgcatgcagcagctcccagtattcgggcggcgtgaggttgtagaactcgcgttgctgcggcagcttgtccgcgaacgcgggcgagtgcacgataccaccgatgatgcggtgaatcggctcctcatagttcatcggcgtctgcacagccagcactcccccgaccctgagccgggcgagcagtccgggaatcagatgcggatggtccggcacccattggatgcaggcattggagaagaccacgtcgaagtcggccggcagctcgtccagccgcgcggacacgtcgcacagctggaaatcgatgtcgggataggttttgcgcgctgtctcgatcatgaccggcgagctgtcgacgccgagaatcttggcatggggatagcgctcgcgcagcacggccgtgctgttgcccggcccgcagccaatatccagcacgcgcgtgacgctgccgtcgtccggcggcagctgcatcgccagatcacgcgccggctgcgtgcgctcccgtttgaatcgcagatactgttccgaatcccaggtaaccatgctccccacgctaatcagccattcacatatcggccgatattatctcacaattcagccgagcagggcgtcgcggcggacgatgagcccgtcaatcgcggcctcgccttcgatgacggtgaaggtcagggacttgcgttcgctggcctgcggggcgatggcgtgcaggtcgccgcgctgctcgtgccagccgcggccatggacgctggagttcgagggttcgaggccgaccacgtagtcgcccgcacccgtcgacttccattccatgaagtatgggaagaggctggcgtcgaagtcgatgacgactccgagtccgagcttgcggttgaccacggcggcgaagctgcggccgttctcgtcggcggcgagctcgtgcaggtacacgctttcgggactgatcgtcgcggaaggattcgttggtcacctcatcctcgaccgtgatcgacagccggccgtacacgctggtgattgtgcgacgcagtacgaggttctcgccgcggtattcgaactggcagacgtcgagggcgcggtcggccatggacacgaaacgcaacggaccgttcttcacctcgatggccttgaggccgtgggctcggccttcctagtattcgatcgggcgcacgtaggcggcctgctgaaggctgcccatatgggccagcatgtcggctcgcgtgctgtgttctgtggacgtcatcgtcgtcaccgatccttgatatttatgcctcacgcctgcgcagcggcggcatccgcggcgtcgttcttcagcgcgcgcagcagggccttgttgcgggattcgatgatgcgcttgccgtcctcgccctgccaggagaagaagccctggccggttttggcgccgagattgccttccctgaccttctcggcgagcagcgggctcgggccggtgccgttgtccatatcgtcgaacaggtaagtgctgatgttatagaacacatcgaggccgccgaggtcgatgctggcgagggggccgaccagattccagcgacggccgagactgtacttcatcacgtcgtccacggtggccgcgtccgcgatgccctgctggacgatgtagaacgcctcgcgcagcacggccagttgcaggcggttgcccacaaagcccagcgattccttcttgatcttcgccggcttcttgccgatcttggccatgaggtcgaaggtgatgtccaccaccttcggatcggtcttctcacccggcaccacttcgaccagcggcatcaactgcgcggggttccagaagtgcgccaccacgaagcgttcgggcttcttcagcaccgactgcagcgcggtggggctcaggccggaggtgttcgtggacagaatcgcgtccttgggggcggcgtgctccacttcggcccagacggacttcttgatgtcaaggttctcggccacggattcgatgacgaagtccacgtccgccacgccgctcgcatagtcggcgtaaccggtgatgcgggccagcaccgcgtccaaggtgtcgccatccttgagtagtccggcttcggcaaagtcctcggcatccgaacgaatcgccttcatcgccttctccagcgaggcctcgccgcggccgaccagatgcaccggatatccggacaacgcgaactgcaacgtgatcgcgtggcccatggttcccgtgccgacgttcgcaatcgtcttgatatcgtccactgtctcaatcacggagaccccttctttccggcggttcgtctggcgttggtgtacgcatgaacagcaccgtgccgttatgcgtttgctcgcattctatgccgatttcgctacgtgaacatttactgaacatttcgcggattcgactagtacaaatccccatatcagcacaaaagcgtggtgccgcaacaccgaagtgttccagcaccacgctgaaatgttcatgtcgttacgctgctatcgcgcacccacagcggaatcgataggaaacctcaccggagtaggtgaacacgggggcgaccagcatggacggaccgaacatatactgacggtccagcgtgcggcatgccgggtcatcggggaactccacgaacatggaacgcatgaccggagtaccgttcacatgaggctgcaggccaagctggtagacatacggcatgagttcaagcttgagcttggtgaactcgcgcaccacatccacggcggtctggccgggcaccaatgcgacgccgttcttctcgtcctcctcgtcgaacagccacggcacacggtacacggtggaaccgtgcagtcgcgagtgggagccgagcatgccgaacgccacccaacgcttgtagacggccggatccgggaacgcaccttcgaagccaccgatgtcgtgactccagaagccgaagccggaggaggtcagcgacaggccggcacgcaaggactgggccatgccattgaaggtggactcgcagtcaccgccccaatgcacgggctgctgctggccgccgacggtggcggagcgcgcatacaggcaggcgttgcccttgccgtaggtttcttcgatggcttcgaacacggcctggttgtacagctgggtgtaccagttgtgcatggagagcttcggagagccgtcataccagacgacgtcgcgcgggatacgctcgccgaaatcggtcttgatggcgtccacgccctgattcagcaacgccttgaccttgtccttgaaccattcacgggcggccgggttggtgaagtccaccaagcccatgccggcctgccagaagtcggtctgccagacttcgccattgggcttgcgcaccagatagcccttgtctcggccctccttgaacatttcgccgcgctggccgatatacgggttgatccaagcgcagatgtgcaggcccttgtcctcgtgcaggcgcttcagcgtggattcgatgtcgccgaagaaacgcttgtcccactcgaaatcgcaccaatggaactcgcgcatccagtagcagtcgcagtggaaggccgccagcggaatatcacgttcggccataccgtcgatgaaggagttgatggtggcctcgtcgtatttggtggtgaacgaggtggtcaaccacagaccgtaactccatgcgggcacattcgccggacgtccgacgagcttggtgtagcagtcgagaatctgcttgggggtggggccatagatcacgcagaagtcgatggcctcgccgggcacggagaactgcacggcctcggtgttctcggaaccgatctcaaaggagacatggccgcggttgttgaccagtacgccatacccattggaggtcatgtagaacgggatgtccttgtagccctgctcggaagcagtgccgccatcctcattccagatgtcgacgctctgaccattcttcacgtaagcgccgaagcgttcgcccaagccgtatacgtcttcgccaaccgacagatgcagctggatggcaatgaacacgtcggattcatcacgggcggaaccgtccatggtcacaccgaattcgctgaccggctgggcggtgacgttcgattcggcaccgagcttgaatcggcccagcgacttgcctgcggactcagtgagcaccttgccgtcctcgccgatgaaggtcaggttccagggggcgcccttgacgaccttcacggtaagtccgccagtggtcagcgtgacatccgcgccattgacgccgacttcgccgtcgccattgccgttcgcctgaacggtcacgtaatcacggttgccgggttcgtcggcattgagcgggaatccggggtattcggtggcgccttgccagtgttcggcacacacacgaatcacgccttccgcaggtgtggtgatgtccacattgaatgtgggcaggttcagggtatcgtatcggccgcgtaccacggaggtcggggcgaggacgttgaggctttcggtggtggcatccgccgccagttcgtaggcttcacgagcatagagggcgtcgacgccgtcacgaatcatccagtagccgttggtgaacttcattgttgctgctccttggtggagaggtggtttcgaccgccagggaacaaggcagccgaaaccaaaatcaatatgtgctgcttgttgattgaattgcctgttgtgcgaatgaccttacttcaccgcgccggtggtgatgccgtaccagtcgccggagcccatcatgccttgctcatcgtacttgccggtgtcggccaaggaaccggtgataatcttgtcccagccatattcggacacgtaatcgttgaggttggtgagcaggccttggctggcgagcaggccggacgtggcgttgcccttgttgtattccgtaacgtccggagcgtcgtcggagttgaggacctgggaggcgttctggcgaatctgttcgaaggccttcttctcgaattcgaccttgacgccggtctcacacattttcatgctttatgcaaaaaatgtgaggcatacgcacatttcccatcaaacgcacaggtgcaagaatggcagcaattcgccatttttgaaatcaccatgtgcgtttgacggcgcgtaagcctcacattgttctcagcaggaccgaatttctgcgagccccccctatagcgctcccctacgcaatatgtccgcaaacgaccacaccacatgggcgatacgcgccaattcggcgtaacggccgatggacagccactgcacacggtaccgttcgaaccacaactccaaatcggcggcaagacgggcgcggcgcgaggcatccagcgcacggccggtcacatccttggtgtcacaggcgtcctcgccgccagccaataccagcagttcctcacccagtctattgaacaaccgctgcccatccagcatcacccacagcagctccgggttcaatcctcctcgtgccgagccatcgagcaccgcgacaaccgcactgccgcaatcaatcaacgcccggtcgcaatcccggcgtcgttcgagacgggcatggttccgcaggagcaatcggcggcgcgcgtcggcgcatcccagcgcacggtcaaacatgagctctcccccgcacgaccgttccacatacgatgccacatccgtattcagcatgccggtgccggaaccgtattccagttccagcacttgcacggcgaggtcccaggggaacgacactccatcggagtcgatgcgagcgagtgaatccataagccaaccggattcgtcgccatacgccagattagaaatccgatggttcatttcgcatgcgtcaattgcaaccgggttccacgcgttttgcgcaccgtagcacagtcccggcacgctcaaccgcggatcattgacatgcccatagtcaccccaatcggtgaccaccatgccttccgcaccatatttgagcccagccaccgccatgcggtacgtgttcagccaggcaccgtcatagtcggggaagaaccggctccacgcacgcacggcagggcacacgaattggcggcggccttgtgatgcgatggtctggatcttgctttcgtcgatatccggctcatacatccagttgagcatcgtgatgtcgccgggcagcaagtccatggtgtgcggattctcgagcgcgatatccgcccacagcatcggttgtagaccacgatgggcaagcgtgctgcataggtctttgacgaaatcggcatacagctcatcgcgactggcgcccggcgagtcctgtacggaccggccacggcccaagtcgaaagtctcatcgccaccaatattgaaggactgcgagcggaacagcggcgcgtattcctcgattaggcgcgaggcgaaatcgtgcgacttggggttggctgcgttcagtgtgtggtgttccattcgttcgatgaaactgaacggacggtcggcgtcttcggggaactctcccagtccacgatgttcacgggtgcgcaggttcatatacatgtgcccgaaagtggccaaggacggcaccagttcgatgccgtggtgtgcgcagtattcgtccaggaacatgatgtcgtcggccgtgagcgggtcagtgccgcgccacgcttcgctgagctcgccgaaagcgaaggcatgttccacgtacagctggaattggttgtacttatacaacgccagctggtcgatgaaccaggtgaggaacgccatcgtcggcacacgcccgcgcgtcacgtcaagactgtaggcgcgcaccgcgaacgcaggcttgtcttggatatgcaggcagggcaaggtccgcgaggtttgcctgatcatctgccgcagtgtctgcatgccgtaccgcaatccgctttcgctgccaccacgcacggcgatggtatctgaggcgaacacatccagcgtgtattcgtcatgcgccaatcgcgcatccacacacagcaatatgacggtgccgttcatcgctgccggcgcacccgcgcccgcacccgcacccacgcccgcatctcgcgctttttcggcggcattggcaccggcgtcggcttcatctgtggctgtgagtactcggtgcgtacggacggcgacgccgcagtaacgctcgagttcgctggacagctgctcgattggcagcgtttcccaggtctcatcggcatcttcggtgacggcatattcgggaattcgtttctcgatcgtcaccaaggacccgatcatagccgtgccatgcgtgtattccaatgtcaccggagcgggaatcagggtgagacacggcgttgcggcatcagccttatattcgaatgtgggcacagctgttcctttcatactgtttttattatcgttcatccgctgacggcaggcgacacgcggtcacgccgccatcagcggacgaatcgtttggtgaggtacggcggcatacgctatttcacggcaccggtcgtcacacccttcatgatgttgcgctggatgagcatgaagaacaccaccaccggcaacgagaaggtcaccgaagcggccatctgcccgccgaaatcggtgcccatggtgggtgtcgagaaggacgacagccataccggcagcgtgtacttcgactggtccttcatgaacgtataggcgatcatgtagtcgttccaggcgttgatgaacgcgaacaccgaggtcgagacgatgccgggcgcggccagcgggaaggtgatcttccacaggatctgccagtcgttcgcgccttccacggccgcggattcgaagatgtccttcgggatgttcaggaagaacccgcgcatgttccagatcgcgaacggcagcaccatggcgatgtacgccaggatcaggccgctgtatttgttgagcaggccgagctggttgtagatgatgatctgcgggatgatgccgccagaggtcatctggatggccagcacgaacaccatgatcggcttgcgcccgcggaagcggtacagggtcagggccgtgcacgcgaagaacgcgacaataatcgacaggacgatcgagaggtgcatgggccagaacacgggggtcgtggtcatgatctcatcgcgcggctttacggcggtgataatcatccagtagaccgggaagaaccatacgacgcagaacagcagggcgaggatagtggtgccggcgcggcgcgcgatcttgccggggttggttcggcggcggggcggtgcagactgcgctgcgccatgcgatacggcccgtggattctcaacacatttcataaggacgacccgctatttcagggattcgccaatatcagcgtgccagtcgccatttccggcgtcggctatggcagcgccaccccttccccaccgtcgacatcgacaaccgactcgcttcacgcaagctcaccgagcatatgttggggcgcgggtatcgacgaatcgcctatatcatcggaccgtcgtacttgccgacgtcgacgccgacgccagcgtgcccgcagctgaccaccgtgcgccagccaatggacgcattcggcgtcagcttggctaccctagtgcttgaccagatcgaggaccggccgttccagcgcacggggctcctgcccaccgaggtcgtagccagataggcgcgcagagaacggttctcaataatgtctgtgcacacttctctacgcccgaagcacacatggaatatgccctaatcactgccatgtcgccatttgcgatgatgtgagattgttatgttcttgttcatttgagcgcacagatactactgagaaccgttctctgcgcaaatagacaatgtggataactccataagctggaaccacattgccctgcctggcttgcattcaagtccaaatcagctttacggtcgcaccatgagctcttttatgcatgaggatattgtcggccgacgccgagcagaacgtgaacgctgcaatgatgctgcgcgccgttcgaaaggtccattgctggtgggatacatcaatgcggccaactactacggcgcgcccatcccccgacattgcacgctatctgttgatgccgtgcacgcctgtgtttccagtgccaacaaacgcagacgaatcaaaggcgtggtcttccatgtgtttaagggaaaactggatatccgcaaaaaggattatgaacagttctggattgcctcgccggtcatgatgtgggctcagatggcccaatactctacattggaggaacttgcggccattggagcctctttgatgagccgcgataaacggcgcagaatggccactcgcaaggatttcgatacttacttggaaatcagtccgcggttcataggtcgtaacaaatgccacgaggcactgccctacatgacagagaacacggattctccgccggaaaacacgctgtttgggatgctgaaggattcaggcttgggatgccccaccgccaactatcgcgtgaatatcggcaactcatacgtcatattggatatggcatatccggactgccgcgtcgcgttcgaatatcagggagcctatcacgccgatccggcacaaatgcgaatcgacgcggcaaagcgaaacgcattgcaactgctcggctggatcgtcattctcgtcactgcggatgacctgagaacagccgacacgcggcatcgttttatcgagatggcccatgtcgtggtgtcccggcaacgcaatctcgccgattggaaccgctcatgggccattacctcttagcatcgcaccgacaatgcgctatgccgttatttactgcgaggcacccgccagatatcgggctcaacgtagatctcccattcataccaaggcagcgcggcacggcgtcctcgtccatgtgaatggcctgcaggttaatgagcctatccacgccggcagtgcgctccattgcctcgaccaccaggtcgcaggtgctgtggtcaagcgattcgcccaccagcagcgaaccggacttaaacgccagcgccgcctacaaaagtgtgaggctgcgcaggctcacactgccaacagccgttcagccaaccctcggaaggtctggccaatgccatccgtacgcaaagcgccgtcggcgtccagcaccgccggccggccggcctcgccggtctcgcgcacttcgggttccagcggcagctgggccatcagcggcacgtcatagcccagcgcctgagtgagctgttcagacacgcgctgaccgccgccggcaccgaaaatctccagcttctcgcccttgtgctcgtagtagctcatgttctccaccacgccacgcaccttcatcggcacctgcagggccacgagtccggagcgcacggcgatgtcagaggcggagggctgcggggtggtgaccaccacaagttcggcgttgggcagcgcctgggccacggaaatcgccatgtcgccggtgccgggagacaagtcgagcaagaggacgtccggctcgccccaccatacgtcagacaggaactgttccaaggagcgctgcagtcgcggcccacgccacagaatcgcccggtcagcaccggcgaacatgccgatggagatcagtttcacgccccacgcggtgaccggcatgagcatgccattcagattggtgggctgtgtatgcacgccgaacaggcgcggcagtgagaagccataaatgtccgcgtcgatggcggccgtgtcgaagccgagggccgcaaacgtggcggccaggttcgcggtaaccgaggacttgccgacgccgcccttaccggaggcgatggcgaagatgcgggtcttgacacccggtttgctgaaggggttctgcttgcgttcggccttgaggtcggcgaccagatcggccagcttgtcacggctcatcgaaccgacttcgatatgaggcagcagctgtgctcccggataggagctgacctcgccattgatctggctggtgatggtctcgctcagtgggcatccgggaaccgtcagctcaacgtgcacggtgacgtcgtaagtgccggcgtccgacgatgcgggcgcggcttcgatggcggcaatcatgccgaggtcggtgaccgaacgaccgagctcggggtcgatgaccttgctcaggcgttcgtagatgtcggcttcgatctgacgtgcgtcgctcataaatccgtatcctcctttagggcctgttctaccctagcgtgtgatgcggcggcatgccagagggagtggagtaagtcacactggggcgggattcgctttttctctcccccagtcagcctaaaggctgacagcccccctcatcagagggggttaatgaagcgtctgagggggctattttagatggtgccggtggctaggagctgggcgaattgggtttcgctcagcatggggatgccgagttcctcggccttggcggccttggagccggcgtttgcgccaatcaccacgtaatcggtcttcttgctcaccgaaccggccgccttgccgccgcgctcgataatcgcctctttggcggaatcacgcgaatagccctccaatgaaccggtgaccaccacggttttgccggccagcgtctgcggcaacgaactggtctcggcctcgtcgacgcccacgccggcggcctgccaagcacgcaaagtcgcgccgcgccagtcaccgggttcgcgggtggcggcgaaccagttcaccaccgattcggcgatttccgggcccaccccgtcgatggccgtcagatcttcaatcgtggcgttttcgatggctgccagcgagcccatcgccgaggcaatcaggcgtgcggtaggcggaccgagccggcgaatcgacaacgcgaccagcacacgccacaggtcggcgtgacgggccttgtccatttcgtcgaacatcttgcgcgtgttttcgccgggccgaatgatcaccggtacatccgtgacgccagtgcgcgtggtcttgtgatccacgcgcacgataaccgcgtcggccggcacgtcatactcaggataggaggctgcggcaaagcccggcatagtaccaagtggcgcctcagccccggtaggtgcgccggtcgtctcgctggcggtacctccctgtgtttcggcagattcgattgcggtctccccttgcgcgcgttcggccagctgcttggccgtgagctttttggccggcgtgggcgcggtccagaaagcaggcacctgatgccacaggccagagccgccgacacgcttacgcacctttttcttcttaccgttcgcaccgaccgtctcatgcacctcgacgattgcggcctcacgccacacgcgcacgtcgcgcagatcggcggcggtcaggttgaacaacccggattcgttagacaacaccggcttctgcgcggccggcaattccagcccttccaccggctcgtacgggtcaggctcttcgccgggggcgaccagaacctcggtgatgttcggcgcgtaggtcgccaccgaatcaggccggttctcctccgggttggtcagagcgatggccgattgttcgcccaagtgctcgatgtcgaacgccttgcgtgaggccagcgaaatcacgcgctcggtcaactgggccgggcagctctccacattcgggcagcgaatgtccttgtcaccctccttggcgggtgacagtttcgcgccgcatgaagggcagaactcgggcatgacgaattcgcgcagctggtcctcacgccctttgcgccgttcaagcaccgggccgaccagttcgggaatcacatcgccggccttgcgcaccaccacggtgtcgccgatcagaatgcccttgcgtttgacttcaaatccattgtgcagcgtggtacgagccacggtggagccggccacgtagacaggtttgagcacggcgaccggcgtcacacggccggtacgccccacctgcacggtgatgttgagcagttcggtgttgacctcttcgggcgggtatttgtaggcgatggcccagcgcggcgcgcgcgaagtggcgccgagggtacgctgcaggcccaggtcatcgaccttgacgacgatgccgtcaagtgcatgctcgatgtcgccacgatgctcgccgtagtactcgatcatgtccaggatctcctggaatgaggtcaccgcacgattgtgcggggagaccggcacgccccacttggtgtatagatcgtaggcctgcgactggtcggcgaccacgtcatgggtgccgcgcggatggtccggcccccaagtgagctgccccagaccatgcgcatagaagctcaggcgacgggtggcggtgatgcgagggtctttttgacgcagcgagccggcagccgcgttgcgtgggttggcgaagggcgctcgtccggcgtcctcctgctcgttgttcagggtgtggaaatcatcccaacgcatgaacacttcgcctcggatttccacgaagtccggaacgtcttccttggggccgccgaggtttgcgggaatggagccgatggttcgcacattcagggtgatgtcttcgccggtaacgccatcgccgcgcgtcaggccctgttcaagcacgccgttgcgatagatgaggttcagggcgaggccgtcgattttgacctcgcagctcatgggcaggggcttggattcgggccaatcgaggtcgcgaatcaccgagtcgtaccaatccttgagttcttcgatggagaagacgtcgtcaaggctcatcatgcggctggggtggcgcacggaggcgaagtcgttggagaaggaaccgccgacgcgatgggtgggcgactgcggattgtccagtgaggggaacgccgcttcgagtcgttcgaggcaacgcatgcgcgcatcgtaagcggcgtcggagctgacgggtgagtcgtcgatgtagtaggcgatctgatcggattccacccatgcggccacgcgagcccacaggcgggcggcggcctcagcggtcatcgtgttcacgtcgaaacggtcgaggcgtatcgcgtcgtcgtcagtgggctgcagtgcggctatccattgttcggagccaggggcaaaacgtgcaataccggtatcaggccggacctcggccacatccccatcgtcgaaatcccatgccagttgttcgttcgtgctcatggttgtctatcctagcgggctcggctcccctcggccggctataccgtcaactcccctcaggcggctacgcggatagcgagcgcaggaactgggcttggatgatgtcgatgttatcgccttcgccgtcattcatgcgggccacagccaccgagagcgtgcgggccggcacgaacatgccctcatccacgcacacgcgagcggcgtcacgcacgatgtcagccacttcgatatgcggccagaccggcagatcatgcgtggcaagcacatgggcggcggcctccaccgattcaggcaccggtatgcactgcgagtccgcacgggaaaccagttcctgcagttcgctttccagcgaaccaatggccccgggagcgatgtgatcgctcataatgtaggctgcggcggctgtgtcgaaccggtcgagcatccattcggcgtacgcgaaccggtagtaggcgaacgcggcatcgtcgcggtccaaggccacgcgcagagcattcaggcaggcggcgcgtgccgaatcccaatcctcattgcgggccagttgaatggcgagcttcagatgtgagagcgggtaggcgggcgcgtacgccaccatacggttgagatgcgggatcgccgcctcggcacccttgatctgactcaacacgtcagccagctccatgtgcgcgtagaacagattgtccgggataagcaccgtacgctcgtccaatgtggcgaacagccggttgtagaccacgcgctcggcataggaattgaagtatcgaggtacgccatggcctgccgcatacacctggtccaaatgggccacggccgcttcggccgcttcgatggcctgatcggcttggcccgagaacagcatgtctcgggcgcgcagacgctccttgtcaagatcgtcggcaagcgtgaacgtgaagtccggcgtgtccttgccatcgatcaacgcactggtgacctgagaggccaaatcggtcagttcgggatcgcatatcgattcgatgacctgcatggctcgctgggccttttccacggagccgagcgacgtgttcctggcgatatcgtggaattcgttgacgccatgctgcagcaggtccactcgctggatagccagtccggcactattctgtgcgcccagcacgtgagcggtcgccgggctgaattgacggtcggccagttcgggctcctcctgggatccggtgggagagaaccggctgtccgccaagtcgaagtcggcgctgatgggtttcagaccaccttcgccgtccacgtccatcacggcaccgaacatgcggtaggtttcctcgggattgtcaagcccagcggtgtccagtcgcttgaggaaggcatcacgggtgaaggtgacggtgaccatattgcgcacggtgggattgcggcgcagcacgctcatcggatcatcgtccatgccggcggccccatcagcaccgtcagtgccgacgccctcgccgccgataccgcccaggtcgtcgcctgcgccggtatcgtccggcatgccgaacgccatttcgtcgatatcgatgcccttcatcaggtcttcgaactgcgaatcgatggacgcagcgccatcggcgtcagcgtattcggccgcggcctgatccgtagcatccgcagacggtccggtaccgttgcctgctcccccggccgtgccgcgttcgtcaccggacgccgtctgcccgaacgtctcctcatgggtgatggggcgggtcgggtcgccatggaaatcaccatctttggggtcggctttggaacccacacgccccaaatcgccactgcgtagatgttcgaaggcgcttagggcctcgctcatcatcgcctcgatggcggaatcctgttcggcaatcgcctcttcaagaccaatggaatcgatgtgcaacgacacctggcgcacggattcgctggtgccgaaacttagcgcggccatcatcaggccgacacgcaggttgtaggcggcgctcattgacgcgcgttcgacgctactcagcgcacgccacgtacgtcgagtggtgtcataccggctatcgggcatcatcgaggtgccggcggtggtgaagccaatggccacttcacccgaatccaagcgcgaccggaactccacgtcaaaccgatacggcaaccgtaaccggcgcaacagtgaagagagggtctgacgatacacccattcgtcgctcctcgccggcgaatacgaaggacgagcggcttgagtgttggtgtcgctcttatcggtccgttctacagcgccctcagcactctcagtactttcagcgcccgcagcattcgtcacacccgaatccggcacgttctgctgggtcagcacatctcgaggatcggggaattcactgcgaatctgtccagccgtgcgtgcggcgatatcgaccaggctcagcacggcccgacgctcctgctcgccatcatacgggtcaagcgccataatcgcagggttttcgatgagtttcatgtcgatttgcgcggcctcggcacgggtcaccgtatcttccgtagggttgcgtcccaaggaagcgttgcgctccaaccaagcgctcaccgcagcgaatcggttgaggttgccttcgatcttcaaggatttcagcgcctgcccgaatgccaaggacttatcccacgtaaagaaatagccgctcgaatacgtcgaggtgtacaggtgcaatggttcggcgccatgcaccgcttccagtcccggcgtggtgtcgagagcgccggcttcgcgcatcagatcggcgaaatgatcctccagaccggaggcccgcatgccgtgggcacgtgccgccaaagtgtcacgcaccgaacggcgaatcgcaccgattggcgcctcacggttgagacggcggaagatattgccggaaccgaatccgatgagcagaccattgatctgcggcaacatatacgtggcgaagaacgcgatggtaatggcatcgcggtattccaaatcatgacgcatcgcaggcggcagattggcacgcatctgctcaagcgtgtaccggttgccggccttgagccatgaggcgagccacgtcatgcgtccggtgtcgtcacgccccaccacgccaccggtaatggccttcacaccgtcagcaccatgaccaaggccacgccccaaaccacgcccatgatgcagcgcacttcccaggccacggtctgtacgggagaaaccggaacgtgaacgaggctcgtcgctttcgcccagccgctcaccgtccggcaatgtcacttctttttccttgccgaacataaatcgcgcctgcatatcctgcacgtccatgtcggggtcggtgcccacgaatacgcggccatgcgtatcggcgaacgccacctgcgcaaaatgatcgcggtcggggaaaatgccaagcgagaagccgcggcctctggtggagggcagctgcgcccatccaagcaccagcccttccggcacgttctccaattcggggaaggtgcgtcgcttgattacaggactcagcgccactgcatggcgagtcagttcgtcgataatgccgcctttacgctcactggtctcctgcaaggcatcgccgaacggattcgtatcgtgcttcttcggcttggacagtcccagatcggccgcgagcgcgttcatcgaatccttcagcccgcccagcagtggcgtgcggttgtgcttcccatggtccgatgtacgttttggcatgattcacattgtctcttgtttgcccgacatcaagcccgaataaagcctatagaataaatgcgtgcattccatagaccacactcgcgcagaccgtccgatgccgtcgaatcatgaacggcacctgcccagccgcccggatacccggcaccggctgcgtttggtgcgcctgctgatcgccttgctggccgccgtcgccgccatcgccgccatggagtgcatcgtgttcaacctgccgttctggcgtacgctcggagcgagcacggatacgaacgccgtgcataacacgctgggttcgggtctcacgcgccggaatgatggcatgttgaccgtcaccgatccgaccaaggcctatcttgaactgaccgcggacggcacgtcggattacctacgcatcgataccgagagcagcaaggtcatcgataaggcccgcgagcaggccgaggccgaatccaaagcgaacgacgataaggaagtcttcaaaccgctggcgaccattcatgtgcgcgcggatgtcgatggcatcaccggcaaggcccagtcgatgaatcccgacgctattcgcagccattatgtcaaggcgccgggtgccggcatcgtgcgtatttggattcaggaagagcgcggcgcgatcgtaccggtcaccgacgcccgcgccaacgtgcgcgtaccgttcgtcatcaattggatgcgcgtgctcgccatggccttggtgttgctgatgattgccgtctggaggccgggatcgcgcctgtggcgtatcacgcttgacccgtccagcactcggcaacgacttgctttcgtggggcttctggcgattcctaccctgcttatcggcgtatccatcatccacgaactgtggtacacgtcttcgctcgtcttccacgtttccggcgattacacctatgatttcgaccagtatgggcatgtggccgatgcgctggtcgccggccggccctggctcgacttgccggttcccgaacagctggccgccaccgagcacccctatgacgtagccacacgtgcccagctactcgccaatggagccagtccgctctactgggattacgcgtattatgacggtcactggtattcctattttggcgtgttgcccgcagtgctgctgttcgtcccctatcgtctgctggccggtcataatctgccgacatccgccgccgagtatattctcgtgctgctgttcatcatcttcttctccttgctggtgctgcgcgtcatccatcgtgtgatgccgaagacttcggtggcggccgcgtcgttagtagtggtctcatcgttggtgagcgcgcaaatggggtatttgctgtatcgcacgaacttctatcagataccgttcgccgcatcgctgacgttgacgtcgctgggactatggctatggctcggcgcggacacgtcccgccgtccgctgagaccatcggaccgatggcaggcgggcgatgccaagcctctctccctgccacgactggccttgggcgccttgtgcattgcggcgaatttcggatgccgaccgacgttcaccttggccgcattgcttgcgttccccctgttctggccgcagattcgcgcgctgggcaccggtctgcgcacacgccgcatcaagccgttgcaggcgttgcgcgcgccgctggcggtaatcattcccgccattctcgtcgtgacgcctctgatggcgtggaacatggttcggttcgattccccgttcaatttcggcaatgcgtatcagttctccatatccgatatgacccggtataccaccccgtccgcggatatgcccgccaacatctggtattacctgttcctgccgctgcgcttcatggatcgtttcccgtggctggcgggctctcccgccccgatgccgcaatggggttattacgaggtgatggtcggcgcgattttcacggccacgccactgaccttgatggctttggcgctgcccctgctgcgcagattggaaacacacggcatgcggccatggctgatgtcttgcttggccgtggcggcggtgctggtcgtattcgacagccgcgtcggcggtttgggatggcggtattccgccgatttcggctggctgatctcgctggcgtccataccggggctactgtggctggtcaatgggcgcgaaccgagccgctcattggcgggggccaacgacgccgcttcaggcgatggcatcgcccgcgtcactccgtggcgttggctgatgcgctgggtcgtgatgctggccgtattgtgggcgctgggcatagccatactaagttgcttcgtgcagtcgcgcagcgattcgatgatcgccaacaatccgacgctctggcatcaggttcagtcttggttcaccctgctataggaccggaccgctcggcgacccgccaagcttcagtattctcccagcattccggccggtgttttccaagacctgcggcataatgtatgtgacgtaattcactaatcgtttacccatactgtcgtgagggtttccccgtgtccactgccgtccgtagtcgcgtcttcaaaatatccgcagcagccgtcaccgcagccatcgccattggtctgtgcctgttctcacaggacgacgtcagcgcctccatcaaggaacgccgcgtggagcggctcaacgcccagatcgagaacgtctataccgacgaataccagcagatgatggacaccgagatcgccgacgagcgcgacgccaaagaacgcacagtcgacagcatctacaccaaggtgaacccgtacggcaccaacaccacgtccatgtacgtgtacttcaccaccgatcaggcctccaccgtcagctacaccgtttccgctgaggggtacccggattacacggccaacgccatcaccagcgatgaggcggccgccgcataccgtgaggccgccgccggcgacgccgacggttccggcaatgtcggcggtaccagcacggcgagtcagacgaccacggtatcgagcaatgacatcgcctccaccgagcacgagtttctggtgttgggactgatccccaaggtcaagaacaccattaccctgaccatcaccgacaccgacggcaacgccaccacgcgcaccatcgagcagaccggcccgaaactgctcggcgaggaggaagtacggctcgaacaggccgtcgcccccgacgaatccacggtcaccacgctcggcaatggcctgtatgcgattctcggcaatgattccaacgagcaggatttcatgtactactatgacgcgaacggtgtgattcgcggcgaaatcccggtgctctactaccgctcgcaccgtctgctgttcgacaatgacggcatcatgtggttctccgcctccaccaagcatttcgtcggcatgagccgcctaggcaagctggtcaagatcatcaatctgggcgaccagtacatcctgcaccatgattacgcgctggattccgacggcaatatcgtctctctggccaccgatctgaaacattcggaccatgccgtgcaggatcaggtcatcaaggtggacaccgactccggcgaggtgagcctgctggtggatttcggcgacctgttccccgattacaagcaatccaccgatcattccggcatcgacgaatccgatccgaccgccacgaaccgttgggactggatccacttcaacaccatccagctcatggatgatggctccgcgttgctgtccgcacgtgagacctccacgatgatcaagatcaatgacatcgaaggcacgccgtcgctcgactacatgatcggcgagccgagcgtatggaatggcatggatgcgcagccctccttcctgaccaaggtgggcgattccggcgacaccggcggccagcactcaatcactgtgcagtacgattcctcgctggaggacggccagtactacatctacatgttcgataacgacttcggttatgccatgacccgtcctgatttcgattggaccatgatcgatggcatttcgaccgcgcagagctccaaggatgagaactcgaactcccagttccgcaagtacctggtcgacgagaacgccggaacctacaccgaagtgcaggacttcgatgtgccgtattcgccgtatgtctcctccgcacaggaactgtccgatgacctgaacctggtggacatcggcatgcagggcctgttcggcgtctacgatgacgacggcaacctcaaggcacagtacaagatggtgctcagttcgggatacatctaccgcgtctaccagtacggcttccgcggcttctacttcgcgtgaggattggcatcgacctcacggccgatgccaatcctccaacggccgattcctatctgctaccgcttcgcagcctcatacttgcggcgaatcagatcctcataaaacgccacagcctcagccggcgctccgtcaaacgcgaccgcgtgctcgtccagcaccagtacgcggtcgatggcgtattcgggccggcggatcatatccgtgtcatgcgtggcgaaaatcacctgcttgttgtagctgaacaacgccttggccacatgcgcggcgccaatctcatccaatcccttgctcggctcatccgccacaatcgcactcggctcaaagctcagcgcggccgcaatagccagcaggtgccgtttctcggagtccagttcgctggccttggccttggagacctgcgccaaatcaaaatgcgcgaacagattgccgatgcgcgcatgacgttctgactcgggcaccttgtgctttttcagcgcttcggaaacagcctcggaaatattcgccgcttggtaaaagctgttcggaatctcctcgcggcgaactttgccgaccagattatcgatgcgcttcgcgtccttcttcacagccgggtcaagacgttcctcaccgcccgcaatggtcaccgtgccggcgttggccttcaacgaaccgtccagcagacccagcaatgtggatttgcctgcgccgttcagtccgatcacagccacccgcagctcgctgatggtgatgtccgtgggagcaagtcccacgtgcccatcatcatacgtatgcccggcctgatccaaagtgaacgtcagcgacgccgggcgtggcagttctttcggtctaaacaagaatcccatgccgctattgtacgtggagtacaggcgtggtgccggcaaacaccggcctatcgcagcaaagcggcgacggtattgagcacggcgcggatgccacgctcgaattcgtccggttcgggtagcagggaaacggccaggtatccattggaagtcatgtcgaagaagtagccgggctgtccggtcagtttgtgctcgtcaatcaaccgcagcaccagctcgttctcatcgatgactgaaggcactcgtagcagcacgttccagccgccttcggcccgtagcacgctgaccagcccgttgggatcggcgtcaagcaactcgtgcaacttggccaggttattgcgcacgcgctcccccacccgtctggtctgtgcgggcgcggcgttcaataatgcgggaatccgttcggcgatgatgtcactcatcggcagataatcatcggcgataacgtccagtcgacgctgtgcctcggcaacgtcctcggcaggtccggacacctgaatccacccgactttggcgtgcggcgcggccagcattttggagaatccgtctagggcgaaggtgagcacgccgcgctcccccgcgagccgtgcgttgccggggaaaggttcgagagagtaatcgaagaacacttcatcggcgataagggcgatgccatgctcacggcacaatgtcacgatacgtgcacgctcggttggttttacgtacgaaccggtcggattgttcgggttgatgagcaccaatgctctgatgcgttcgccaccgggctcgctgagcagccgctcgagttcggcgatgtcgatgaaccaggagccgtcgaattgcaactggtattcgaccgtgtcaacgcattcaagccgtgcaatcgactcaatcagcggatagccgggtttgggtgccagcaccgcgtcgccggcatcgcaaagtaacttaatcagccacgaatacgcctcggacgtggagctcagcaagtacagggcgtccgggtcaacgccctcgatggcggtattcgcattgttgaaagcggcatggcgctcgttcccgccctcgctggcggcgggcgaagtcgactgagggctgcttgcgtctaccgcctttgccgtattgaggaatgcggccaatgcttctcgcgccgcacgcggtccacgcgggtcggccgtatacacgctcggcaccaattcaggtgccagcccgtggcgggtcggattggaatcgttgagtttgctgagtgcgatgccgtttgccttggctgccgcctcggccgccgcaatgggattcggcgcagaaatatccacacgagaagagaaatgcacgctcataccctcccacgatagagcgtggtgccccctgccccgctctcaaacgcgcaacattcccggaaatgcgtcgctctggacccgaatcacaccctcaaacgcgacacattcccgggaacgcgtcgccacagacctccatacacacgcccactttgcgcaacattcccgggaacgcgtcgcatacctttcctatgcaatgcaaaaggccgcccgactagtcggacggcctgaagcatattcgcgggtcagcgctgcacacccacgctcactggctcactgctgcttggtgctggcatagtaggcggcaccgacgatgccggcctggttacgcagcttggcgggcacgatcggggtcttgatatccacgtacggcaggaacttttcgctctgacggctcacgccgccgccgacggtgaacaggtccgggttgaagtacttctccataaggccgtagtacttggtcagacgcttggcccacttcttgtagcccagttcctcattctcgcgaatcgcggaggaggcatacttctcggcgtccagatgcttggcgctcaggatgatgtgtccgagttcggtgttcgggatgagcacgccgttgtaaatcaaggcggtgccgatgccggtgcccagtgtggtggcgatgaccagaccatcctggcccttggcggcaccgaactggacttcggccaggccggcggcgtcggcgtcgtttaccacgacgaccgggcggccgcaggcttcggagaacacttcagtaacgtccacgccaatccaagactggtcaaggttggccatgaagtcgagcttctggccgggcttgatcggcgcggggaaagcgatgccaacgggtgcggattcaggcacttcgaagtggtcgagctgctgcttgacgattttggccacggcctgaggagtggagacctcgggagtgagaatcttcaatcgtggctcggcgaaatcgcccttggtcagatcgacaggtgcggccttgatgccggaaccgccaatgtcaacaccgaaagcctgtgcagtttcaatcatcgttgaccttcctttccatacgttttcatcagttcgtaaggttgcgcccagtttaacgcgaattacgctcaacacgaaaccattacacaccaattgtgcaaacgtgtgcatcgtcgccggtcactacgtaccctattcgtatcgtttttcaagcctgacaatgggcaatgcatgcgatttcgcatactaggaaaaatcggcgtctatggtggcctgactctgtgtcgcgcgcgataatgggaggtatggcagaacatacccaacttattgatgcaattaacatccgcaccgccgtacgcgcctacgatgatgagccgatcgacgacgatacggcccgccagctcgagatggcgcttcagccgatcaacttactcggcgatctcaacattcagctggtgcgcgaccagcccaaggtgttcgccgaagccaatgcttcaggtcatctgaccaatgcggcgaattatctggccatcgtcggccccgcgaacgatgaggaagccaaagagcgtgccggcttctatgccgaacgcatggtgctcacggccacgttgcgcggcctcggcaccttatgggtcgccggctcatgggacaaggcggaggcggccaagcattgccgcgtcacctctggccaggagctgtatctcggtgtggtgatcgggcatccgaagaatcatctggattatcaggcgaaatcctatgaggagctatgcgaagcgcaacgcacgcaccgcgccaccaagacctatgagcagttcaccgccacaatgagcgatgaggggcgcgaggccgctccggattggttcaagtccggcgtcgaggctgcgatgaaggcgccgagcgcgatgaaccgtcagccaatcaccttctcgtataatccggccgacgataccgccgccgcgcatatcgatcagagtgcggaagatgagcatcacgcgttcaatgacatgggcatcgccaagctgcacttccagatcggtgccggccaaggccagtgggcttggggcgacggtggcctgttcatccataagtaacctgtagtgacccccctcatagaggggagccactactacggctacttcagcgacggcatgagcttccaggtggggtcgtgcatcagcttgcgcgagtcccaccagcccttggcaatctgtaccaaaccggtcttgaggtgctcgcgatccaccatcaccaggcgaatgacttccttggccgcggtgagcacggtacccagtccaaacaccagcggacggaagtcaccataggtcatgaagtaccgggccatgtatccgcggttgcgcatgatgtgataccggttcatgtcggatgtggagttgagctggcgcacgccggcgatatcccaattgccgatttcgcgcgtacggcgcaggatcacgtcgggcaccacaatcgggttggtgaccttgctggcgcggtagccatacatcgtgtcatcccagtagatgaagaagcgcgggtccggcagaccgatttccgtaaccacacggcggttgaacaggccgccttcgaagcacagcgtgtccatcactcggtatccggccgggccgaatgcggcgggcgcaatcgggttcgggatgcccagcggcacaatgaagtcgtactgccagtagaacgggccgccatcgtagtcgaatcgggagccctgaatcacctcgtgcttgtcggtccacttggacagcttggcaatggcgtccggcagcacggccacatcgtcatccatcacccagaaccatgcggcacccagctcgtaggctttggccacgccggcggagaaaccgcccgcaccacccaggttctcggtctgcggcgcatagaccacacgttcttcgttaccggactggtcggccacggtggtgccccattggccggtcaccttgccggcaaacgcagcgaccatgtccgccgtctgatcggactgctcattgtccacgatgacaatgcgccacggtgcctgttcaagcgccagaatcgaatcgaacagtgtctcaagcaactgctgacgtttgtaggtggtgacgatcagggcaagcttgtcgatggtgttgttgggtttcttcacttcagccatggctcccattgttgcacttgaccggcacaagacgaatttctgcacagtgaaacgcgggttgcatacgtccggcgcatggcgtatgaataagcctgtcagtttcagggaaggtgcaattccttactggcggtaacctgcaccccgggtttcataacggggatggcaggaagcccgcgacccgcgcaagcggctgatccggtgagattccggagccaacggtatagtccggatggaagaaacgagggctcattatgagtgtatcttcgcgtattcgcatgcaagttgttcgttctgtggcacccgaggccgagggttcggccagcacgtccaccgccagcaccagcgccaaacttggctcacacaccactggtgtggccgattctggccgctggtccacgcgccgtatcgccatgtatgcactgttcgtggcgctggcgatggtcaccagcttcattgaattcccgattacgccggtcacttggctgaagtacgacccgtccggcatcgtctgcctgattgccggctttgcgtatggcccggccgccgccgcaatcgtgtctgtgctcggctttgtgccgcacatgttcgccaatccgtggggttcgctgatggctgtgctggtggcgctgttcctgtctgtgccggccgcgttcatctaccgtaagatccgtacgcgcaagggtgccgccatcggcattctggtgggtgcggtgctggccatcgtggtggcgctggtgagcaacctgattgtcacgccgatttacgcgcacatgacctaccaagctgtggccgcgatgattctgccgattctgctgccgttcaacgtggctaagatggcgattcacgccgtgatcaccttcctgatctacaagccgatctccaacctgctgtccaagcagcagtgactggcctgagacgggccgatgcccgccacgactaacgaccactcaaagaccactcaaagaaccagaacgcagaatcccggcacgggccgggattctgcgttttcgcctatcagttacggattgctgtttcatgaccgttgcaccccattccttcgacgccgacgagttccacgattctgccgaacctcacgcttccgccgagcctgcctcccccgccgccgtgctcaaggacattcgtttcagctatgaccgcggcacctcatgggctttggatggcgtttcactcacggtccatgccggcgagcgcctatgcttggtcggtccgaacgggtcgggcaaatccacgttagcccgtctgattgcgggattgaccgcgccggacggtggtgaagtgacgttactggggcaacgcgtgtacgcagccggcccgaatgccgatgcctatcgtgctgcccgccacggcatcggtatggtgttccagaatcccgaggatcagctggtcaccaccgtgttggaggatgacgtggcctttggcccggagaatctcgggctggagcgcgagctcatcggcgagcgtatcgttgattcattgcaggccgtggggttggcgaacttacgccagtccgacccgacccgtatgagcggcgggcagcagcaacgcgcctccatcgccggcatgctggccatgaacccggcaatgctggtattggatgagccgaccgccatgctggacgaatccgcacgcgccgaagttatgcgcattttggatgatttgcaggcgcgcggcaccactattgtgcatgtcacgcatcatccagatgaaaccgttcatgccgatcgcatcgtgcacatggaggccgggcgaatcattggtatcactgcagccgtcgataatcgatccccgctagcggaggctgtctcgcaaagcgagactgagggtagtatcggcacagaagccgcccccagtcgccctacgaacgacagcccccgccagcgggagcgcgaagacggctccgaactgccgctgctctccgatggcatcggtgatatgacgaaccccattattcgcgtctcgcatctgacctatcgctatccttcggccaaacgggcggttatcgatgacctgtcgttcaccatcgcgcgcggtgaaaccgtggcactgatgggcgtgaatggttcgggcaagtcgacgctggtgcgcatgttgtgtgcactgactgcgccgaccgccggcagcatcgaagtggccggtgttccggtggcctcgaccggcaagcgcggtcgcaacgtgcgcccgaagtcggcgaatcgcaagcaattagcgcaattgcgccggcatgtgggttacgtgatgcagcatccagagcatcagctgttcgctgacacggtagccgaggacgtggcgtacggcccacgcaaccaagggcttggcgagaccgaggtagccgaccgcgtgcgcgaatcactggaactgctgcatatcgggcatcttgccgaccgctcccccttcgacctgtccggcgggcaacaacgattggcagccattgccggcgtgctggcttgcaatcctgacgtgctcatcatggacgagccgaccgcgagtctggacgcccaagccaagaagcgtatccatgagctgttgcgcacgctcaaatcgcgtggcgtgaccgtgctcatcatcacccatgaccgggaggaggccgagcaaatcgccgaccgcgtggtccgtatgccgattgccgcccccgcatccggcggccccgtcacggccaccgtcaccgagccggccgtatcctccaacggccctgcgcactcagtgatacaccgacttgacccgcgcgtgaagatggtgggcttcctggccgccatgttcacgatgttcgcggtgaacacgccaacccagctcgcgctgggcatcgccatcaccctggccgttatcgcggcggcacgcctgaacccgttacgggtgcttgaatccattcatccgattctgatcctgctggtgctgatgggcgtggtcaatctgtttgtggtacgcaccggcacgccggtggtggcgcttggcccgctaagcatcaccgatcagggcgtgaccatagccgtgctgtacgcctgccgtttcgcattggtaatcattctgggcgcggtgttcctcactaccaccacgcctaccgccatgaccgacgccttcgccaccttgatcagtccgctcaaccggctcggtatccatgcccaagaaatcgcgctggtcatgagtctggcattgcgattcattccaacgctgaccgacgaaacccgcgccatcgtcgacgcccaatccgcgcgtggcggttccatcgaaaccggttcactggcccagcgcatcaaggcgatgagcgcgattatcgtgccgattttcgccggcacgttgcgtcacgcggacaacctgagcctcgcacttgacgcccgctgctacgaggagggcatccgccgcacccactggcgtgccctgaccatcgccgcgcgagatctcatattcgccgctgccgtcatcatctacatcgcggccatcatcgcgctgtagggcggcaaacagcgcagacagcaccggttgctatgctggtgtggttatacgaaagatgtaaggaaattcccatggcattgaccaagaagcaaatcaagcagctgcgcgcgatggcgaactcgctgaagcccctgttctatgtgggcaagaacgatttgaccgagtcggccgtcaatcaggccgatgagaccattgagaagcacgagctcatcaagtgcgccgtgcaggacggttctggcctgaccgccaaggaagccgccgccgagcttgccgagcagctgaacgccgaagtggtgcagtccatcggcaatcgtttcgtgctgttccgtcgctcccggcgcgacgatgtggagcatatccgcttggtgcgcgagtaatgttcgccccgctcgatcccgtagcttgatatgagtaatggcggttgggatcagtcccattccaaccccccttactcatattttccccccgagaaccgccaccgctacaaaaaggacacgaccaatcccccaaccaaaggcaggaccaaagacaccccacaccaccaccacaaaccacgaaagaaaacacccccccccca

SEQ ID NO: 25 - DNA, 88038 bp, Bifidobacterium longum
aatatacaggcggcggcaccgatgcctatcacatcaccgggaaacgatgacgacaccggggaaaaccatcagcccacactacggaaaaacactgccgaacctgtcgaacaaacattgaagcaaaacatgcaggcgccggaacaggccatcgcgtgggcgcgcgcccacggcgggacggaggggtgcgtgcaccattccggccacggctcgcagtatataagcctggtgtattccacgcgcgtggaggaatacgggatgctgccgtcgaccggcacggtcggcgactcctacgacaacgcgctggccgaacgcacgaacaacacgtacaagcgcgagctgatttggatcaacaggccgtaccggacggtcggcgagctggaatacgcgaccatgaggttcgtctcgtggtacaactcgaaacgactgcacgcctccctgggctacaggacaccggaacaggccgagaacgagtattatcagaaacaggcggcacaaaccgtctcacaatagaggcggaacaaaaatcaggccacttcagccgccccgctttgttatactgagcaccatccacaacacaaataaaggaaacagacttgactctgcaggctacgcctcttgtatcgattatcataccggtctataacgccgaaaaatatctccgatactgtgttgattccattcttcagcagtcatacaccaatcttgaagttattcttgtggacgatggagctaaagattcatccccatccatttgtgacgactatgcacaatccgattccagagtaacagtaattcaccaacccaatgggggcatcgcgaaagcgcaaaacaccgggctcgacgcagctcacggtgattacatcgcgttcgccgacaacgacgatatcctcgacagccgtaacatcgagctactgttgcacgcattgaaatcaacagacgctgacatgagtaaaggacgctggcgtcaattcggcgtctcgcaattaccgaccatctgtaatgaagccgctcagggcgctgacgaaccacaccacattaacgtatttcgtaacccgctacgggcttatcaatccatattctgcaaaagtctgagaattatcggagaacgtttcggtcgtcatactgaggcgcggtatttcaacgaagcaaactggtgcaggctctacaaacgcgagctgtgggacggactgcgattccccgtcggtcattatgcacaagacatccgcatggctggccccttatactctcgtatgtataaagtcgccgatgttgatgcgactttgtactactggcttcaggaacccgactcagtcacgcactcaaaacgcaccccgacattttggcacgataatgtactttccgcagcggagaacttccagttcacccttaatcagggaatagtgccataccgcaattacttcggattgactgcgagtgtccgtgatgaaggacgcgggctgcatcatgcgaacagcagcacaggctctgctcaggcccagttcactatctcagccgaagatataaagaactaccaggacgacgttcaaaacatgaaatctcttattcgacggctggccccgtcacaaaggttcctctgcaagatactgtacttcatccgatcaggagaaaatcttatttacaaccgtcgaatccattccatgaaatgacccaaacgcgcgctcactctggttatggatacacctcttttgtgaagaaaaacatgctggtattcgcaaaatgtcatacttacatgccccgctggtacactctgtaggtatggttgaaagaatactggtcactggagccggcggttatatcggtaggcatgtcgtcaaggcgctgcttgatgatggacaagacgtcatcgcctcggatctccgcttgaacgatgttgatgatcgtgcggaacacatagagaccaatctgtttgaatctggtagcgatatctattccaagcttggaaagccggatgtctgcctgcatatggcttggcgcgacggcttcaagcacaactccgacaatcacatgggtgatttatccgcccattatcgattcatcaagaacatgttggacggaggtctgcctcaaatcgcggttatgggaactatgcacgaagtcggatactgggagggtgccattgatgagcacaccccttgtcatccggcttccatgtacggcatcgcaaaaaatgccctacgtgaggccacgcttatgctcgcacaagaacacaatgcagccgtgcaatggctccgcgcatattacatcgtcggagacgatctacgcggtagttccatcttttccaaactgctgcaagccgcacatgatggcaagccgtccttccccttcacgacgggtaaaaataagtacgactttatcaatgtcgacgaacttgcacggcaaataagcgcagcggtttcccaacgagaggtgaccggtatcatcaactgttgcactggaaagcctatatccttggctgagcgcgttgagcaatacatcaaagacaatgatctcaacatcacactggattatggggcgttccccgatcgtccctatgattcccccggcgtatggggtgacgcgaccaagattcacgagattctagcgacacgatagatcaacaaaacatatgggttggggcggattccatcgcgatggaatccgccccaacccatatctgctattagcagcaactcattgagtactacttctcaaccttttggaacatccgcgatacatacgccactactgcatccgtcacgcgcaaaagtatccaagacaagaccgcaataatcaacatatccgccacgaatagtaggtaggcattggatacgccgaggctgtcgggattgacaatggtgtacacctgcatgatgacttgatgatggactaagaaaatcgcataggaatatttcgatagtgaacctatagccactcgaacgggttgacggtcgaaccactgcgagatccacactaggaacaggaagaaggccacacccaccagtgtgaccgccacgtcgcctttcaggatatcggtagactgctgtactgcgagaagcactaccgcagctgcacccaccacatggggcacttttttgataaagcggacaaaatacatcccgaaggcaagttccggcaaccgggtggtcagtaacaaatcagatggcataccttgcgagtccggatacaacacaatcgtcagcacatacaatatcgcgatgataacgccggtaatccaaggatgacgcttcaccccataccgcagcaaagggaatatgatatagaacagcagaataaatcccaggaaccattcgccaagtgtatagaacgtcggtattccggcattagccagataaccatccattccaatcacggagagcagcacactatatttcggtgcctgtgccgcgacgataccgccctggcgtaagaacaggtacacatttgccgcaatgaaagcaatccagaacatggggaagattgatttgcatcgcttccaatagaacctctttagatccagcttctccgcatcctcatgcgaatacatcaatgcagcgccggaaataatgaggaactgagagacaccaagcgaaccgatgtaaataccgaacggagaattcgcaaaaattgggtgttccactaaatatggattattgaaatgcgtgataacaatcaatatcgcagacagtccacgtacccaatctaggtagaatagtctcggcttacgcttcgtgacattaccagtcatgttactcatcctcgtttatgcccaattgcttacgatgcaacttcaccaacgccggtcccagcaccggaacatgtttagtgacgttcttcatcactcgcagtaatgtgttacggaatcgctttccttcagcgatggcaatgcaagtttgctgcaagtcctcacgaatccatggcacagtgatgccctttaccacttctcgcaactcatatgagagattcgtaatctcgatacgtgcataacgatccgagaaaatatacgctgggtaatatccattggcctgtggcacatatccataggcccgctcaatgaagtgtaataacgtaccatctaccttattgggctccggcggaaagtccgtgtattcccatccatggtccagtaagccacgaaatgcttccggacggaaccagaacatagtgcccatcggtgccaccggttctttgtcggcattcaacggaacgtgcatattcagtgtctgttccaagaagtccttggtaccggggaaattcggtccccatgggaacgtgtaccccgggaaatagctggcatggttcggaggagtcggcatagcgatgccgaggcgcggattcctctcgaacaagtcgataacgttggaaacatactccttgctggcaagaatgttctcaaagcacttatacgcgaacccatcaccgatactctgaggagacagctgcgtaaccttcttgtcgtgggcaaaacaaacgtaatcgtactggaacaggtcttccccgcaaccaaccagcagggcactgacatcacgtcctctgttctcaatcaccctgacatcgaagttatatgggaactgcttgcagtattcacgcacagtttccgcgttggcttcggagccaaccgtaatgatgatgtcacagccttcgggcatcgactggatgtagtggaatgtggactccagcaaatccatgtaataaacatgaattgcaagtgctattttcttgccttccggcagaggaacgctcagcgattgcggcaatacataatcaagatgcaggttcttcatcaaatcagcgacgttcatcgtgcgaagcgcgttctgccagatcaagtccacgtcatagtcggtgtggtcccgcaaatattcatataagtccagagcagcgttgcctacggtctgggtcatcacatcacgatacccgtggaagaacgagcgacgtttgaaaatcgggcaacgcttttctgcgaccagtcgtttcgccgcataggtaatggggccgtacgtgaacccttccaagtcggacgtatcgacatatacatcccacttgaaacccttatcggcaaaacgcttggtaaacagggattcatgcaggcccacagaatcgtaatagtcattgatgggaggaatgttatcccagtaatccctgaacgcctggctcgtgtgcaaacttttgcgatatgcatggaaatgcgactgaatgtgttccggaaggtaggggtatgggctacggccaaacggatcatgctcgacacgatggaatttggtgatgccccagaaatccaaatcccgcttgttcattgcttcgaacatttcagagaacggatacaccggtcccatgatggtggcgttgaataatacaatctcatcgaattgttccagcttttgccagccgtaactgtccaaagcggttttgtatgcccatacatcaaaacccttgttctctcgcacaatcagcttactggtgtaccgcagcagtttctcgcgcccggcatcattcaactttccattgcatacaatggtcagggcagagaagtgcggcatgaaaccgtcaagcagcttcagcacatagtcgtccacaaccccctgagcgtcgtaaaagaagaaaattcccagacgattgataggcgtatcagacgtaagaatcatggattgctctattcctcttccaaatgaagtaaacagacacgaggatatcatatgggcccgttatcattactggcatccgtccctcagccagtatgatgaatactgattagctgtaccgtatctggatactggaggaatgatgggtagaatagcgctatgcggggtcttcgatattcccaactacggggaccatctcttccccctagtattgcgcgaagagctctcgcgccgaggatacgccggtaacgtggtgttgttctcaccgttccaagctgaggaaagcttcgtggagaactctaacgtccactcgcttgacgatctcgaacgtatgcatatggaagaaccattttccgcaatcgttgtgggcggaggggagattatccactggcatcgctttgggcaaaaacgcaccttcaacagtaccgattttgaggcttatcctatggataaggtctggctcgtcccttgcttcatgaagatgaagtataatgttccactactgtggaatgcgcccggcattccttttgacttcgatgcggacaaggccctcgcccactacctgttcagtaatatagactatctgagcgtccgcaatgatttctccaagcaggtgctgattgactgcggtataccggatgcagccattcaacgcgtgccggatactggtttctctttgaagaatgtcgccaccgaccaagaactccacgatgcgcgcaaccacgtgttccccggattagcgcattatgcggtgttccactgcaaccgctttatcccggaatccgaaatcaacaatgtcgtggccacgctcaaggaattgcatgacgatggacatgaaatcgtgctgctgccgctggcctatacccatggcgatgaggatatcctccacaccatccacgatgcctgcccattcccctgcctcataccccaacacccgctctctttactggagatcatcggcatcctgtcagattgcgaaatctatgtgggtacaagcctgcatggatccgtaactgcgtccgtattcggccgtaagacggtgagcttcgattaccagcagactaagaagacacgagacctgtaccaccaacttggacgtgacgctttctatgtcactgatggcaatcagcttgcagaaaccgtatcggatgctctgcaaacgcaacaaccggttgatttcttcgatacccaacaacaactcaatcagcatttcgacaaactattcgcactgattacacaggggaacatcgtcactcctaatccttcctcgcaggccacacaattctcggacctggtgcagaaatgctttgatgcagaatatcgatccatcggattgtcacaacgaatcgacgaactggacacggcattggagaaaaacgaaggattcgtgaattacttcaaaccgcgagccgagtatttcgagagcgagttgaacaaacagctgaatcgagtacacgaacttgaggagctccaacagcacccggtgaaaataatattgcagaacatcaagcataagtgaggaacgccaagtgacagcatcaatcaacatggatacaactacaacgactcagagtatcagccaaaatgataatttctcattgactagttactcattacaaggatttttgcaatttcttatgcataattctaagcaaataattatctccatgttgttccttctgcttgcatttggacagaagctttttagcaacactttttccattgatacacagggcatcatccaaaacaatgatgcactctataaatcatggtttgaacttgaacgtttcggcctagtgctgtttaaaaagctgaccggcacctatctctataacaatgcgttagcttcattcaccatggtggtgttctttggcatttccgctatggtatgggcatatctcctatgctcagcttctcatgccacaaagctgcaaccggcatttttcatgattccttatgtcgcttcgcctattttcgccgagatgttgggatttttgctactcggtccggaaatttccatcgctgccacactaactgcgatatctctcatgatgtgggccaatgcagcagccagcaacagtgcaaaacggcgtattttgctagtcatagtctccgttgtgtgcgccacaatcgcgttcacgatgtatcttgccatggtcacgatttttattaccggcactgccatgctctatatattgcagtttggcaatcgtgctcagtgggatgaacggaaaaagtcctcttggatttttttggtgggaagcatactcatcttcggcgcatcgtaccttgcatacaagatactcaatgaaatcgcaatgcatcttgctggcgtgacgaccagcgcctacatatccgatcaatctcgctggggaaaagattcgttcggcacgataatccgcaacatcggtcaccatgcacaagagttgtattccggctccggcatcttttatagtgcactgttttccattgccgcaatagtctttgcagttgtggcagtcgcatgctccattcgcaagcgtatttcggttctcgcagttttggtttctatactgctgcttctcgctccgatgattatgtctgtggtactgggtaccgccccatcagtacgcacagaaatgacctatcctctggcgtttgccttcatgctcatgatgttactctccagattatcgcgcaacacagttcaacaagcaatagcgtggatcctcatcactattgttggatggaaccaagccctcattaccagcagaattttctacaccgaaaatatcgtattcaatcaagatgtgctcaccgtgcaagccattaagaacgacatcgataagctgggactgggcgaatcccccaagcaaccggttgtctttatcggcaatcacacggcaaaatgcaatgatgattgtttcacgccagaacaactaggaaccgctctgacgggccgttccatgttggaaatcggattttccactgagcacggtactggcgtgaagcaacaattcataattgatgtactcggggtccactataacggtgcaacgccccagcaaatgaaacaaagcgaaacattggctgaatcaatgcctcactggcccgatccaggaagcgtggcagaaaaagacggcatcattatcgtcaatttctgatcaaccctgaatttcagattttggtttatcgacgcactcaccgcgttcaccgtgctcatcatcgtctgacggcctcgatgcacgcagctccttaatcacgtaaacggtgaatattacggataagaccacatctaggaacgatagtgtcttgaatagcgtattgaaccaaaactgagaaacttcagatatgagtccggcatggtatgccatcacctcattgaggaaggtcaatgcggtgaacgcgagaagatagagcctatccggcaatttattgccgacacaaacggcgataagcagaaacgcgataacaggaatctgatagcgctcatgctgctgagtcgagatgatgaatactgtgttataaaataggcaaaccaataacgtcagaatccgaacgtccagacaacctactgttctcttaatgtaggcaatcagaatggcagtgataagggcacagataagaataatggcaatgttgattttcccggcatcgaggccaaacgggaaatcaacctcttgaagattgacaccaaagcgaacgaagattccccaagtattaaaggcactgagattcaggaaagggtacttccccgatcctccgaggtaaatgcgcagaggaaggctaggaccgcttacaaccataaaaggcaaccatcctaaaagcccgattgccagtccttcaagcgttgcgatcacaatcttccgtaatgggtagaacagtatcacgattgccgcaaagggaaatatgaaataacagaattgaagtttcgtcagacaaccgattgcatagaaggcagaagcccaatagatacgtttcgtcgataccgaataaaagcagaggaaaagcagcagtacgagcaatccgtcgaattggccccaaatggctgcattaaatagcagtgtaggactaaaggtggcgacaacgacagccaaggctttatccatatcggacagtggctgtttcttatcgacaattacatagaccgcaatccccagtatcagattgaatgcaatggggaaaagtttcataaggagaaatgtggaagcgcttgccgagaaatattggagcaccggagtaatcagtctaaaaagtaccggaaccagtggagggtaatccaaggaagggattgaatataaatggaatatattgtcgatcggtgtggttgcccatacatagttgaatgtcattacatcggcaacaccctgatttgagaatgccaacacgacttggaacagccctgaaaagaccaaggaaaaaatcagaatcatgagcagtccgtctactggctgtcttttctttgaaatatgtttcatgcgcttccccttaacggtatctcaatcacagtaatgatttagaagttgactatgacgacgccatctttttccgcaacacttcctggatcaggccagtgaggcattacggaagcatcttgttcgctctgacgtatttgtttattggttggctggttataatgcacgcccagcaccgcaatcatgaactgtttcttgactcctgtgccatgcttagtggaaaaacccacttcgagcagagaacgacctgtgagaccgagttgatcagccggataacaatccggattgcccttggcaacgtgattcccgacgaaaacaactggctctttaggtcgctctccaagacccaattcatctatacgggactttattgcttgtacggtaagcacatcttggttgaagacaacattttctgtgtagaagattctgctcgttatcaatgcctgattccatccaatagcgataatcagaatccaagcaacaattgtgacggcttcgacacgtatggactgcacgtttcttcgtatattgaaaacgataccggagaataaaaccattgtgatgaacgagaaggccagcggatatgtcatttccgtacgaactgagggaatccctcccagtacgaatgacatgatcgtgggagacagcacaatgaggagtactacgaggcaggagaagagcgatattttcttagttatgacatgatatatcgccgtgacaaacacacatagtgcgcaaatggagaatataacgctatagaagataccttctcctgagtataacgccagcacatgcgagcctatgttatgcaatataacgctggacgaatccttaccccaacgcgattggtcgctgatgtatgcattggtcgtcactcctttgaccttcatcgccaaagcgttgagcagcttatacaatgcatatgaaataacgaagataatcacactaccaataagaaatacacgggattcgttcttgtcgtgattctgatatttgctgtcactgtatctcaggacatagagtatggccgttccggtgatgaaaaacgtgaccatagctagatacatggtaaatgaaagcgtggcacatacgattgaggttacaatcaacaacgctgatagttttttgggtctatttgcgttactccacaacattaaggacaacgcaactaagaaactcgccacagatatttcagggccgagcaacagaaaaccgagcatttccgcaaaaataggagaagccacataaggtatcataaagaatgccggttgaagctttgccttggtggtggatccacaaagcaaatacgaccatattaccgctgagatcccaaagaagaccaccatggtgaatgatgccagtgcattattgaactggtaggttccactcagtttcttgaaaactactagcccaaatcgttccagctcgaaccacgatttatacagcgaatcttcattttggatgattccctgtgtatcaatcgagaaggtattgctaaaaagtttttgtccgaatgcgagtaacaagaatagcacggaaacgatgagctgccctgcatagtgcttactgaattgcaacaatccgcacacggaatatacagtcttttcctctgcggtagaggtctctgttgccagtgacatcaacggtctcctcccggtatcttgaagtacctccttagctcaagtatcgtcaaacgctaagaccggcacttgcaattcgattgttcgcagttttggaaacaacggcacgaaattcatccaggcacggaaaagcctcgtcattccccgtaatatcggcaatgccacttacagcattgtttcaatgtgataccttgggcaatgcttggactccagatagattttacctacacattcgccaacaatgcccaatgaaatcataatgaagccaccgataagccatatcgaacacatcagtgacccccatccggccatcgcatgccccaccgttaatgacaccatgacatagacgaatatgacgattccgaccaagaccgataatgccccccacaccagtcacgaaacttaacggctttgtcgagaacgaggtgatgccctgaatggcaaaggaaatcatttttttcgacgcaacaaggagatcaaacttatgatgaagaacttcggctgtatggcgcaatccttcggcctcgttgtaacaaggcaacacgaaatacacaataggctcgtcacggttttcctcatgtatcgccaattgctcagcatattcagtagacaacgccatatcgctccagactcctagccaaccatactctcacggcgactttgtaatacaataaccttcactgacctactactatcagttatctattgccgtaaactgtattgcacggtcactcagcacaccctgttcgccattccggtcatttctgatggcaaagtaatagctattgtcatcattcgtgaacgccaggaactcgggcttttcggcatcctcatcggtctgtgcacgcaacgtagcgaaaattcgatattcaccattgttgaacatatccagtggaatcgaatatttcactgtatggtggccgggtacgattggcatgcccttgcactccgtttgcgtgtcgacgtcataaacttgtccgcttctacgggaatcctgcagaacaattcccaaataagcagggatatcctcgttaaactcatactcaatagagaattcaagaggcgtcttgccatccacaacctttggcccatcactggtcacgttgagaatcggcacccgagaattcaacccgttaggatgaacgtatttcttttctcccttggtcttgaagaaatcattgttctgagcattttccaagctgtactggtctgccacattacgaggttcaccagaacaaacgatctccccatcgcttatcagtatagctttgttgcaatacttcttcatcgaatccatgctgtgtgtgaccaggatgaccgttttcgttggatcttccttcacactcttgaagaaagcatcgcacttcttctgaaatgcagcatcaccgaccgctaacacctcatcaagcaccagtatgtctccttgagccttaatggcgaccgagaatgcgagtcttacctgcataccactggaatagttcttcagcttctggtccataaactcgccaagctcggcaaactcaacgatatcgtcgtacatcgcatcgatttccgaacggctgaagcctagcaacgcaccgttcagatacacattctcacgaccggtcagctcaggattgaacccaacaccaagttcgatgaatggtaccagcttgccacgaacatccacggttccctgctcgggcacataaatctgggagataatcttcaataaagtagatttaccggagccatttcggccaacaatgccgaaaaaatcacctcgtcggacatcgaacgtaatgtctcgcaacacatgctgctcggtgtaccctttgattcccttcgtccagttcaggaatgccatcttcaaaccacttgcttgctcggtcggcaaccggaatgacttggctacatgcttgacgctaagaacaactgggctctgacgctccagactcacttcataatcacttttcattgcttacagcacctccgcaaacttggcattgtgcttgcggaatacatgcacacccaccatcaggattaccaaggtcaacacatacggtacgaatggtagccacctgctgttgatatatgtccacactgtcggcacatattccggtgacagcaaattatgacgaatgtccataatgacctgggtactaggattcaacatcaggaacttagaagcccacgcaaaatctggtgcccgctgggcaatcatgctaatcggatagataattggcgtggcatagaacatagcttgcatcagcacttcccaaatgtgggccacatcgcggaagtagacatacaacgtgctcagaatcagagatatccctaatgccaacaaatacaactgcaatatgttaaatggcaccaacagaatacgccacgtataatgcgcgtgggcaaagaaaccaaagcatatgaccaccaccatgttaatgccaagggaaatcatggaccccatggtgttggatgctacgataatgtagttcgggaaatgcaccttacgcaataagtctccgcgatcaacgatgccgcgcataccaacggtggtggcctccgtgaagaaagaccacaagcaagtaccacacagcagggaaatcggaaacgttggggtgccatcagagaatttcaggaaccggacgaacaccacatacattacggcaaatagcatgagcggtttcaataccgaccacgccatgcccaaaaacgagccctggtaccgaagctggaaatcagttttcaccagctcctgaaataccactaatgaatagcggtacttgttcctcacccactgcacaagtttcttcataaacatccaattctagcaagaggcgtatcggcaccagccttggctagcgcaacacccagcttacgctcgtgttccagttttaatagctgctctagaaatctgaagctatgccacctgttccgtgcaatatgtccatccttgtgaagaactcattcttattaaggcatcagaatgctaacatagtactcactgacggctaccatatacactatgactcaagaagtgtttaccccgaaaaacatcattgtgaccggtggctgtggcttcatcggctctaattttgtccactatgtatataacaaccatccggatgtgcacatcacggtgttggacgcactgacatacgccggcaaccttgacaacatcaagtcattgctcggcgaccgcgttgattttgtgcatggcaacatttgcgacgccgagctactggacaagctggtacccggacacgatgcgatcgtgcattacgccgccgagtcgcataacgacaactcaatcgccaacccggagccgttcctgaaaaccaatgtggagggcacgttccgcctgctggaagcggcgcgtaaatacgatgtgcgttatcaccacgtcagcaccgatgaggtctatggtgaccttgcccttgacgaccctcataaattcaccgaggaaacgccctaccacccttctagcccctattcctccacgaaggccagttcggatttgctggtccgtgcatggcaccgcacctttggtgtgcgcatgaccatctccaactgctccaacaactatggtccatatcaacacgtggaaaagttcattccgcgacaaatcaccaatattctggaaggtatacgtcccaagctgtatggtgacggactgaacgtccgtgactggattcacaccgatgatcactcatccgccgtgtggaccatcctcaccaagggtgttttgggagagacctaccttatcggtgccaacggtgagcggaacaatatcaccgtgctgaaggacattcttgaagtcatgggcaaatcccccgatgatttcgatcacgtcaaggatcgtccgggacatgatcgccgttatgcaatcgactctaccaagctccagactgaactcggctggaagccatgtcacaccaatttccaaagcggtctagaacacaccatcaagtggtacaccgacaatcgtgattggtgggagcccgtcaaagctgcaacggaagcaaagtacaagcagcaggggcagtgagcttgttaccgcttgggaaaacgtattggaatcgataagaaagacggaataaatgtcattggaattcgaaaaggaactcaaggtcaccaagaccaatattcctggcctgctggtatttgacttaccggttcacggagataaccgtggatggttcaaggaaaattggcagcgcgcaaagatgacagctctgggacttcctgacttcggtcctgtgcagaacaacattagtttcaatgccaaaaaaggtgtaacgcgcggtatccatgctgagccgtgggacaaatacatctctatcgcaaccggtgagattttcggcgcttgggtagatctgcgccccggcgacagcttcggccaggtcttcaccacccgtctagaccccagcaaggcaatatatgtgccgcgtggagtcggcaatagcttccaggcgttgcaggatggcaccgcttacacctatctggttaacgcccattggagcctcgaacagaagaagacctacacgttcgtcaatctcgctgatccggagctcaacattcagtggcctattccactggtagattccgagcgctcggaggctgacctgcatcatccaatgctgaaagatgccaagcctatggcgcctaagcgcaccatggtattcggcagtaacggcaaactgggccgcgctatccgccgctatgcggaaagccatggcctacacggatttgaatatcacgacaccgatacgttcgatatcgccgatgctaaagcctacgccgccattaactgggacttgtatggcaccatcatcaatgctgcggcattcaccgccgtcgatgaagcggaaacgccgggaggtcgcaaaaatgcatggagaaccaacgttcagggtgtcaagaatctcgcccgcatcgctactgagcatcgcatcacgctagtgcatatctccagtgattacgtattcgatggtaccaaggagctacacaccgaggatgaggaatttgctccgctcggcgtatacggacagaccaaggccgcaggtgacgctctcgtagagaatgtaccccaacactatctgcttcgttccagctgggtgattggagagggacgcaacttcgtgacccgtatgctgggactggctcagaaccacgcccatgccgaggcaccttccgatcagtttggacgcctgacctttactgatgacatggctaacgctatcttccatctgctcgatggcggtgcctcgtatggcacatataacatgaccggttccggacgcatcgcaagctggtatgacattgcacgactcgtcttccaaactgctggagtcgatcccgataccatcaccgctaactccgtagctgagtatgcccgtgaacaccatgctgccatgcgtccgcagaattgctcgctggatctcagcaaactggaagctaccggatatcaccctcaggattgggagcaatctctcacgacttatttggcaaaggagcttgagcagcgatgaaaggcattattctggccgggggatccggcacacgcctatacccccttaccacggttacttccaagcagttattgccggtgtatgacaagccgatgatttattatccgcttagcgtactgatgatggcaggtattcgtgatatcctcatcatttccacgcccaaggatttgcctaactttgagcgtctcctgggagacggttcgcagtatggcgtgaatttcagctacaaggtccagccttccccagacggactcgcccaagccttcattatcggcgaagagttcattgcgggcgaaccatgcgctcttgtgctgggagataatatcttctacggcaatggtttgggaaagacgttgcgtcgagcggcatccgtgaagcatggcgcaacggtattcggctactatgtggacgatccggaacgctatggcgtagtggaattcgataaaaaccacaaagcgatttccattgtcgaaaagcctgagcatccagccagcaattacgcggtaacgggactctacttctacgacgagcgcgttaccgaattcgccaaacgagttcgtccttccacccgaggcgaattggagatcaccgatcttaaccagatgtacttggacgatgattcattgacagtgcagacgttgggtcgcggttacgcctggctggataccggaactatggatagcctgtatgaggctggggagtttgtgcgcactgtgcaacgtgcacaaggccttcccatcgccgtagccgaggaaattgcctatgaaaatggctggattactcgggaccagttgcttgaggccgctgaaaagtatggcaaatctccgtatggccagcatctgaagagtgtggcggaaaaccggattatcagtcaaccatctgacgatccacagcaagcctgattgcactctttacagtagttggattctcagataaggcccgacgcagtaatgcgccgggccttatctgaggcttctgctgttttcgtgggttaggttcttggttgtggtaggcgtatgtcgggtccgccgcagcggagcatgatcagggcgatgaggttggtgacgtggtggaagccgtgggccatgcggatggtggccttgatcctgttgtcggacgcctcgagcctggcgttggagtatcccagctggatcgtgcgcaggatgtcgggccggcgccgccggatctttttggcgagttcgacgatctcgggtatgcgcgagtgggacgcccggaacacccagtggttcagttcgccgcgggcctgttcgaccggatgcttgagcagggtcctcaatagttccttgaactgccaggcgcggtagatctggcccttggggtccgtgttcctgatgccgtcgagcgtcgcgaactgccggtccgtcaggtcgccggggttcttcagcacggcgtgtttggcgccgcgcatgcgcttcgtggcattctcgtccccgtcgcgcctcgcctggttccacagacgtttcctgaccttgtccaaggcgccggtcatccaggagacgatgtggaagccgtccaatacgcgttcggcgttcgggcaccaccggccgacgcacgagtcaatccagcgggccccgtcgccggcgacgaccttgatggaggcgcgctgttcgggcgtcaacgccttgaagaacaggtcgaacacgtccccgccgaccccgtcgtgcgcccagatcacccgatgccgctcgtggtcgacgaccacggtcagatacgcgtggcccttcctgtagccggtcccgtccacgccgaccgcggtgagtccgtcgaacggcgaggacatcgacgccttgacacgttccgcgacccgacgggcgacggcgccggcggtcctccacgacacatgaaggaaaccgctgaccgtcttccggttcgcgaccgtcatcagccacgcgcgctccacctcaaaattgctccagcgcctgcagcggcagctcccggaactcctccgtataacgcacacccttagccatgatcccatcatctcctatcaaacgaggggaaaagacggaacaaaaaccaggtcacatcaaaaccaggccacttcatctttagacaccgaacgcataagtcttagtgtccgcgagtctcccatcagaggtatatacctcataatgagtccaatatataccctttttgggcttccaaatcgcccacggtcccttgaaaccttgcacccatttgctgcgtttaacatcatagattttaatctcataatgggcagccgcattatttgaactttcccccagcaacacatgattgttctgccatcccgcatatgttgccgccacacgcgttgtacctggtgcatacctgaaagcgattgtctgcgatccgataatcttgcgagtccgagagtcacgtgcttccacgtgtagccaatagtctcctaactggtccgcccaacccgcccaattggcacctgtccaatcggtgatggttttccaacgtttgctggataaattatacgattgccatttgtaatcaatatccgatgaagggtaatcaaccgatgctccgacagcaatatcttcagagcgataaacccaagttatctgaaccgcgggagtgaattgatagttgccgaacgcattcatatccacgcgaccggaaatgccgttgatggagccgccgctcgtgtactgccagccgcggtcgttcgtggggaacgcggtgtactgcatggtggagccatactgggcgacccaacgggtcttgccgtggatgttggagctgttgagcgcgctgttcaggtagctcgtgtacgagtagacgctcagattgttgtaaccggccgcctgcagtttgccgtaccaggagttcaccataccgtcgtacacgctcggactcgttgggctcttgtgccccgtgtacgtccagttctccagatcgtagaacaccgggtaactcaggtcgcccggattcacgcctgcctggcgcagcaggttcaccacgtccgcaccctcggatgcgccgtcggccgcactttccgcatacgagaagacgtacacgccgaacgggatgccgagacgcttgcattcgctgatgttgcgcttcgcctgcacgtcgaagccactgccccagccgtagctcagacggatgatcgcgccctcgacgcccgcgttcttcaccgcctgccagtcaatcgtgttctgccacgcggacacgtcgatcacgcccttcgcctgctgggcgaacaggttgttgcgcgcgtcgaagaacgcctgcgtgccgttgtacgtgccccagtgcgcaccgtactcgttgttctgcaacgcggcgagcttcaccgacgcgttgtcggcacgcgtcttcgaggagaccgcgttcacgtcaccgccgttcgcagcgaccttctctttcacatccgcggcgctcaccggaatgaacgactcgccatccgtcttcgccaacggatctggctgcttgctctccgtgcccacgatcttcggatcggtgaccgtctcgcccgtctcgatgtccttcaactcgccttccggcgtagccgcatattgctcggacaccaccgtcgcgtcatcggagatctcggcggacaccttgtccggcagctcggcatccggattgtccggcatcgcgtcggcagccgtctcatcggcgaccgtcacaccgttcgcgaccggacgcgtcgcggaagtcgcagaccgcgcctgcgagcgcgcgtcggatgaggttccgtccgaggcggtcgcggaggccgcggaccggacgccggacgcgtccgcgtcggcgttcacatccgcgagcgcgctggccggagtgacgcacaccgcgcccaacatcgccaccgccgcgacggacgtcaccgccgcgatcacgccgcgccccgcaccggacgccgccgcacgcgcacgcaacgcacgcagcatgcccgtcgcacgcgccgcacccgttgcgcccgtcgcgcccgtcgcatccgagccgtcgaaccgcttcttttccaccatgcgtaactccttgacgcacccatcccgcgcacccgcacaccgccacgcgttccgatggtcgaccggactctcacacgcgggaacaggcaggcgggaataggcgtaatcccaacgttttcaaccgcgtctcagtctaatgtgcgcggcggataaggcgggcggagcgaagcggacaaaatcagcggaactccaccgcacattccggcgacggcatcatcctatcttttgagaagatacttcctgtttctgctgcgcggcggcgcagtggcgagaacgactccacgctcaacgagccggctcaacgccttacgcgtcgtaggaaggcctctccccgagcgacggccgatttcgtggacatcaagtggcgtatccgccgacaatacggacagtatcgcggattccgatgccgtaagccccttacggcccccattcggctccccaccatcgaccttctccgctagtgcgtaccgatcagggccgatttcatcggccagccccgcttggaccaatctatacaaaatcaccctgatgtcgtcggaatccagatacagcgcgacatgcaactgcggaaccgtcatatcgccatgcctcttcaacaagagcaacgccatacgttcatgacgagtcaaggggacgcccacatgatcaagccagtcacggttctcctgctgctccacgccgtagcgtccaagaacgaccgtgaaccgatcgggagtcgcgcggaacacaggttcccccagtgcgtgggatttcatctcgcgaatcaccagagggatgccggagccaccgccttccacggtcacatcattcgcatcgtcatacggtatctgatgaagcagctgcatcaacgtcgcattgcggcagcatgacacgccgctgccgatcgtggccagcgtaaccccaccccataatccgccaggattcgacacctccacccgatcggggtagatgtccacggtcacggattctccgaggaattgcgcatcatattccctgtgaaccacggcattggcgacgacctcgcgcagcacctcctttggaatctcgctatcggtacgggctccgacccccacgacgaacgtgggagcccgcaggtttttggcgatggcctccaccgcctgttcgattgcctccggcatattgccgtcgcattgcacacgatccacgaaacgcggaccctcaaccgccgatttctcgacacccggatgtgcgacgacgtcaatgatcagcttgggatagtactgctgcgggtactgtccggcggccaacagtcccgcaagacgcacctctccaaccttgttcaccatattcaatctggtcatgcgctcaagacgagtatcagtcccgcgcaacgccttggaattacgatgctcggcaagcaccctgtccaccgcctcggcattcagatcggagacgtcggcttcagggacaaccatacgatccgcggaactgggcgtcagggcatgggtcatttcgaacacttcggttggcgacaatctcaaatccttgtcgtccatacggcggtacccaccggtttgcggccctctcgccgtaagatagcagggtttgtgctgaatgccgttttcatggatgtcgatgaccaggaacgacaagccgttctgctcgcatcgggaaacgtcatactccggaggattcgtcaaccgtgctccttgcggattgccatctcccataccatccatgaactgcgatgcaatatggttggcgtcgaatcccggaacaggcgagaaatccccgtcctcgctgattcccaacaacagcacgccgcccttggtgttggcgaacgcgctcacactctcccacacgctggtgccgatggtccgcgcacaggatttcgcctcgaaacgggcgtcatcgttgccttggacacgtagatgttccagcacctcggcgatatcgtcattcgtccacatcatcatcccccttgatcagcttatttgtcttacttgttgcgaccacatggatccaagcagtcgcctccaatcgaccccaaacccacgtctgaaatctcatgataacgtgaagataaatactctgtcatgagcttatcatgattgcatcatgataagctcatgacatcaagaaccggtttatgacaagcgacacgaatacgcatgccgaacagcaacaggaacctgaacgcaagcatcaacatgtaaataccgaaattgaccgaaccaagaaaatcacgggaaatcacgcacgacattacgcgggtaaactatctatagcacatgagtatgggccgggaccgtgatgagacggcttcgaactgagtatgaggatgggaagatgatcttcgagacaaacacgcagaaatcggacatcacgagcgccggtggcgatggttccggcgagcgcgccgaccgccgcgaccagccggtcgtgtatttcgtgcttccctgctacaacgaggcggaagggctcgtgcacacggccgacgtgctggccgccaaagtcgcacatcttaccgaaaccggacggatcagcaaacaaagccgcatcctgttcgtcgatgacggttccaaagacggcacctggagcatcatccgcaatctgcacgaacgcgacgcacacttgttcggcggcgtaaagctctcccacaaccgcggccatcagaacgcgctcctcgccgggctcatgaccgcgcgcgcctacggctgcgacgccgccatctccatggacgccgacctgcaggacgatgtgaacgcggtcgacgggttcatcgacggattctgcaacggcgacgaggttgtctacggagtgcgttccgcacgcaagaaggacacatggttcaagcgcaccaccgccgaagccttctacaaggtgttcgagtggatgggtgccgagacggtacccgaccacgccgattaccgtctcatgagccgcgagacgctcgacgcgctcagcgaataccacgaagtcaacctgttcctgcgtggcatcgtgcccacactcggctaccagaccagcaaagtctactacgagcgcggcgaacgcgaagcgggcgaatccaaatacccgttgaagaagatgatcgccttcgcgattcagggcatcacctcgttctccacgaaaccgctgagcttcgtcaccggtgccggactgctgtctatcctggtagcgattggcatgttcgtgtacgtgctcgtctcgctcgggttcggccacgccatcgccggctgggggtccatgatgatctccatctggctcatcggcggactcatcatgctctccctcggcatcgtcggcgaatacgtcggcaaaatttatatggaatccaaacatcgcccccgttaccgcatcgaaaccacactgtaggaggggccggcggccagcggacggcccctcctacagtgcttggattgtatctattttgtcctcatcatacgagtcaacgcgtatagcaatgccccctgcttgaggcgaaaatgagaccgtcgccgttctcctgccttgttataacgaagaggtgaccatcggcaaggtggtgcgcctgcgcagtggccaccggcatcatcctgctcacgtatctggccttgtggctgcaatatacgcccgccgacgcgactggcgtggatggcatgcagttccgctacttcctgccattaagcggcatcttcacactctgcgcttgcgaatgcgttgccgggttgcggcggcgcgcgagtcacgcaagtcgtgcaagccacacaacgccgcgctcctcacgcgccgcatccgaatctacagccgcaccttccgcagcagacactgcacgggcttaagcaccacggtatcggcaatcaccgcaaatagcagcgccgcgagcagcgtggctgcgaacatcagcacgctgatgcccgcgtacgaccatccgtccgtgggcgcgggaatccgcgggccgatcagcaccttggacagcggcgaatgcaccagatagatcgtgtaggagtaccccgccagccagataatcgccttgcgcacccgcgccgacgtgatgtgcacgtcgtaccggaagaacaggaacaccgcggccaccaccatcgcgaacgcaaccgtgaccgtgcggccgacctgcatctgctggccggcgaacagatatggcgtggcgacggtccaggtcagggcgaacggcgccaacgcatacaagccgcgccgcgcccgcgtggacggcggatagtattccaacacgaatcccaacagatagtagaccagcagtccccgccaggggaacgactgcaggaacgtcaacgggtatccggcaagattgcagatctgctcggcggcggccacggcggcggccagaccgatcagcagccaggctcccgatcggcctatcgcgcgcatcatcgcggccaggaacggcgtcgccagcacgaaaccggcgagcatgaacacgaaccaatagacggaatcgtcatacccggagaacagatcgaacaacgttccagacacagcgccgccaaccgaacgatgatcgatcaccaggtaggcgacgaaccccatgccgcccgcgtacagcagatacggcacaatcagcgagataaaacgtttgtagtagtagcgcacgtacggcgcgaggctgctgggatcggcttggccggcaccgccgcctgtccgggcatcagagccagagcccggcagacggcccgctgagtgggtgctcaccggccggtcggcatcgaatgtcaggttgaaccggcccgacaccatgatgaacagcggattgcagaccatgaacaacgcgaacagcacggatcgcaccgtttccgcgccgccggcgagggtcatcttgacgggcatgtagttgttgatcacgtggacgccgatgaccaggcacatcgccaccacgcgcagcagatcgtagttcacgtcgcgcggcctgccggcgacgccggaaacggtggcgtcggaaacggcgacgccggaaacggaatcgggcatggtcatcacatggatcccgtcagggacttcagatcgaccgggcagctgatctggctcttcagcttgtccaaggtgtccaggccggccgagggatcggaggacgcgcccttatgcgcgtcgttcttgccgccgttcgcaccatcggcgccgttcgtatcggccgggcactcatccgtcaccttaccgttggagcccgtctcgacgccatccgcattcaccaccggcgtggttaccacgttcagtggatgtgtggcatcgctgctgacccgaacggtataggcaatcgtcaattcttttccgggctcgatccactgctggttgaacataatgtactgacggtcatacaggctcgcggtgttggtaccccatgaatctatatcagcctgcacagcggtgatttcgccaccgtacggggcggtaagcaccacgcggtacagcatgccaccgagcactggattctccgagccgccattaacgaaatcgggcaacgattcggccttagccttagtcagcgtgttcttcatggtgaaggtgaccgtgtattcgtcaccgagctgatcttccgtaaactgacccagctgcgtgttacgcacggctgtcgtgatgcgcttatccagcacgccagaatacagggcgttctggctggccgaggcgtcgccgcaggtttttgtgaccgtggtggaggtcttcagataccaatcctgcttgccttgctgcagctccgaaagatagatgccggtttcaggcacctgactgtcagcagacagctcaccactggccttatcgtcgataagtccggtggcaatcagcgcctcctgctcatccggatcagccatccatagcttgaaatgaccgctagcgctggtatctctgattgccttcaacagcggggatgcggtggaagcattcgcgttaccaagcacgtggttcataattgcttgagccgcttcggaaacgaagttgttctgctgctcgaagtccgggtaatccgtgtacaggtctgaagcgaagaacggcaccgtggtggtgccatccagcactcggccgtccgaaagcttgaccttgcctgtggctcccagcaatgcctggaggaatacgggatcgaatgacaatacacccgctacgttctcgtcttcgttgcctttctgatacagccacatgtatttgttcatctgtgccacacgctggaattcggggtcgatggtcgtggtggccgggtactggtcaaaagtgtcgccaaatacctggcgctccttcagcaccgtagcatccattggcttctcaggaatgtcccaaccagaagtggtggcgaaatcaccgatggtaatcgtgcccttatctgccgtgattgcggcgatggtgcccaccatgccgcccgccgaacgcagctcggccgggttctgcaccatcaccaaatacgtgcgcttgccgtcctcgccaagcagttgcggtagcaagttaatgaggccatcgtattcgctgagcatcgaatccacggtcttgagcgcagccttttcggattcgagcacggtggccaccttggcgacgctcggagtcggcaccttgttgagcttggtgagctgctgcgagatatccttatgcgcctgcttgacgatatccggcatatccatcagggcgctgacgtccaccgagccattcttcagggagaagccctgcaatcgtttggacaggttcagcagatcagtgaacggaccgttgaccaacgtatccacggaagccagcatttcgcgggcagcggtgatgtcgctgccaaatcgcgaatggtcgcggaagaagtcccactgcgggccgttcagctcctcgttgagatcactggtggcattgaccaactcttgggagatgtccgacagactcttatcgctgccgcagccaagtgccgaattggccagactttcggcggatgtcagcacacgctgcgcatccgtggccattctcgagacggatgccgcgtagagcgtgcccacacaggtgacgctggccagcaacgtcagcagcagtacaaccaccactcgcgcccatatcggcgtacggctgatcagcgaacggccgtcgccacccacgtgctggggagtcttcaggtttacgggacccgtctgctgatttgcagcgctattcgtagatgcggagcgattggatttcccgttaccggcatggcggcttctcctacgccccacagccttatggctcgaatgccctgaagtgaatcgcatacttatcctacccgaaaatctgctcagctcatactcttatccaacggcgcaaggccacgcttccggatgccggactccgggcgaatccggaatcgcagacatgccggaacacacgtgacgccacgcatatctcatgccagtgtaccgatgccaccgaaatagaccgagggtttatcccataccgggtgcaaatcccctcatgaccaccacatcgctgtcagaatgttctcagacttcattgaggggtataacagtattgcgcaagaaaacggtcactaaacgtaacaatagttaaagccgtattgatctgttcggcttaggagaacgggagaggtaattacatgttcgtcctcagcaacgcctggcgggccctgacacgttctaaaggacgtacggccctgaccgcattcatcaccttggcggtcaccttcggcacagtcgccggactggccatcattcaagaagataccaacgcacacaccaccgcgtacgatcagcagaaggccacgttggccattcgcccgactgcggctacgtggaagaaggtctccgctacggactcggcttccaccaagcattacatgacgtggacctcatataccgaatacgccacgctcgtccggtcggccaccaactcgttgaacttcacggttaccgaaaccgtgccggcccgcgtgagcggtgatttgaaggccctggacggcggatcgctgggctcggcctccgatgatgagaccggcggccagctcatttggcgagccttctggaccgaggatgccgccaaggccagcgacctcggtaccttcgaaatcgtggacggcaaggacctgagctacgacaacaagtcctccaacccgaacaccaccggcgcactggtctctgaagcgtttgcctccgccaacaacctgaaggtgggcgatacgctcaaggtggcggccgcctcggacgcccagaccacggccgagctcaaggtgcgcggcatctacaagtacacatccgaatccgccgtcgccaatccggtgacggccgcccgcaaccgcgagaacgcgatcttcaccaactatcagaccttcgccaaggccggactcgacccacagtccaacgacaagaccgcctccggctgggcggtgccggatctggacgtggtgttcgacaccggtgatcccgctacatacaagtccttggtatccaccctcaagaagtccaagctgcccgccaagggttacgagttctcttccccttcgctggaatcctacaacgcttctctggagccgctggatacgctatcctcgcgcgcgaagaccggcaccattgcgttggttgccgtgggcggcgtgctgttgctcatcctcgtgctgtcaggcgtgtgggcgcccaagcgtgacgacgagatcggcatggcactggtgtccggcgtcactcgcgggcgtttgggatggcagttcatgctggaagtgttcatcgtcaccctgcccttctacgtgattggtctggtcggaggcgcgttcgccgccaatccgatcggatctgccctggcatccggccatgccaccccggtgacatcgggcctgatttggaccatggtctggtatggactgggttcaatcctgatcctggcgattcttgccgccctgcgccttgcgttcttcagcgcgaacaagctgtttgccgccgatggcgactggggcaccgtgagcgagaccaacaagacgaccaccacaaccgacgatgcggaggcacaggcatgagcgacaggaacaacgatcaggaactcgagaagaccactgacgcaacggctgacgaagcgacttctgagactgagacgaacgacgccattgaatccgttccagctgactccatgcagttcagcgtgaccttcgatgacgttgatgacgaaggcactgttgacgatggtatttacagcgcactggcatctgccgaaaccggagaaaccgacgagaccagcgaggccgaagcagacgccatcgcttcggccaacgcatccgccgaagtgaccgagcgcaatgccgcccgcgtcaacgaaacactccgactggccaaaaccgatcacaaagacgcattggccgagcatgcggagcctcagggcaaagcgtccgaacccaccatgacgctggcctcacgtatcgatcgcgtgttggtgggcggcggttccgacgacattctgctcaagacctacccgaccttcgccctgaacaaggtgacggtcgccggacccaagggcaaggtcaacatcctcgatggcgcgaatttcttctgctattccggacacgcatacgcgctgctgatcagcgacgaccccgattcgggcatcaccgccgacgccaaacgtcgcgcgctgatgggcgtgatgagcggtttgaccacgccggcgtctggcacggtgatgaacaagagcgccaacattgttgagctcgagcccgtggaactgcgcggccaccgtctgggcatcgtaccgcagctgcacgccgtgcagccgaagatcgacgccgaacaaaacgtgctgtacgccatgaatgcgtccaaccgcaacttcctgaagcccaagccggtaatcgcccgcgaactgctggccaaggtcggcttctctgaggccaccagcggcgtggctgtcggcacattgcctttggtgcagcagcgtttggtggccatcgcccgtgcaatcagcaccgaggccgaggtgctgatcctcgacgagccgacacgagggctgaacgcggatgacgaggtgaccgtgttcgccgcgctggccaagctggcgcacaccggtgacccgaagcactgcgttatcgtgctcactgcgtcgcgcgagatcgccgaagcagccgacacactcttcgaaatctgatgttcagaccatagagccccctgtgattcgtattgccgaatcgcaggggtttttcaatgctgcggctcattgccgcgctaatctgaggataaatctgaccgtacgaggcgaaacctgataatcatgaccggatatattcccacactggagcagatcgacgagttgcaccgcaaaatcgcgccgtccaaggcggcgtacgagctggtgcatacgcattgcgtgattgtagcgaccatcggctgccagatcgtgcgccggcagaacgcgctgttcacgcgccgctgcacattaccgaaggacgcggaggtaccgcccaccgcaggcgtcaccggcggccatgtgccgccgcgtctgctcgacgagcatttggtactcatcggcggactgctgcatgacatcggcacctaccgcgtgttcaagcatgacggctctgacgacgaaccgctcaaattcagcaagaaacgctacattctgcacggtcttaagggctacgagtatctgctcgacgagggcgtggacgagtccatcgcccagttctgccgcaaccataccggcgtgggacttacgcgcgaggatgtggtgcgccaggagctgccattgccaccagccgactatgtgccgatgaatctcgagcaggaagtggtgatgtacgccgacaagttccatagcaagtcagtgccgccgaagttcctgcaggtcgaggcgtatacggcccgagccgagcgatttggcggagagaacaaacaacgatggctggatctggtggccaagtatggcgtgccggatattccggcgttggcggagaagtatgggatgcggatgatttgaggctcaaggcccctcgtcagagacggcttatgaagctatttcagatggaacggagacggtaggtgccgttgcggttggaggcgatgatcatctggtcgttctccagcacgttccagccttcctgctcatagccggaagaggagaccaccacaccggcggagtcgccgttgtcgtcgcgcagctcacggtagcgcatcacacggtagtcggcggcctgcgcgccacggccatactcgtcgtagatttccacgatgcgcgggctggtcttctcacgaccggcggcgcacagggcgatgagctggtcctcggactgaatcatgcagttgtagctggacttcgggtaggcttggcgcagttcgcgcacggcctgggccacggcctcgtcgagcgggaagccgaaaccgatgtattccagaatcaccgcgaagaagatagcggagtcggaacggccgccggtggagaggagcacgctgtggttcaccgggtatgagcggttggtgacgatgttgcggccattggcgtccgagatatcgccgttgtggatgaagctcaggccgttcgcatagaacgggtgctggttctccatgatgagcggcagattggagcttgccaagcgcaggtgccagatggcaccgcgagacggttcgtcggccagcgtctcaaacgtgctgtcatgacgggccgcgatggtcgacttgtagattcgggtgccggtttccggggtgggtgcgccgccgtcgcgcacgtgcggcgcttcggcgggatcggaaagctgggctacaccccagccatcattgtggatttcagacagttcacggaaatcctcgacattgtcttgccccaacacggcgttgagactcaggttgaaacctgccgtcgcgtatcccagtaatctgcacatggtatttcaacttaccgaaaccgtgcggcgacgtgcggcgaccgttataggcattctttatagagcgcatcagcgccgctgcaaactggtatgttatcgcttctgtttggcggagcgctgaggcttggcggcgggtttgccgttcttggccttgcccttatcgcctttatcgccctgctcagtggcggcagcggtctcagcgatcttccgctcctcggccgatacggcggcatcgagctcccgtaccaatcgcccaagcccggacgtggtgtccatcgggtcggggacggcggccgggtcggccactgcacgagtcggcgtgggcgtcgtgatggtcttggccgtatcggtgcgcttcagacgcggtgggcggcgggtggagacgaacagcggctgcacctcgaccagcgggttgtaaggtgccagaccgaaccacttaaccggcgagccggccatgcggcggattgcgtacttggcttgcaacgacagggcaccgcgtgcggaaaccttggattccggcatcagggccttgtgaatcagcacgtaacggatggtgccgatgtccggatcggcgtcgaccttggggtaaatcgacttctgcttaggcagttcgccggttttggacaggtcgtgcatgatctggtggatgtacgccgggatggactgcgaaaccttgaagcccaaacggaagcgcacgcggtagatgtagttcgtgccgaagtcctccaccgagtattcacgggtgaacggctcatcggtggtttccacgctgactgcccaccaagcacgggcacgcttggggtggtcggcgaagatggagaagaagatgtccgtgtcgagtcgcttggtttccgagtcggaggtcaggtacacgatgttgtccgcaaaatacgggatgcggaaatcactgtgcagcttgtcgagcgcgggtaggaagtcgttgggccgcatgtgacggcgttgcgcacgttcgagcttggtgccctcattccacgtgtacatgacgaacagaatcgcggcggtcagcagcatggtgaaccaaccaccatgcaggaatttggccatagacgcgatgaagaacatggcctgaatcgccaagaacagcacggtgaacacgatggcaccgacccgcttgccggaatgccataggtagacgccgagcaacacggtggtggtgatcatcgtaatggtcaacgccagtccatatgcggcagagatgtgttccgaatccttgaagatggcgagtacggccagtgtggagacgcacagcacgccgttgaccaccggaatgtacagctggccacgcgtgcgggccgggtaccgcacctgcagatgaggcatccaattgaggcgggtggcttcggagaccatggtgaacgcgccggtaatcagggcctgggaagcgatcacgccggccgaaacagacagaatcacggccagataacgtacgttcggagacatcatctggaagaacgggttgagtgactccatcgcagtgtattgcgggttatcgctattggccagcatccacgcaccttggccgaagtagttgagcaccagcgcaaccttgatgaatggccaagtgaagtagatgttgccgcgccccacgtggcccatgtcggagtacagcgcctcggcaccggtggtcgagaggaacacggtgcccataagggcgatgccggcagcattgttcgggctgaacaggaatttgatgccgtacaccgggttcagggcctcgaacacagaccagtcgttagagagattcgtgacgcccacgatggcgaggaagccgaaccagaccagcaccatcgagccgaatactttgccgatgctttcggtgccacgcgactgcacggagaagagaatcacgatgatcacgacggtgatcatcagggtcaggcttgggttttcgtcgaacaacccttccaatggcggcagggtctgcaagccttcgactgcggaactgatggaaaccgccggggtaagtaccgaatccgcgaggaatgccgcgccgccgagcatggcgggaatcgcgagccatgcgccgtacttgcgaatcaacgagtacagtgcgaagatgccgccttcgccattgttgtcgatgcgcatggcgatgagcacatatttgacggtagtgatcagcgtaatcgaccagaagaccagcgacagcatgccgagcacggcctctcggtctacgctgccaagccctccctgaccggcaaggaaggtctgcgcggtgtacaagggcgaggtgccgatgtcgccgtacaccacgccgagcgccacgattgccatgccccaggtgaccttgtctgggctggattgcaggcgggcccaccatcgaccgaggccgcctttcgaccatgcgctggcgattttctcggcttctttggtttcagcttccctctgcttggcgagtgcctcgcgctcctccttggtgagagtgcggcgggacaccttgggagcgttggtaaaggtgtcggccctcagcagtgcttcttcttcctgtcgggccttggctttggcggcaccagactgggctttctgggcctttgaggctttttgggcacgtgcggtcctttggttcgactcagccatacgttcagtcctccattgaggtggagatcatccccctcgcttatgtcaaacacatcatgatagacctcgttcacaattctgacaaattttacaagtcaacacatcgtctctacacgcgccgcgacggccgcacacccggccctcacagtccgtatacggcgcgggcggtatcgcgggtgccgcgcgccacatccgcgatgggcaagtcgagcgtatcggccatggcccgcaaggtgtagggaatcatgtacggcgcgttggtgcggccacgatacggcatgggcgtcagatacggcgcgtcggtttcgaccatcgcatggtccagccccacaatccgtagcgattcgcggataccgtcattgcctttgtagctcacggtgccggagaagctcagataccagccatgttcgcgcgcgatctcggccatctcacggtcgccggaatacgagtggaatacggtgcgttcgggcgcgccgtcggccagcagggtttcgatgacctcgcgatgggagtcgcggtcgtgaatctgcatgggcaggcccagttccttggccagggcaatatgcgcgcggaaagcctcgcgctgcagttccttggcaccttcgccggtgcggaagaggtccatgccggtctcgccgatagccaccacttgctcggggtatgtggtggcgaggcgatgtacttcggcgagcgcgtcctcgaaagacgtgtcatggtaaggcttgtatttgaggggcagaccatccggccccggcacaccgcgatgcccgtggagcacggactcattggggtgtattgcgagcgccgcgtgcacattacccggatgatcgagggccatctggacggcggtcatcaggtgcggcagctcgcaaccgcagtcgataatacccccaatgccgacagattgcgcctgcgccagcaattggtcgacgtcgtacaccgggacttcgggctgtcccttctcctgcgcctcatggctcatagcgcgcgcgaaagggattacggaggccacgtgagtgtggttgtcgatggtctgggcatcgtccggcaatgcttcaggtgccggggcccagctacggtcgcgatggtggtgcttgctcatggtttctcagtgtaggctgtttctcagtgtaggctaccgccagcaacgctcgtaaggcagtccggtaagacgttcgactacacgacgggtatcgtcggtcacgcccgcctgaacttgccgtttcttgccacgagcgcaacattcccgggagagtagcgcaaccggcaagcgagacggtcgccatcctgccgcctttttctgcatcatcagcccattttctgcctcattttgataaaatatgatgcagaaaagttcgtatgatgcagaaaatgaggcagtatgagatcatttgactacatcgaatcaggtaagacgttgctcaccccgcacaccacgagtttgcttgccgctattcacgaggcaaaagggcgtcaaagcatacagacaacgatcagaccggatatattggggacgctggttgccgtcgcgcgcatccaaagcacagatgcctcaaaccgcatcgaaggtatttctaccagcgatagcaggctcaacgatctcgtctcggagaaagtcacaccgcgcaatcgcaatgaagaagaaattgccggttaccgtgacgcgctatcggttattcacgaaagccacgactatattccgattaccccgaacgtcattcttcaactgcactgcgacctcttccgacacacaccactgacctttgcggggcatttcaaggacagtgacaacgtcatcatcgaacgagatgcacacgggaccagcaccgtgcgattcgccccaccgtccgcacttgtcacaccggaactaatcgaacgcgcgtgttccgcctacacgcaagcaatccgagatggacataccgatccattgcttgccatcgccatgttcattctcgatttcacctgcatacatccgttcaatgacggcaatggccgtatgagtcggctactcacgctcctgatgctgtgccgcaatggctatatggtcggcaaatacatcagtatcgaacaccttatcgagcaaagtaaaagcacttattatgaggcgctggccgcaagcacccaaggctgggacgacaacgccaatgattatgcgccattcacgaactacctgcttggcatcatactgtccgcgtgcaaggaattcgacgaacgcatcaatctcacggcaggcggcagagcgcagggagcaccgcgagtagccaccaagggaacgcggattgaagcactgcttgatcaatccctagttccactctccaaggccgatattctcgctcgcatgcccgataccagcaccaccaccattgagcgcacgctgaaatcactgttggactccggtacgatcatcaaaatcggtgctggccgcagcacccgctacgtgaaacgccgctaaacgcatccttgtgcgcaacatctcgtcactcttccggcgccccgctggccacgcgaatcatcgcgtactgcgactcgtagaggcggtagtacgcgcccttggcggcgagcagctgcgcgtgcgagccgtgctcgacgatctggccgtgatcgatgtagaagatctcatccgcgttctcgatcgtcgacaggcggtgcgcgatgatgaagctcgtgcgccccttgagcagatgctgcaggccggcctgcagcgcctcctcggtgcgcgtgtcgatgttgctcgtcgcctcgtccaggatcaggatacgcgggtcggcgagcagcacgcgcgcgaaggcgatgagctggcgctggccggccgacagagtcgatccgcgctcctccaccaccgtgtcgtacccgtcgggcagttccatgatgaactcgtgcgcgtgcacggccttcgccgccgcctcgatttcctcgtcggtggcgtcgagcttgccgtagcggatgttctcgcgcacgttgccggagaagatgaaggtgtcctgtagcatcacgcccatctgccggcgcagcgatgcgagcgtcacgtcacgcacgtcgtagccgtcgatcgtcaccgagccctcggacacgtcgtagaagcgcgacagcaggttgatgatcgtcgtcttgccggcgcccgtcgggccgaccagcgcgatcgtgcgccccggttcgacgtggaagtccacgaggttgaggatgttacggccgtccttctcgtagcggaacaccacgtcgttgaagtcgacgcgcccgcggatctgcggcaggtccgccgcgtcgggcttgttgcggatctccggcgtgacgtcgagcgtctcgaagatgcgctcgaggtacgccgagcaggtgatgagctggttgtagaagttgccgatgttgatcaccggattccagaagttgttcgcgtagccgacgaacgcgatgagcacgccggtggtcacgttcacgcccccgaagcccatcacgccgacgaagtagatgaacgagatggtcatcacggagatggtctgcacgcccggccacatgaggaactggatgtgcacggcgtgcatccacgcggaacgcacctcgccctgctgttcctggaaggtcctgaactgggcctgctcctgtgcgaaggtctgcgtggtcttcacgccggcgatcgactcgtggatgtaggcgttcaggttgctctgcttgttggagagcttctggaaggcgcgccgctggaagatctgcagcacgcgcacccagatgatgagcaccgggaacaggatcaggctccacagggccagctgccagtcgatcacgaacatcacgatcagcgtgatcacgaaggtgaacacgtcggagatcacgttgatcagaccggagctcagcgtgtccgaaagcgtgttcacatagttgaccacgcggatcaggatcttgccgtgcgggcgcgaatcgaagtagctgaagggcagcgtctggatatgcgtgaagatatcgcggcgcatgtccttgagcatgagctggccgacgcgcgtgatcgccaccgtgcggtagcgcagcccgaactcgtacagcacgatcagcgcggcgaggatcacggcgaggatgccgagcttgccgaggtccttgttcgggatcgcctcgtcgatcatgatcttggtcaggtacggcacggcgacgacgatgcagctcatcgagatgacgacgacgagaatgcgcgccacctgtgccatatacggtttgagatatttgccgacgcgcaggatgtcccggaagttgatctgctcctcgagttcctcatcctcgcggtatgtattgcgttgtgccataagtcctcttctaaaaaccttgtgcgacgccggactggagtccgagctgcttgtggtagatgtcccagtagcggccgtgtgcggccacgagttcggcgtgggtgccgcgttcgacgatacgtccgtgctcgagcaccagaatcaggtcggaatccttgaccgacgagatgcggtgggcgatggcgacgatggtcttgccgccgtccatctccttgaggtgcttctggatctccgcctcggtctccatatcgacggccgaggtcgtatcgtccataatcaggatcgacggattgtccgcgagcgcgcgggccagcgacaggcgctgcttctgcccgccggacaggcccacgccgcgttcgcccacgacggtgtcataaccctgtggcatcgacctgatgaaattgtccgcgccggcgatctgggccattttctggatatatcggtcgtcgctatcaccgctggcaccaaaaccgatgttgccgccgatggtgtcggagaacaggaaggtatcctgcgccacgatgcatacctgcgagcgcaaggtggccagcggccagtcgcgtgcgtcgatgccgtcgatgagcacatggccaacggtcgggtcgtagaagcgggagatgaggctgacgagcgtggacttgcccgcgccggtttcgccgaggatgccgagcttggagccggcgggcacggtgaagtcgaggtccttgaggatcggggtctccgggtcgtccgggaaggcgaagctgacgtggtcgaagcggatgtcgcccttgatgtgcagcgggcaggacttgcgttcggtggactgctgggcaccggatgttccggaagccacgggcgctccggtagccccggtagcctcatcatcgtgcttgacttgctcgacgatcgtgaccgcctgcttgacggcttcgaccgcgtcgggcttctccacgatgcgcggctgttcggtgagcagcttgcggattttgatgcagctggcgttgaatcgctgccagtcgttgatcagccagccggactggcgcaccgggccgtcgatcatccacaggaaggagttgaaactcaccagattgccgagggtcatgtagcccttgatgaccagaaagccgccgaggccgagggtgatgagctgcagcgagaagccgaggccgtccagccacggcatgtacttgcgcgagttgtaggccaaggccatgttgcactgcatgtaatcgtcgttgtgctcgtcgaacttttcggtctcgtacggttcgcgcacgaatgccttgaccacacggttgccctcgatgttctcttcgaccatggagttgagggaggccagcgagttgcggatggcgaagaacagcgggtgggcgtgcgtggacaggccgcgcgtgagcacaaaaatgaacggcgtgacgcaggccaggacgagcgcgagtcgccaatcgatggcgaacatcacgcacagggcgcccacgaacatgaccacgcagtcggcaatctgatagctcacccaactcaggcagtggcggatcgcgtcggtgtcggaggtcaggcggctcatgatgtcgccggtgcgtgtgtggttgaaatacgtgaagtcgagctcgtgcagcttctcgtattcgtcggagacgaggcggtagaccgagttctggccgaaacgctccatccacatctggtagccgtatcgcgcgcccacgcggatgatggtcatgaggatcatcagtccacacaaacgtggcagttcgtcggcatgtccgccgacgatgacgcggtccacgatgataccggacagaatcggaatggtcagggccatcgtgttatttgcgatgaacagtagaagcgcgcctaccacgcggggcaggtctggtttgcagtatggcagcacccatttgagattgcttgcgctggtattgattcccggatcgacgtacatgtgaggagatcaccgtttcttggggattgtttgcttgtggtatggtgcggcatgctcctgcgccgcacgcggcaatcgctgccgccgcgattcacgatcagccgtgcttcgcactgcgcctgtcattggccgcatgaccgaagctctccttcatcggtcgaagcacgttcgactttcgcaaacgcgtactagtctagacagcctgcgtctaatcgcaacggcccgcaactctgcgtgttccccgcattagcaacgatacgcggctctctaagcgcaacattccccggaatgcgtcgctgcacacctccgaacaggtccaattcgcaacgcattcccgggaaagtggcgcatgtcatatcacgctcaaacaacccagcatagtgagtggctcattcacgttttacgtattgtgcgacggaatcggcatctcccgcaacacgtgagatatgcaaaagtgccgcacgctgaattgtgatcagcgtgcggcgctgcgcgaaacgcgtgaaatccgcagaacgcacgaaactcacgaaacagataaaacgtacaaaacgcaagcaaggcgaagacaacgaacagacagagacagacagcctacaggtcagaacgccagcgaacgcacgtaggaaccaacttgcgggcggaacagctaccggggattgttcgtttgcgatgttcgcattcatggcaggtttctccatacgattcgggcggtcggttcaggaggttggttggcggaggcaggttcggtttcagcgtcggtccagggccacccagagcacgccgtgcggcggaatcgtgccggtgatgacgcggtcggcacccacgccttcaagacgcacgtcggcgggctcgcccggcgcgtcggcatacagatcggatagcgtccaatcgtcattacgggcgtcaagccccacaatggattggagctggatgttgcggccgatctcgtatgtgtcgctgccggtccagaacagcgcggcgtaatggccgccgtgatgcgcggaacgtgtgccatcagcccaatcggctgcgtcggcggaccagacgatgaactcgccacggtaggtgctctcatcccaccatttgccaaaaatccgttcgcgcacggtctcgcggttattggtggagccggcaagcacctcacgcaacgcgggattctgcagcagcgcgatggcgtcgctgttgctggtgggcagatcgccgccgaccataagcgggctacgccccatgcaccatagggccagcagtgtcttctgctcgtccagcgtaaggcgggattggcggtcgtcgccgcgttcggcgcgcaggcctatgtgcccgaacggcaccatgtcggcgtcggcccagtggccggtggtctggaacggcgcccagcgggccaggcgggcgaactgctggtagatgtcttcccaacggtcccacagatcgtcggaaatacgccacatttgggcgttctcgcgcaggaagtcgacgtagctcgtcgccacccagccgccgggcgagagagacaggtcaatcgaacggccgtatttggcttcggctttggcgatggcgcgatgataggcggcgatttcgtcggagtggaacggggtctgcatgtcgtcgaccttgaggaagtcgaggccccaggaggcgaacaggtcgagctgcgcgtcataccaggcctgcgcgcccgggtgggattggttcaggccgtagttgtccggattccacttgcacacgtggtcgaggtcggccacgtccttggcggtgtagttggtgccgtatacgggcaggttcttgtccacagcgatacgcgggatgccgcgcatcatgtgcatgccaagcttcaagcccagttcgtggacggcggcggcgagcgggccgaatcccttgccgccggcagcactcgggaaacgcaccgggtcaggcagctgacggccgtattcgtcgagaatcagcggcgcgttgtcgttgtaaccatgtgcgcgggcggtcgggtcgtaccagtcgatgtcgatgaccaacgtatcccagccggcgtttttcaggtgttcagccatgaaccgcgcgttggccagcagctcgtcttcggtgagagtcgtgccgtacgaatcccagctgttccagcccatcggcggacgccatgcctgaggaaggctctgcggaagatccgtcatcgtatcctgctttcgttgatattcgtataagttgccatacggcggtacgccagccgcaaaccaatcggcatcgcgcacgtacggataggtgaagagtgacgccactcccccggagagtcccatcccaacgtacgacgaacttcatggcctcttggcacaccgacgtatgtaccgttacatattcttccaccggaacgatatcaagcaagcgcatgttacgctcggcgcgtcatcgcctaagcgcagcattttcagcgattccggcgcacagccaccatttgccaaaacacgatgttgtgaataccgttacaaccattggaagcattacgggcattgtccaatgcccatcacaggcgaaacatgaggtgacgttatgccgagcggcaaaccaacattgcgcgacgtagcgaaggccgccgggttctcccccatgaccgcctcgaatgcgctgcacggcaagccgggtgttaaggattccactcgcgccaaagtgctggcagtggccgaaaagctcgattaccgcatcaatctgacggccagcatgctgaagtccggccgcagcaacatcatccacatcatcgtcaacgaattcgattcgccgttctactccaaactcgtcgaatcgctcgtcaccgaaaccaccgcgcgcgggctgacgccgttcgtggagcaaacccggtactctccggatgccgccaaacacgcgctggccaacaacccgttctccgggcagttgttcgacggcgagattatccacgcttcgggcctgaatgccggtgtgccgctttccgcgatcaaccacggccgaccgctggttctgattgacgcctgcgaggaaacgcccacgttcgatacagtgaatttcccgaacgaagacggcgcgcgggcggcagtgcagcatctcatcgaatgcggatgccaccgcatcgccattgtcggcgacgggtattcgccacgaaccgaactggcgcacgtggaaagttccagcggtttgcgtctacgcggggccagcggcgcactgcttgacgccgggctgccgtatgacgaatcgacgaacttcattggttacggtagcgacagcggcatcgaagccggtcatgccatcgccgaggcgatgctcgaggctcgtgcgcaatcggctgatgacactgctgagtcccgttccccgggcaccacgcgggcaacgggaagcaccccggccatcgatggcatcttctgcattaacgactatgccgcattcggagtaatccgaggccttgccgactacggcatccgcgtgcccgacgatgtgagagtcatcggcttcgacggcgccacggccggctcgtacaccacaccgacgctgagcaccgtccaagtggatctcgatcagctcgcccaattcgcgcttgatatgatcacccgccgcgtggagcagcgcgaccagggcgacggcaggtccgacgaatccgctggcatgccggccacgcgcgccaccattggatacacactggttccgcgcgagtccactgtcggttcggcaaacaggtaacgctgaaacgccgaaatagggcggcgattcccgactgccgcgcccactgcccaagtgccgtgcagcgtgacgtgcgaggtttcggcatgcgtcaaaccgttcccagcgctcccacgtggtagtggcgcccatgcgcacttttcctagggttaggaccatgaccttccctaatcacacggtgttgtagaggcgggcggggaaagcgtcgcggtattggccgggggtcaggccagtgcggcgcttgaagacgcgcatgaagtacttgggatcggcgtagcccacttctcgcgcaatatccgccacgctggaagcggtagaactcagcagttcgcgcgcacggtcgatgcgatattcgatgatctgctcggccacacccacgccgaacacgcgccggtacatcgcggtcagatagctgggtgaatagtggaagcgcgcggccactttggccacggtgatgtcgtcgaaggcattggccataatccacgagcggatggccagcatcggcgccaggccggacgaatcgccagcggcaccggccgaatcgacatgcatggcccattcctgttgctgccggacgcggtcggcactggtgatgggcttgccgtcgccccggtagccggcaagcgtacgatgggcggcaaagtccgccttcagccgctcctgcgcgctgacctccagcagcaggccggtggcgaagtaatcgcagtaagcgttggaatacgggccgaatcgcgcatagatgtcgatgagctgcccacacatcaccgccagccggtcggggtcgggcagggtgcgttcatcgggcagcaacaggcaatggtcgtcctgcggcagacccgcgtcatcggggagcatgcgcgcatccggcaatttgaaatgcatccagtagaagtccacgtcagacgtgatgatgtcggcgcccgcatgctccacattcggcggcaagagtgcgatttggccggcctcgatatgcagggtctgctcccccacccgcatcggcaggacgccccgacgcacgaacatcagctcgaaggtgtcgatggtgcgccgcagatggcgccagcccggtccggacacaaactgcccgaccgagtaaaagtccaccggcccttcgagccgacatgtcgtgatgcccatggctaccagagtagccgagagcaaatatcagccgcgcagccagacggtcatttcgttttcgccgcggttggcccaggcgaagtacgggatgagcgtggcggtggcgggctcgcgcttgaccggcgcgtacacggcgtagagcggcgcgaacgccggaacctcggccgcgccctcacccgcggcggccacagcagccggcaacggctcgcgccaagccggcacctcaagcttcaccatgcggcgggtcacgtcttccacctcgccctggcccttgtcgtcgatgcccttggcgccggcgtggaagtcgaactcctcgaccttggccgcgctcgggtcggccagcagtgcctccacatccgcgtgcagcaggtgcaggttggcgccgttgtctttttcctcggcgcagaaggtgatcgggccgcgcacgaacgccaccttgccggcgtcctcgcgcaccagcgggttggcggccagcatacgcaccggcatcgggaagtcgaacgtcacggtgtcgccgtcgcgccactcaccggtcagatacaggtagccgtcgcgaatttcgcgggtcacgcgggaactatcggccccagactcagactcgcccgtggccgtaatcgcggcggcagcagcggactcatcgcccacccaaccgggcagacggaaggccagcgtaaagcgagcaggagcctgagccgaggtgccagcagcatcaccgcccaagcgcacgaccgccttgccatcgccttgccacggcaggttcgccgtaacatccagctccacagccgtaccattcaactcagctttggccacgccgcccatatacaagtgcgtgaacagcgtaccgccatcctcggcaaccgtgtaggcatattcctgcaccgactcaacgatgcgggcgatgttcggcgggcagcatgcgcagccgaaccacttctgacgcaccggcttgacgtggcgcaggcggctgtctttatggcaggcatacggattgacttccagcgggttcacgtagaagaagctcttgccgtccagcgccatgccggccagcgtggtgttgtacagcgccgactccataacgtccgcgtactcggcctttggcgcgagctcgagcatgcgacgggcgaagaacgccagcgaaatcgcggcgcaggtctcggagtaggcggagtcgttgggcaggtcgtagttgtaggagaatgcctcgccgtccaccgtgccgccgatgccgccggtaacgtacagtttcttatcgacgatattgcgccagagccgctcggccgcatcggcgaggtcctggtcgtcggccagtcgggccacgtccgccagaccggagtagaagtagccggcgcgtacggcatggcctacggcttcgtcttgttcggtgaccggcttgttcgcctggtgataggcgtaccggttggggtccgtgttgggtttgtagttggcgtcggcgtcgcgctttgcgttctcgtctgcctgaatatcgaagatgtacggctgccggcctcgctcggtcacgaaatattcggccagatcaaggtaccgctgttcgccggtgacctcgtacagcctcaccaaagccatctcggcaatctcgtgaccggggtaaccacgcagctggcccggcttgcgaccgaagcgctcgtctacgtaatcggcgaaacggcaggcggccttgagcaacttgtctttgccggtgccctggtagtaggccaccgcaccttcaacgaggtggccgaggcagtacagttcgtgatggtcacgcagattggtgaacgcgcgatccatgccgttcaggatgtagtaggcgtccagatagccgttgtcgagctgggcggcacacacgacgtcgatggcttggtcggcggtctgttccagtgcggggtccgggtaatgggcgagggaatagccgactgcctccacccacttggagaagtcggtgtcttggaacacgaagccgtagaacttgtctgggtcgggattggccgggtcttcggggagcgcctcaaatccgcggaacgtgtacttcggcggcacgaacgccttgccctgggtatccttacgcttgttttgcgcggcagcggccttgaagttgtgcatgcagtagctgggggccgcgccggggacgttatcgttcagggcgttccactgatagggaatcacagccgtgcgcacgagttcctgctcggtgcgccagaatgaatcggtgacggtgacgtttttcagggccagcggcttgctatgcagcgaagtcatgacgtactcctttggactatgcgacattcgtcaacaatatgtatcggtacatatgatacgtgcgcccgcgcgagcagcaaggtggacaaatcgttggcggggtggaatcgccggcgcatatccgcccgtacgatttcgcccggtgaatcgtccgacgaatacacggcgacttatactaccgacggaccacaaacgtcgcctacatgaatggaagatcaatcatcatgacagcaaacgccagcgcacgggccatcaaacccgaacttctgcgtacgtacaccgaagacttcaacaaggaccgcgccaacctgatcgcggcggacgcggcggtttcggccggcgtgctcaaggcggccaccgactatcgcggcgtgcgtgcgctgccacgcgacttctccatcgaactcaagcagggttcgatcaccaatcaggagcgttccggccgttgctggatgttcgcctccctgaacacgctgcgttacgaactcatgcatcgctggaatcttgaggatttcgagttctccgagacctacctgttcttctgggacgcgatggagaagtcgaacacttatctggagaacgtgctgcgcacgctcgacgaggcgaccgattcgcgtctgttcgaggccatcaatgagtcgcctgcagacgatggtggctggtggcagatgttcgctgcactggtgaacaagtacggcctagtgcccaagagcgcctacccggagtctgagaactcccgcaattccgacgatttcaagcagtacctcaactccaagctgcgcgagttcgcggccgagctgcgccgccgttcggctgccggggcgtctgaggacgagctgcgtgcgttgaaggacgagtacatgggcaccgtgtaccgcatctgcgccgtggcgctcggcgaaccgccggagaagttcgacttcttcgcgcgcaccaaggatgatgatgaggataagaagggcgaagcttgcaagtgcaaggccgaggccgacgcagacggcaaggccgaatcctgcaagtgcggcgaatcctgcaagtgcgagggcaaatccgacgccaaggcctgcaagtgcgataaggacaagtccgacaagccgaaaaccggcaaggacgagcgcccgcagattcgcgagatcggcatcaccccgcttgagttctacaagaagtacgtgccggtggacgtcaacgatttcgtgacgctggccaacgccccgctcaagaaccgcccgttcaaccagcgctaccgcatccgcttcagcgcgaacgtggccgaggctggcgatatggaattcgtcaacgtgccgctggacgtgttcaagaaggccgcgcttgaccagctcaccgccggccacccgatctggttcgcctgcgactgcacgcagttcgccctgcgcaaggacggtttcttcgaccagtccgtggtgcgcgtcgaccagctgttcggcaccgaattcaccggcgacaaggcccacggcctcgaatacggcgacagcccgagcaaccacgctatgaccttcaccggcgtgaacctcgacgaggacggcaagccgaaccgctggaaggtggagaacagctggggcaaggacgccggcaaggacggctactacgtcatgtccgacgcctggttcgaccgctacgtcaccgagctcatcatccgcaaggaatacctcgacgacgccacccgcgccctgctcaccaccgaaccagtcgagctcgatccctggcagcctctcacccgccgctgccgctgatatattccgtctattggccgcggctgaagtgctcctatgttttgccgactcctcacagagtgagcaaaacataggagcactttagttatccacagagttatccacatcctcagcaagctagaaccacataccccgtttttcatggcgaacacgcgaccgctacgctacggtggcgttatgaacagcggatttcccaccccgccacccggcgtattcgacgatgaaccacccggctggaccaacaatgccgcggcaccgagtgctgcgtccacgcacgccgtcaagcccgagccatactcaccaccgcgtatggcaacccccactgcgcccgctatgagcgaaaccctcacccaacgtaagcgggaaatgcttaaacgatgcacggacgccgcgcaacagctcggaaagccggtgctcttcggcatgaccacatcgctgatactgcaatccgtgccgcttcccaaggattgcgatctcaatgccaccgagctccataccgtctccgactcgcatagcacccggatacgcgccgtcgttccgccaacaacaccgcacatctggaaaccgctaagcgccgcgcacaatgcacgtatcaacaagcatgtgcacgcgctgaatctggtacatacttgggcgcagctcgccgctcacatgtcattggaatcattggtcatacttggcgacgcaacccttacggcaatagcgcgcaagccgagcctatcgggcggccgcaccgccgacgaaatttatcaggactttgtgcggcaggtcagcgaacttccgaaattcaacgcgaaagccacatgcatgatcgcacttgaatttattgcaccgcgcgtggattctccgatggaatcagagacccgtatcacaaccacgcaatacgggcttccacgagccgtgacaaattacacagtgcccggcgcgacgttcagcaatggtgagccgataacactcgatctcgcttggcccgaattccgcgtcgccatcgaatatgacggcgatcatcatcgcacagacaaggcccagtggcggcgagacaacgacaagcgcgaactgttacggcatcatcattggatcgtcctcatcgccaccgccgcgaatatggctgatgaaccgtctcaagccgaactcgcctaccgagccgggcgacagctggcgttgcgaggcgccatattcgatttcaccttgacagcgacgccgctcaatgaacttgcccggcggaaacgacggaaatccaccggggcgcactgagctgacatcgatacgattgcgcgcgcttgctgcaacgcatatgccattcatcgcaccccatttggtcgcgtggccccgaccgcatggcactgttgtgtgtcacacgccatgttacgtccggcgaatccgcacatcatctgcgttgcgtactgccatattatgcggttcgcgatatacgtcacggtgtccgatgtcctggtaacgacgtcaatcgatttatgtgtgtaccgggccagattttgttgtcccggttctccatttcgcctctttttgagcaaccgggacagaaacaccctcgaaaaatcgccaattcggccctaccgcacaatatccgccatcacacatcggcggaattccgggcttctggatttgcatacattgagcgctcacgggatggtctgtcccggttcccaaaaagaggccaaaatcacgaaccgggacaacgaaatctggcccggttcgcacgtcaatcggttgccgtcaccaccgggacaccgactgcgcatagataagatgcttcaatgcttaacaggcatgcgaccataccgcgatagcaacgtttcgctggaagtagaggaatcaagcagcaccccaaaccggaagtatggggggactcctgcaatgctccgacagcatcgtaacttgcgttgcatgatgcggaccaaaacgaagaaacccggcggagggggccgccgggtgagagagaagagagaagaagggttcagttatggggttcggaagaacctcgccaccggtatgaacttcattccgttgacatcttctatataaccgtctctttcttggggattcgatgtgcttgtctgagaaaagtcttggcaaactgtgacgggtttgtaacgccgcccgacaaccggcctcgcattgtcggggctaggccgcacatacggcaacgggccaccccgcaacacttcatgtgcgaggtggcccgtcagctacgagctagcaatgccgaatcactcggcggcgagcttggccttctcggcggccagacgttcggcttcggcggcacggcgagcagccaacgcttcatcgaagcgagccagctcctcttccacggcctcggtcggaatcttggcgaagatcggtgcgggcttaggcaccatggcgccgacctcgattgcctcgctcttccacgggtgcacgttcacaccgagctcgtaatcgccggtgatgatcgggtacgtgaagccgggcttgtcgagatcctcgacttccttgagctcaggcagcggcgagaaggtgccggtgccgccgagcgcctcccacaccttctgtgcggagtgcggcaggaacggcgcgagcaggtggttcgcgtcagacacggcctgagcggccacgtgcagcacggtgccgagacgagcctggtcgtccttaatcttccacggttcggtggcggaaatgtacttgttgatgtcgccgaccacacgcatcgcctcggacagggcgtgcttctggtggtgggtttcgatggaggagccgaccacgtcgaacgcggcggaagcctcttccagaaggccacggtcttcgttggtcatcgaatcctcgtccagcggcggaatctcgccgaagttcttgttgatgaggttggccacgcggttcaccaggttgccccacgaggaggcgagctcctcgttgttgtggcgcacgaactcggcccacgtgaagtcggaatccgaggattcggggccggccacggaaatgtagtagcgcacggcgtccacggggtagcgggcgaggatgtccttgacgtagatcacgatgccgcgggaggagctgaacttcttgccttccatggtcatgaactcgctggccaccacctgctcaggcaggttgagcggacccatcgggccggtttcgccgcccttggagcccttgccgttgtacgccagcatttcggacggccagatctgggagtggaaggtgatgttgtcctttcccatgaagtagtaggccgggcagctcgggtcgttccaccattcgcgccacttctccgggtcgccctggcgtcgggcccattcgatggaggccgacaggtagccgatcacggcgtcgaaccacacgtacagcttcttgttcgggttgtcaatccagcccttcaccggcaccgggataccccagtcgatgtcacgggtgatggcgcgcggcttgacttccttgaacaggccgagcgagaagttgatgacgttggtacgccagcccttgcgggtctccagccatgccttgttggcttcggcgagcgccggcaggtcgaggaagtagtgctcggtctgctcgaagcgcggggtttcgccgttaatcttggagacggggttgatgagctcgtccgggtcgagctcgttgccgcaggcgtcgcactggtcgccacgcgcaccttcggcgtggcaaatcgggcactcgccctcgatgtagcggtcgggcagagtgcggccggtggacgggctaatcgccacctgctgggtgcccttgtagatgtagccgttctccaagcactgcttgaacatctcctgcaccacgtgctcgtggttaccggtggtggtgcgggtgaacaggtcgtagctcaggccgaggtcgcacagatccttggcgatcacgcggttgtaacggttggccagttcctgggcagtgagaccttccttctccgcctcgacgagaatcggggtgccgtgctcgtcggtgccggacaccatgagcacatcattgcccttcatgcgctcgtagcgcgcgtagacgtcggagggcacaccaaatcccgcgacgtggccgatatgacgggggccgtttgcatacggccaagcaacattcaccaaaacatgactcataaggcttgattatccggcgcggcggggacacgcccggatagctgccgcgccgccatcctcatcccactcacctatccacccgcaacttccccacatacttatccgtacacctcttgcgcgcttatccacatacgcattcgcacacgtatccgcgcacccatccgtacgcacgcccacgcacatccgcacacacttccgcctgccaatatccaccgagttatccacatcatttgcacacctagtaaagttatgcacttatccaccgttttcgcctatccggtggcgcgcaagccgcatttctgcatattgttcggtcatggatatcacagcaggtccgatgacggacatcacaacagccgcctcgccggcaaccgcgcagcccgcggtgccgccgatactgtttaccaaggatctgccgggaccgctcagccttaaccgtctggccgccttcggcacgttacgtaagctcgacgattccgccggctactggatcgagcattcgggcacactgtatggtcgcgcgaaaatcgtcgcggaggtcgccccgtttggcactgtggtgtgttcgatgaccgccgcttgggtatggctgggaggccccgactttccgagtaccatagacgtgatttccacatcgcacttccgctcggcatccgtcagccgccgtatccgcgtattcaaaagattgacgttgccggagcaaatcatcaagctcggcgggctgcctgtcaccacgccagcccgtacggcttgcgacctggtgatgagtcctgaagacatccccgatccttccaccgtcaacgcactggtgtgtcagctgatgtccgcgtaccagtttcggccaaacgactgtctgcaaatcgtcaaggaacatcggcatcacaagtatgccggacgcgcacgcatgttttttgaatcggtgcagcaggagatggacgaaccggctttggagcaatgcgcatgacgagggggttcattgtcagaggccatcgcagaggccgccatgccgctcaccgtttacggcatttgcggcaggcgcaacggttgcctcgccacgcggcggcggcacactcatccgaatccgcatcgcgcgcaatctcggatatgaccgcgccgcctgaaccgcccatcagacttacgcccgcggtggcatgttcgcccgatacggatgttgccgtgctctggcacatcgcatatcacgtgcccgaactgcgtaaatggctggttgccaatcccaaagccgacgcgcctttgctggaattggtctcgcagcgtggtgggcccggggtccggcaggcgttggaaatattgttcgagtcgatggaagcgtaacggggagataatcgccggctgctgcgctatcccttgattttcagcacagccgcatacacctgcttgcgattggccaacgatccgtcagccagtggatgctcctgcaccacttgcgcgatggcgtccttgatacgcaggccgtcctccaaagcacggtcgatggagagcacggccatgtcatccacgctcaacgtgctgggcgcggccgcttcggcctcctcgttggacgcgccgccgatgaccagcaccatctcgccacggggcggatcatcaatcacactttggcgaatctcgtcaatcgggccgcgacgaatctgctcataatccttggtgagttcgcggcacagggccatcgggcgattcgggccgaacgcgtccagcagatcgtccatcgaatcggcaatgcgatgaggcgtctcgtagaacacgatggtgcggcgttcgggcaacagcgtgcgcagatactgcacgcgctcggaatgctttcgcggtaggaagccttcgtagcagaagcggtcggtgggcaggccggagagggcgagcgcgtcgagcacagcggaggggccgggcgcgcaggtgacgggcagaccgcgttcaatggcacggcgcacgatggccaagccggggtcgttgatggtgggcatgccggcgtcggatacgacgagcacggtggcgccggtttcgacctggtcgagcaggccgtcggccttgtcgcgctcgttgtggtcgtgataggcgatgacgcgaccgttcacatagacgccgaggcgacgggcgagatcgtagaggcggcgcgtgtcttcggcggccacgatatcggcccgttccaagagggccaccagacgggctgaagcgtcgccgacattgccgatcggggtggcggcgagcaccacggtgccggcggggatggtcacggccgattcgcgggattgggcgacggcggattcgccggcatgaacttcatcattgcgttcaggcacttgcgtcacgctaccgtcagcgtcatactgctcattcaactcatctgcgcttgtcatactcccagtattgcccatgccacagagcaatccacgacaatccatggcgaaatcgaggcattctccctttgcaggggctgatttcacatgttccggaggtctacttccgtttcaaggggctcctcatccggtgaagcaccgatacaaacggctttgacgcaacgctattccgccattttggcggcgtatctacttgaccatcagcccctcgaaacgcaagtagacctccggcaaaccccaaatcagccccttgaaacgcgagatggcagaatttcaacgaaaacaaatgaaaagaccctctgcggtggaatgaatgcagagggtctcgtggagctgacggtagtcgaaaccgcgacctcttcgatgcgaacgaagcgctctaccaactgagctacagccccttggatgttactttgctccgcaaagcaactcgcaacaatatagtacggagtacggtcaaacgcaatttgacgccgaagtgtcgcacgcgtgtcgacacggtaacgtttcggtgtcgcagacggggcaagtcacccacaccgctccgcatggataccgcggcggcacccggcaacgtcatcacgtctccagcacgcccagcaccttcttttcgttgtagaacgcgaacacgatgccgcccagaccgcacagcacggccgcgcacacggcggcgatgcggtagcccgcgccggacgccatgccgatggtggagacgccggtgaacagcagcatggccacggactggcccatcttcatcgcaaaggtgcgggccgcgtagaacatgccctgacggtcctggccggtggtcttggaactggcgtcggcgatattcgccacgatggcctgcggcaggatgccgaacgcggccatcggaatcgcgccgaccaccgagagcaccaaaccctgggccatcgccggaatgaagccgagcacggccgaaccaagggcgccggcaaatgcgaacgcacaggtgaagatcacgaaggcaaccagcagcagcctcttcttgccgaccttattggccagaatattgaccggcagatagaacagcacagagacgccggtcatgagcacgaagtagatggtcgtggtggtttccggcagcttgagcaggctggtcacgaagaacggcagaccggtctggaaggtggtgatggccacccagtagaccacgtcggagcatacgaacttgcggaattcgccgtcgccgaacgtctgcttcagggattcgatggtcgattcggaggtgggatgggagttgacgtagtccttctcgcggatggccagcggcggcaccagcatgcacacgaacgccacggcggccatgatggtgaaggtcacgcggatggcggtgatgcggcccatcatcggcacgaacgcgccccaaatcaccggcgccacgtacgcgatggccgtgccggccacccaagtgaaggagatggcggtggagatggtgagttgctgcttggagtcgtggccgagttcggcgatgagcgcgttgtacggcgtgcagtagaacgtgagggcgatgtagtagccgatcacggtgacgaacaggaacgccgcgttcacccagctggtgccgttgatcgggctccagaacacgagcacggtgaccaccgcgagcggcagggcggcgaatttcaggaacggcatacggcggccggatttggcgtcgcaacggtcggagagagacgccacggccgggtccacgaacgcgtcgaagaatcgggcgaaggcggtgatgccgcccaccacggtcacgatgccgagaacgaccaggccctgcggcacgaatacggtctgaccttgggagatggtctcctggtcaggttggtagaaatacacgagccagttggagatgatgccggaaagcagcgcccacccgaactggccgaccgcaaacgcccacactttggcgatggggagatctctgatggctgacttcgccggtgcaacttgcacacccgttacacttgctgtagtcgcattgcccattctcacaacctccgaatcaacattgacacagtgtcaaaatccagtatacaccggcacaccatgcgctctacgatagtgggcatgacaagtctgaccgagcaactgccatacgtatacgcttttcctgatgcgttggggaccggattactggtgcacaccgagagcgtattggacgatgagatacgcgatcgtattggctcgttcatccatgaatatgaggttgtattatctcgattccgcgatgattccatcgtcggccggatgcgcacggccgcacatggcggcacgttcgattttcccgactgggcatcgggtctgtttggcctgtacgaccgcctgtttgcggcaaccgatggggcgaccgacccgtgcgtgggcgaggatttgattcggcttggctatgacgagtcgtattcgtttacgcctgcgccagatgccgctgaacatgcaggcgcgatccacggacgagccatttggtcagccgacgttgagcggcatggcacaacactggtgacgcgcggaccggtcgcgctcgatttcggcgcgtgcggtaaggggtatttggtggatttgcttgcggggatgttgggtgatggcgcgggtcaccctcaacccattcaatacgtcatcgacgccgggggtgatttgctagtgcacacggacgaaccaatcaccatcgcccttgaagatcctgccgatccggccaacgccgtaggtgcggtcgaaatcagccaaggtgcattctgcgcgagctcccccagccgccgccactggtctgacgccgcaggtcaccaacttcaccatctgctcaacgccatcgacggactaccggttgacgatgtagccgccacatgggtggccgtcacgccgccatcgagcgccataaccacgaagacatcgacgcatggcagcaatgcctcgacaacggcaaaccgcgataccgacgattcgtcgaacaccgttgcggcacacgtccctgtcacactggccgacggactcgccacagccctgttcaccacctcggccgcccagctgcgcgctcacttccccttcgaatgcgccatcctcaacgccaatcgcaccgccgcacaatcccccaattttccgggcggttttttcacacactaatgtacgaaatcatcagtatcacatccagtggagcattccctcgggtggaccgatgggttgctcccctcagtcagctacgctgacagctcccctcggagaggggagccgagtatagctaatccgctaatccgctaacgcaggaaacaatccgtcagtcagcgagtgcgaactggctgttgtacaggtcggcgtaaaaaccgcccgccgccagcagctcgtcgtgcgtgccgcgctcgatcacgtcgccgtggttcatgacgagaatcatgtcggcgtcgcgaatcgtggagaggcggtgcgcgatcacaaagctcgtacgccccacggtcagcgcgtccatggccttctggatcagctcttcggtgcgggtatcgaccgaggaggtggcctcgtcgagaatcagaatcggcgcgtcctgcaccatcgcacgggcgatggtgagcagctgcttctggccctgggagagcgacgacttgtcgtcgagcacggtgtcatagccgtccggcagcgagcggatgaagtggtcgaggcccacggccttgcacgcatcctcgatctgcttgtcggtcacgccgggcttggagtaggcgatgttctcgcgcacagtgccgcggaacacccacgtatcctgcagcaccatggagaactggtcgtgcacgttccagcgcggcacggacttggtgtccacgccgtcaatcgcgatcgagccgccggaaatctcatagaagcgcatgagcaggttgaccatggtggtcttgccggcaccggtcgggccgacgatggcgaccttctgcccggccttgacggaggcggagaagtcgtggatgatcggcttgcccggctcgtagccgaactgcacgtggctgaattccacgtcgcccttcacttcgtggccgttggtcccaagcaaagcggacttgtcggattcgtcctccatctccggctcctcaaggaagccgaacacgcgttcggcggccgccgcgcaacgctgcaggttctggaaggcctgggcgaactgcgccaacggctgggtgaacaggcggacatacatcatgaacgccacgatcacgccgaactcgatctgcccgtcgagcgcgagcgccgcgcccaccacgcacaccaccacgtagccgaagttgcccacgaaattcatgagcggcatcatcaggccggagaggaactgcgacttccagccggactcgtagaggtccgagttgtacttctcgaagcgacgaatcgaatcggcctcgccgttgtatgccttgacgatgaggtgaccggcgtacatctcctccacgtggccgttgacgtcacccagcgccatctgctgccgggcgaagtacttctgggaggacttcatgatggccatcatgatgatcaggccgatgaggctggcaccgatggcgcacagggtcatgatcacgttgttgtagaacatcatcaccagcgcgcccacgaacagcgtcaccgaggtaatcagcgagccgagcgactggcccagcgtctggccgatggcgtccacatcgttggttatgcgcgacagcacgtcgccgtagctgaccttgtcgaagtatttgagcggcagtttgttgattttgaccgagatggactcgcgcagtcgctgggcggtgcgctgggtgacgttggccatcatccagctttgcacgtagccgagcacggcgtagcccacgtacagggccaccaaagtccaggcgatgtggcccaccgtgccgaaatcgaccgagttcatcaccggtctgccgttaacgatggcgggcagacctttgacgatctcgttggtcatgtccttgagcttgtccgggccgacgatctggcagacggtgccggccgcgcccaggatgagcgcgatgatgatgacgggaagatagttgcggcagtagttcacgagtttgcccatgactttgccgaaatcatggggctcttcgacggcacgcctgccgcccattggtcctcttggcatttgttttactccttaaaagtccgtattgacctccctctgatgaaggaggtggcgcgaagcgccggagggagagaagccgtacgcgactacccctcagtcagctgtgctgttttattcgctcgcttatcagctcgtcttcgcctgggaacagcccactgggctgttccctttacggctcagcccctgacatggggagctaccgctgccgcccccccctacgccgtaagctccgactggctgagctgggattcggcgatctggcggtatacgtcgcagttgtcgagcagttccttgtgcgtgccctgacccacgaccttgccgtcgtcgagcacgacgatgcggtcggcgttcatgatggtgccgatgcgctgggccacgatgagcttggtggaatccttggcctcgcgggcgagcgcgtcgcgcacttcgcggtcggtcttgaagtcgagcgcggagaacgagtcgtcgaaaatcaggatttccgggtgacggtacaccgcgcgcgcaatcgacaggcgctgcttctggccgccggacacgttcgatccgccttgggcgatcgcggcggaatacccgccgtccatgcgcgccacgaactcgctggcctgcgccacgtcggcggcggccctgacgcgattcagctgctcggccggtatatcggcaccttccgcggcctcgccagcggcgatcaacgcggcctcgcgcttgcgcccggccggggtggaggtatcggccatctcgacctccgccgggtcgcccggctgatcgccgtagctcacgttggaggccacggtgcccttgaacagcacggactgctgcggcacgtagccgatcttgtcgcgcagggccttcaggtcgtagtcgcgcacgtccacgccgtcgaccaacacctggccttggctggtgtcatagaagcgcggcacgagattgataagagacgacttgccggagccggtggagccgatgaacgccaccgtctggccctgctcggcggtgaagttgatgccttccagcatcgcctcgcgcgaatccgggtaggtgaagctgacgttgcggaattccacggtgcccctctggccggttttggccacgtcggcggcggttttggtgccgttctcgacgatcggctcagtgtcgagtacctccatgatgcgctgcgcggacacgtcggcgcgcggccagagcacgaacaccatgctcatgagcaggaagctcatgatgacctgcacggagtagttggagaacacgaccatgttggagaacacggtgagcttgtccttgagcccggcggcatcgatcaggtaggtaccgatccagtagacggcgagcatcagaccgttcatgatggtgttcatcaacggcatcatgaacgccatgacgcggttggtgaacagctgggtgtcggtgaggtccttgttggccttggtgaatttggcttcctggtagtcctcggcattgtaggcgcgcaccacacgcaggccggtgaggttctcgcgggccacgaggttgatgttgtcggtcagggcctgcatggccttgaatttcggcatgaccatggccatcatgatgacgatggccgccagcagaatcactacggcgattccggtggcgagcgtccattcgaagccttcgccggcgatcttgcacacggcccatacggccatgatcggcgatttgacgatgagctgcagacccatggtgatgaacatctgcacctgcgtgacgtcgttggtggagcgggtgatgaggctggcggtggagaacttgctcatttcggccgggccgaaggactcgaccttgcggaattcgagcgagcgcagacgctgggtgaacgaggccgccacgcgcgcagcgatgtagccggtgatgatggcacacgccgcggatccgagcgagatgagcagcatcttgccgccggcaatccagatgtccttcatgtggctgcccggcgtttcgaccagcgtggtgatgtctgacatatagtcgggcagtttcaggtcgaagtagacctgcccgacgatggtcaccagggcgatgagcatctgaccgatctccgctttggagaggtatttcatgatgcgaagcattggtttccccttgtgttggttgggttggttattggttattgacgattggttcttaagttggctgggttatcggcgattatcggttcacgatgtcttaatagtttctattgtttgattacttacactgtgagatattacgcgcacttctgcatgttcgctgtgagcgtcctcaattagccttgccgattagttctccgcgcgcttagctgccatgtgttcagccacgcgcttgccccgctccacgaatgcctcacgcacctgttcagcagtcggccgaggctgtcccggatggcaaatcgacatatatgtggtgaactcagacaccaggtcaacgaattcgcgcgtgcgccgctcccccatttgcgagaaaatccagcaaatcgcggaacgcatttcctctatcatccgatgagactgctcgcgcccggaatcagtgagattcacgcgaataatgcgccgatccttggaatcaatgtcacgcgtgacccagccttttttctccagagacgacagcacagtggagatgcggccggaactggcctgcagcgccgatgccaattgcgatggcgtttgcgtccccttcatggacagctcccggagcacgaactgctcaccatgggctccacgagtgaattccctctgcattgtcgaacgatcgccccacacgctggcatacagttcactaactgcttcctgctcaaatcccataagagcaccatccatttccattcgccacacggcagagcgccgcaaacatcccaagaatatctcacaccgtaaacaattcgctactagaaactatttttggaacgcataatgcacacactccacgctctttgatattctgaaagccgcatagatattcacttcggggcgtcgtctaagaatatttgctgggccaacggtagcgacgttggcattgtgctccatgaggtatctggtcgaaaaggcggacgaagacaggccagttgggcggagcgcgcccatacctcaaaaccattgcaattattcgctttgaccattttcgtggagtcacgaaaatggtcatgaaaaacataaggacacacccatgaaccgcgacgaaatcacacgcaaaaccagcgaactcagcactatcgcacacaccaccgaggactccaaagttgagtattggtatgcacgcgagctaatgacctatatggggtacgacagatgggaaaacttcagcaaagctattacacgagccaagcaagcttgcgacaattccggcgtatccgttgaatcccatttccgtgacactacgcgagacgtgactctcggcagcggtgccaccagctccatcgcggacgtcaagctcacccgatacgcctgctatctcattgctcaaaacggtgatccaaagaaagaagaagtggcacttctccagagctattttgccgttcagactcgcaaaacggaaatcattgagcaacgcatgggagaaatcagccggctcgccggccgagaggcccttgccactgcagagaagaaactctatccgtatacccaaatcacacacaacaaaaccgcacaagtgcacatgtacacgcccaaccacgccgcagaacgccggcaaggatgtgatacaggccacagaaagcgttgtaccgcctaggcaatgcaacaattgtccgctatgctctgaaggcagatggcggcacggatgccatcccaaagagggggtatgaccatgattcggggtatgaacctatgcagcatcgccggctgcacgcacgaagcagaagaagcgggcatgtgcaacatgcatttcacatcggcgctggttcacggagcgctgcactacactgcgggcggacgtccgtcgcactgctgagcgcaacaacaaagcaaaacaaccagtaacgctcaacggcttccacatgttcatgctctaattgcatgtacttgcagacacaatggccggtctgagccagctgccctcgcatggagcagctggctcagaccggccattattgttgctttgtactgtttgcactgtattgcgcctgcattgcgcaagctcgggcgcactcgggtgcactcgctgagtggcgtgaatcgcagattgctcaatagcaacgcaatccacgctactcagcagttgccatggttatgcgcggcgtttgcggatgacgagcaaggcaccagccgcagctgccagcaccacaaccacgaccgcaatggcagccacggcagcacccgtattcgaaaggggcgcagcgccattagcagccggcttattcgtggcagtgctaccgggcttagcagtgttgccaggattgttggtatcgccgggcttctgctctccagggccgggagtgacctccgtggccgtgaccgtgacttcgaacgtcgcgttcacgccacgataagagacggtgatggtcttcgtgcctgcggtggcagaatcaaagccagtgaacttcagatcaccatcagttggatcaatcagcttgcgcagcgtttcggtatcgccgactttgtaaatggcggataccttcacatcggcagcgttgaacttatcgcctacctgataggaatccttggtcacttccacagcaagctcagccaactgaggcagttcgccgaatgtcactgtgtaggttttcgccgtgccatcctcagcagttacagtcaccgtggccacgccgttgttctcggccgaagcctgctccacttgcaccgtagcctttgcgtcagcagcagtcgcctccaccgtcgggtaagaagcagcgtctccggccagcgcaccggcatattcggtgatatccgcggagaatccgtcaaccgtcttgccatccacagtcagatcagcaagattggcgttactagacggctgcggctttggcgttgcttcaccttcggcgatgcgtacttcagcgatcttggcatagtcattgccatcggcgtaggtgaagttgaggcgaatgcccttggtggcgggcagagcgctcacatcggcttccgtcacggctccagcagcaccattcacagtgactgccggcagcgtggcatcagtccacgtggcgctgtcttcagctaggtacgatacagtgaagctcttcggagcggcctcgcccttggccttatccaccgcaacgctgagcttgcccagctgatatgccttatcgaaggtgtagctgagccacggcgaggtgtcgccggtgccccagttcgaccagttggtgctcaggttgttgtcgcaagtcaggtcggccgtagaagcggaggcccagctactggccggctcatacttcgaggctgcggcggacgagcagaacaaccgggcaaggttgctttccacagtcacggtgaacgtggcggttactgaagaatcagtgacaaggcgtaccgtcacggtttgctcgcccaatttggtggtgtcgaagccttccaacgtgtattcatctggctccagtacacgcgtcttgccattggtgagcgtagcggtaaccgtcacgtccttatgcgcgagcgtctgcctcttggcgatagtggcttcagggcccttggccgcgatggactccacagcagcagtctgcgaaccgaacgcagtgccgttgaaggccacggtgaatgcgccggcattgctgttcgacgtggcgaagacaccggcatcgagcccggttgcgtccgcaccggtcagcgttaccgtagcgacatcctgccattcatcgttcgcggaagcacgccagtagcctttcagggtatcggttgcggcgcgctccagcttgagttgcacttggtcgccgaagccggcaccaacatgcgatgtttccttatcgatgtagccatcggcattggaatcgtactgcatgtaaatgccgcttgggctggcaagtaacgtggcatatcccttgccgccgttagcgtcagcaagaccgttacgaaccaccaggccggcacgcggatcgccattaccgcccaagtcgagcggcttgaccgtggtttccaacgtttcgttcacgtccagagcatcaggctggtacaccgcgctgccctcgttgcgatccgtccagacaccacgattggcgttgtccgtaacggtgaagtcataggtaccgccggatgcggcgacctggcacgcgctgccgcccttccaatgggcttccttccaacttccggaaatcgggttggagcaggaaacgtcgatggttctgcggaatgtgcggcccgggttgaagttgctgctctcggcaagagtgcctgtaatggtgtaggttcccggcacattgaatgcgtaggtgctgccggcagccttggtcgacttgctgactgccgtaccgccttccacattccatgtcaccttggtagcaatggtatcgtcgccttccttgacgttgacggtgtccggcagagtaacggttccgcccgtgttcacggtcttcgggagatcatcgccggtttccacagtccagttgaccagcttgcccttggcgctaccatggttgtcccaatagttcagatcccagccgtcgggctcgccttcttgagcaggattatgcatttcgatggtgccgttctcaccgatggtcagcggcagccaaacataggtggaatcggctttaccggaatcccaacggtcaccaaggtagatgaagtgacctttctcctggtctactgcgagcacactagccgactgcgaaccgaatgtggtgccgcgggtatcgcccacagacaacagaccatccgcgccttccggcatgttgttgtaccacgtgttctcgttggcatcgtccttttccacgccacgggtccagcttcccagcatggagtcggcggtgtagtaggtctgcttgttcgggtcccagccggttgcaccagatgcgatgatgttgtaacgcccgtcatattggaatacggcaggagcttccagcgaaccattttgtttgacgatttggaaatcttcgccacgcaccggggcatccgtagtaccgtctgcaagaatgtatgggtactgcccgtcagcagagtactgcttttgtccctcggactggtccacattcgtggtcttgactacattggtgtaatcatcgttaagcttggcgatatacagcgtggcattggcttcggaagaatacagtacataggcactgtcgtccttcggatccacgaacacagtcatatcgcggctgtcaccgttctcaccccagctggggttacctgcggcttctttccaattgttctggttaggcaaacgataggcacccaccatagtgaacgggcccgccggattgtcggaaacagccacgcccgcaagtgcacgtgcatagttggaaccgcccggcgtggtgcttccatcggaatgccaccacagcacgtattgcttgttcttcttgttgtagatgatcttcggacgctcgaaaatgccctgtacggaatcaaccgcgccatcaccatcctgatcggggttggtgttgaggtacgggaagattgcgtcggccttggcagcgtccacactgccgtcggacttggtcaggttgtaggccttgtcgaagtaggcgtaatcggcattgctcttatccgtcaactgagatttgctggtcaccgcacgcagcgccacaccaagatcggtccagttgtatagatctgtcgacatataagcatgaacaccggggctgttgtcgtaaccgttagaacggtcttcgccataccagtagtaggcgtcgccaaccttgaccacttggccaccgtgcgcttggatgtgtgtgccgccattatcattggcgttcttggcataccaatatggctggaagtaatcgctagcgttcttgcccggatcggctgtgggctggaacttggtgtatgtcggcacttggccgatggtaggcaggtaatccacacctgccgcactggcacttgcagcggccagcccgcatgacaatagcgttgccgcggcggtaattgccgcgataagagcgcccttgcccttattgtttatcttcattgatttggttccttgattgatgataacggttttttgaacaaacagttatgtcgctatccgcgaagtcagaaaagggccgacaaatcaatataccgatactgaaaactcagtattcaacctgtcggaccaattatgctcaaagagcggaggaaccggccggcaatagtcaatattgccggcttgttccttcccccattactgtgcgagggtgctatgcacgcttgcgcagcatgaacaatgcacccgcggcagcggccagcagagcgacagcgccagcgatggcggcaacattggaaccggtgttggccaccgtgttcttgttgccgttgccggtggcaccgggcttgttggtgctgccgggcttctgttcttcagggccaggggcgactgcgttggccttgaccgtgacgttgaaggtcgcggtcacaccacggtaggagacggtaatcgccttcttgcctgcggtggtggagtcgaacgagccaatcgcaagctgcgggtcgtcaagagcgaccggcacttccttggtcttgtcgccactctgatagacggcagtaaccttcagaccggcggtatcgagcttgtcgccgatggcgtactcgatcttcgtgggtccggtcaccttgagcgaagccaaagtgaaggctttgaaggtcaccgtgtaggtcttcgtctcagactcgtcggctgaggtcaccgtaatggtggccttgccgccaagcttgccattctcaaccgcgtcgccagtcaccttgacggtggcggcattgtcggcggcgaaggcctgcagcaccgggtttgcctcagcaccgaacggaagatcaactgtgtagtcggtcttatcagcagcgaagcccttgatggtctcgccgtcaagacgcaggtcgcccagcgtggcatcggatgccggctgcggggtaatcaccttgttgtcttgtgcgaacacctgaatttcggccacgttgatgtacaccttggtgtcctgcaacgtgttggtcaggcggatggccttggcctttaccggggtgtcgagcacgaagtcaacggtcggggtgtcggcggcggtgatgccgtcggagccagagccggcatcgccggcctgtgtcttccagccatccttggtaccgacttcatgccattcgccagcctcatcctggtattccagcgtctggctcttcggccaagacgcacgaccatcgtagtagaagaaggtcttcacttcggtgatggtctgagcttcgtcgaaggtgaacgtggcgaccgggtccaccgtcgaggcggtggaagcccaagtggaccaaccctttgacgtagtgtcaccatcgatggccttggaagcggaggcaccctcctggaagttcaccgagaagttcgtgccagaggccgcggcgatgttcttcacgcctccgacaaccggaaccacaaaggcttcgatctcggtagcgttcatgaagtcgccgttctgcgtgttgacgatacgcacctgcgtggccttgagtgaaccatcttcaggagtgaacgtaacagtctgcccggctttgggcttgacctcgctgccgaactgcgtccatgtggtgccatcagtggtgtactcagccttggcggatgccggagccttgtcaccataggtgatggtcaggccggtgacttctcgctcttcgccgaagttcaccgtggcggtcgggctggcagagtaatcattctttgcgttccacgtcacccaagcctcggccgacgtatcgtcatcggtgagcttcttccactggtcgcccttgctgtattccgtctgctggttggtcacagtcaggttggaagcagtgtcggccacattctcaggcgtggcggcggtgacatagatcgtacccttcagcgcaatcgtggtcgtgtcgtccagctggtaggtaccggccacggcaatgttgtcgccagccttggcctcggcgagcttggcatcaagcccatcgaagttccaagtaaccttagccgcatcgccctcgaatgcaggcgatgccttgacgtgcaggtacaccggctcagcctcaagcgcagccttggcgttgcttgcactggtgccggccagcactgtggcggataccggatcggaaacagtgaaggcaccaacgtagaccgtggcggtgacgttgaactcattgccgtatacgtcggcggcagtggcggtggcctcgtaggtgccttccttggccacatcgaccttggaagtatcccaatcggcgaccgttgccttgccttcgccccaggtgtagtagagcgtgacttcggtcggcagtgtagccttggcgttcacggcggtctgcacgttcacggttttctggccggtaggcgttacattgcgcaacgtccaggtctgattggcggatggcgaagtgccgctcggcgattgccacaggccaaccttcgtgccaactgcggtgccagagttatccacatcgaggttcgtcttagtcgcggcattgagcagctggtaggtcgaaccatcggaagtgttgagaatccacttggcagccgggtcggacttagcggcctcaaccgtttcgttggaaagcgcgttcgtgccatccttggacaccagcaccttgccttcggcgttagtaatcacataagccttgagatcagggcgctcggagtcggcgggctgctcgatctgggtaaaggtccaagtctgcttcttggcgttctcggcatcggaagcgacgttggccagggacagcgcggaatcaccagaagtggtatcagccacggccttgccggactgcttaccaacgagctggtaagtgtcgccggtctcgacggcagcatccttagcgtagccggtcacgccagtgagctggatggaggcgatagaacgggcgggcacagtgaccgtagcggtcttggcagccttgtcaatcatcacagagccttcagcttgcttgacgttgctggtcttggcgaagacttccggagtggcggaatcgacacccgcgttcttgtcttcggcagaggtttcggtggtcaggtagagctcaccgtaagcgttgtcggcaatctcgccgtacttcgacaggtcgatgacgaaggtctggtcagaggtgccggagttgcggtggatgacggtctgtgtcttgccatcgtcggaggtggcagtcatgttgttgtcctcatcgttgttggcgatgaccttgtcgcccgcgtggatgaagtgggtgatggccttgacgccgttgtacttggcgtttgcaataaccgtgcacggttcaagtccatcggtggtaccgccgttgttgttcacgcggcgctcggagtagagcttgccgtccatgccagccacggtgcagtcgaagtcgatgagcacggtgccccagttggtgttctcaccggccggattcacattcgagcccatctgcatgttgtagaggtcctcgaccacctgccagaaggtgaagtccttggactgcaggcgggtgacgttggagctgatcttgctcatcatgcccagcgcgttgtcgaaaccgtacgggttgtaggagccagactgccaggagccgtccacctcgctcatcgacagcttcttgccgtctgcctgagcgatatcgcgcgactgcatctggttgctgtcggagtaggcgtgaacgttgtactggccgataaggtccttgatcgcctgcgggtactggttgtacgacttgacgaagtcggcggagttcgtggcatcggtggctgcgatgatggtgtcatcattgtccttgagcgcctcagcgagtgcggtaatcgtctgctgctgctgggcgttgctgacatgcataccctcctgcggcttcttcagcgcgttggagtatggggtgacggacctatctttgtcggagtagtacttatcccagtagttgttaatgagcttggtgttgtcatcactctcatcggtgtacttcgaagccatgtcgcccggagtgccccagtaactggtctcggactcgttgaacggctcgaccgtgtcaacgtttgcgccaaggctttcgaggtgctcgacgttcttggccatgtactgagcgaatttctcagggtttgcaagattattgctaccggagttgcgtccaccagtggcgtaaccgctgttggtcaggaaccacggagcggagttggcgaaggcctctacgtcggtgatgtcagggttatcgccggtggcaccgcgctcaatccaccagtcttgggcggcggacttggagaagtcatactggttgtcgtcagtcgggtcgaatgccgcagccagcttgtctttgtcggcctgcttggtggttacgccattgccatacgtgccggaaccggtggcgtcatctttccacgtgccaggcacggcagcgccttggcgcatgaatgggtagccgtaggcaacatcggaggcattgccgccgcccacgttgtagcgggccatgttcaggtccagtccttcatcaccgaagatggactggtagaactgttcgcgcagctgtttgccgtattccacagccttagccttggaagcgtcatcgccgagattggtggtgatggccgattcctcgccgaggctgccggtggcgttggcgaaccaagccagtgaggtgccccagccatcgaaactgttggcataccacgggttcggggtcacggtaatggcatcgttatcagccgcatacgcagtgccggcaaccgcaaacgcccctcctcccactagtgttgccgccgcaaccattgcagcaagcgatttgctcagtaccttcattggtctccttagtgttcctgctgtccgccttataccggaaaaatcggcctttgcttcactgagccggcctctttgcctgatacatgacctacgtcgactccttctttcggcgcagccaaaatgtttacgcaaacattttgatatgagcgattttatcacaaaaccgtcacccagcaaacaacttcagagaccacaaacgacgcacaaagtcatgagccattcgaattgcgctggcccaatcgctacgaatcatatttgccgtagcccttaagtgaatcccactgcatcgagatatcgcgcccgctatcccttccgataacgccgaccacgcgtgttgccttcagcaatcagctttccttgcgcaactaaaccgtttaggaatttgcggactgttctgttatcgagctctgttatcttggcgagttcaggtacagtcacatagtcaacctctgtcaagcgtcgattcatcgccgacagcatcgctgcccgcgaatcaatttcacccgatgcggttgcatctgctttcttaccatccacacgttccccgccaatgagcctcgcaccctcttcggcatctttctcaactacagatctcacgctagcaaaaccagaaccatccacggtcttcagcgcaggaacaataggaatcgtcgcctcgaatatgtcaccatcgcggaactcaggctctcgctcagtatattgccgggacgctcttatcagattccgcagtccgctacccagctgctcggctatgccggtctgcacaaacacattagcgataatcggattctttggcattggcgtgaactcgcccagcttcattcgaccttcaaagaatgagcgcgaagcattaaccgtccggatggattcattatcaatggtgacacgcgccaccaccggactggaatactcccgatgcatgaggctgtttgccaccaattcacgggcgatcatcgtacgcgggctcactcgcttatcgccctttaacacaaagcggtcaggcagattccgctcagtaaattcacggagttgctcgtacgaatcgaacaagttggtccgcaccataagtcggtcatcgtatcggtcaatattgtctcgccgaaccacggcatcagtaatatacgctgggcaaaccgaggaaatgacttcatccttgcccaagagcagcactgcagcaagattaaagccctcttcgccggtcgtgtaatcacgatcgtatagcttggcgctgcggaacagttcttcgtcagacatagttccccaagggtgcccagctcgctgagcgaccgccagctgccgcattcgcgcaatcagctcaggacgcaaatcaaacggagtcacgtaacggaaaattcgccgttcggaatagtagttctgcttgcgaatatacatttgactaatctggatatcgctttcgatgtgtgtatccacatcagcaatgcgatcaaacactgcgcccttgaaccgcacaaccgaagaactcggagctacccaaatacgaacaataatccgttcgtcgtactcgatatgttccgtttccaccattggagccggttcgaacatcttacgattagacactacgttgacaacgttgcgctctatctcactaacgcgcttagaatcgacgccgagcacttgaccgtcatcgtcaacgccaagataaatgctgccaccagaacgattggcgaatgagcatacagtctcaaaagtatccgtatgaggcaattcgctgcagcgcttgaactcgaccatagatgattcaccggcctgcagcacttgcataagttcatcctgcgtcatcgcattccgcccttcatagcgataattcatacattaggacatggcacttatcgtattttagcatctaattagtacattaggacattgttttatgtcctaatgtactaattaggcggctaattgtactaataattgcacactgatgtactaatccgatgatcgaatgcactaattgtccgcgcaaatgcactaatcggatgaccgaatgtatcaatgagacctataggcagccgattggctgacgatcagcccagtcattggctatcggccgctagccagtcagccgccaacagccaacagccacccaactaatagccgccagccaatcagcccgtccaatcactccttgtgttccagtgcggcctttaaatcgcggctacggtagcgttcgcgcagcatagagaatccaccgaagcccacaagccacaccaggccggcaatcgcggaattgcgcgtatcgtccgcaaggaacaacgtcaggtagatgaacacgaagaacacgattgccaccgtattgagcaccttccaagcgggcatgacgaacccgtccggaatgaaatcagcggagcgacggtacttgcggtgtgccatcagcgtcaggatgtagatgaacaggaacaccgcggagctggcggacgagaacagcacgaacgctccggacacaccggggatggcgttgacgatcggcgacagcagtatcagcgccgcggacaccaggatggcgcgggccggcaccttgcgatcggacaccttgccgagcttgttcagcatcgggttcggcgacacctcggacagctggtacaggtggcggccagccgagtacagcagcgagttcagcgcggaagatgcggcggtaatcaccacgaagaacaccagcgcagacgcccaattcagcccggcatactggaacaccataatgaacggggatgcgaaggagccgtccttgttcggcttgaacgaggtccacggcacaatgcacatgatggccaccagtgcgcccacatagaagatgagcacgcgcacgataatctcgttgatggccttgggcagcaccttgcgcggattcttggtctcggagacggtgacgcccacgaattcaatcatctcgtaggcgaagaacaccatctggaagctcatgaggaaggccatccaaccgttcggcgcgaacgagaagttggcgaacaggttgtcgaatccggcgtggccggccgggctcacgtggtccacgccgtgaatctgcacggctgggtaatggtagccgatcacgatcatgaccacggcggtggcgatcatcgcgcaaatcagcgtgatcttgatcatcgagaaccagaattccacctcgccgaacaccttgacggcaatcaggttgatggagaccagcgacaccaggaaacacagctcgatcagccatttccaatgggtcaggtcgatgccgaacgtgtcgaagaaggtgatgaagtacgtggagacggccgtgatctcggtcatgcccagcagcacgagcgcggcccaatacgtccagccggcgaaatgcccccacccgttgccaaggtaacgggtgatgaaattgatgaaggtgtgctggctggggtcacggtacatcatttcgccgatggcgcgcatcaggaagaacatgatgacaccgaccagaatgtacacgaagatgatcgaggggccggttagcgagattgacttgcccgagcccaggaacaggccggtgccgatggtgccgccaatggcgatgaactgtacgtggcgattgctcaggccacgctccatctcgttggtctggtccaggctttcgacagacttgagtttgcccgtagcctgctgtgtaccaccattcacattcgtatcggccatactgatttcatttctcttctctgccgcccgattgttacgcaccagacgcgatactcgttcaaaacaagttcaaactgtatcaccgaaatatgtcacgaaaaccgctcagctcaagaatacatgcgatgatactgtaaatattccgccaaaaagttcaattcatcaacaccaaattgaacttctacctctattccacggacttgagcgagctgaccgggtctacgcgatcgagcactgggttggtgaacagctgcaccagcagcgcgaacgccagcgtcgccaccacggcaatcgcatagctgtaccagtgcacttccacttcgaaatacagcgacggcatattcaacgcagcagtcagtaatccgcctatccacctgccaagcggcagaccaaccaccacacccataccggtcaatatcatcatctcgcggttcacgtagttgtgcacctcgcggtcatagaagcccagcaccttcagtgtggccatctcgcggatgcgttcggacacgttcgtattggccaacgtaaacagcaccaccagcgccaggccgccggcgagccccacaatcagcgccaccacggcacccatcaaatcgaacttaaacgtggcggccagatgcgcacagctcacggccttgagcaccgacgattcctcgcccaaccgatccgcatattcggcctgttcggtctcggaacctttcagcttggcgagcatcgcgttccacgtcaaggtcgaggcagtgccatctcccgaagccgaagacgtcacaccgtcggccgcaaacttctggtcgtacagtcgctcactgatgtacacatcagagccgatgaggttgcgcgtcaccgccgcaaccttcaccttggcccgcccgctgccgccattgcccagcgtgacggtgtcgcccgcatgaatatccaacgaattggctgcggacttcgccacaatcacaccactatcgtccagcgctacagtgccgccacccgctttgccgaagatattgggcagctcgaaccacccatcgtcaccggcctcttccagcgtgaccatgtcgttcagtttgttcagcgaattgttgggcaccgtcatcagctgcacggtttcgctttcctgcgccgcattgctcatctcgccactatccacgcgcagattcagcgtttcggtggtttggccatcttgtgccacctgcttgcgcatcgcggcggcgtcatcgtcattggccacgaccatcaagtcatactggtagatctgctcatattgcttgacgccagtcgtgtcgacggtgtcgttaatcgcaaatccgcagataatcagcgctgtgcaaccagccacgccgcccacggtcataatcaaacgcgacttgaatcggaagatattgcgcgcagtgactttgccgaggaagttcagccggctccataccgggcgaatccgctccaacaatatgcgagcgcccgccttcggcgccttcgggcgcatcagcgcggcgggcgtgtgccgtatctcctcgcggcaggcgagcgcggtgaccacgcccacaccgaccacgaacagcacgatgccggccgagccgtacagccagtcgtattcaagtcgcacaccgggcaatatatacagtccctcaatcaccaccatcaggaatgccgggatgccgaggaatccgaccagcagaccgatgccgccgccgaccaagcaggcgagcaacgcgaacagcagataccggctggacacggcgagtccgccatagccgagtccaaggtaggtgccgataagtccgcgatcttcctcgaccatgcgggtcatggtggtcaggctcatgagcacggcgaccagcaggaacacaatcgggaatgcgcggccgatggattcgatggaactgacatctgatttgagcgagctgaatccgtcgatcgaagcgcgcgtctgcacataccaacgtgcgttggccacatcgtcgatgcgccgttgctgcttggcgaattcgctttccgcttcgcttcgcatcgcatcgagtgcagactgcgcatcatccagtttcgccttgccgtccgcgagctgttgttcgccttctttcagctgccgctcgccttcttcaagctgccgcttgccgctggccagttgggcggcctgcgcttcaagttgcgccgactgggtttcgagggttgcggcattcgcttcgagttccgcggatttggtattgagctgtgcctctcctgcagccgcttcctgttccttagcggtcagttgcgcgttctgctggtccaaggtggattgtgcgggggcaatggtttcgtttaatgtgcgctgcaaatcggctttctgctgggccagactgtctcgctgcgtttgcagttccgtttgcttggcggtcagctgttgccgcagatcgctgattgacggcacttcaggcacggtaatgccaaggcgcgcgagcagttgcttgatggcctgccatgtgggtgagttgaggtcgatattcgggtcaagttgcgccagtagattgttggcctgttgaatcatgggcagcatctgatcaatttgcgccatgccttggtcgatttgggtaatgccctgttcgattttcgtgcgattggcggtcagttccgtttgcgccgcatcgagctgtttgcgagccgaggtgagctgcgttttgcctgattcgagctgggtgcgcgcttcggctatctgctggcgaccttgcgcgatctgttgacgggccgttgcaatctgcgcacgtccatcggcgagctgccgttcgccatcggtaatggttgtcctgttgttctccaattcggtacggctatcttgcaatgtcgtttcgttggcttccagctcggcccagttgtcgtcgatctgcttctgggcttcgtccagctgctcgttggcctcgtcttgggcatcgtccagtttgcgctgcgcgctggagacgatctgttgacgacgggctttctggcgtgtggcctgtatctgatgttcgatacggtcggccacggttttgatggcttcatcgtaggcatcggaaaacgtgtcaaaatcggacgcaccagtgacggcaaccgatatcgcagtgtatatattgccggtcacgccgtcgctgggtgcaaagaacgtatagtcctcggatgaggtggaccggaaggaggtcatgcccgaatagccgtctggattgttgaggtcgcgcgggtcgagtacgacgccggtgatggtgagtttcgtggggaactgcggggattgctcggcgtcggcgtccgtattggcgtcggacttcgcatcggatgccgaggcattggcggcgacacctaccgtatcggcattattggaatcgtcagtctccgtggccgctaccgatatgacggatgaagaggtgtcttgtggcgtcacagtaatggtgccgccaatcttgagtccgctatcgttcaggaattgctgcgtaaccgccacttcgccggccttgttcggcagtttgccctgccgtatgtacggctgatcaagcccttcggtaccgatttcctgcatggtcacggttttcttggtgccgtccaccaacgtggtcaccgtctgagaacgttcgggctgcacggtttgcacaccgtcgattcggcgcagtgccgccgcatcatcatcggtcaggccgtatgtggatagcacctgcaggtcatgcagtccctgctgatcgtaaaaacgaccggccgccagaaaagcatcgcggcatccggcgtagatgccggtcagcacggccacgccaagcagcgtgatgacggcgatcgagacgaacctcttccagctgcgcagccagcaacgcaacgtatctttggcaaataccgcagaaacgcccgctcctcgaccgccgctatcgtcgaggttccgccgtttcacagaatgtttcacaggttgtttcacgaatcgcctcgcttgtttcacggggcgtttcacagagtgtcttgcagtgagcatcgccaatcacctaccattcgatatcggcgatgggccgcggcgttgcgttgacctcctcgctggtcaccttgccggagcggaagcgaatcactttgtgagccatcggtgcaagcgcggaattatgcgtgatgatcattacggtcatgccttgtgtttggcaaatatcctgcagcaactgcagcacttccttgccggtctcgtaatcgagcgcaccggtcggctcatcgcacaacaacagcttcggctttttggcaatcgcgcgggcgatggatacacgctgttgttcgccgccggacagttgcgcggggaagttgtccatcctctcccccagtccgactttgcgcagcgtttcctctggatcgaaatggtcagggcagatttgcgaggcgagctccacgttttcgagcgcggtaaggttaggcaccagattgtagaactggaagacgaagccgatatcgttgcgccggtaggtcaccagttcctttttccgcagacccgtaatatcgcgtccgccgaccactacgcggccggttgtggcggtatccatgccgcccagaatgttcaatgccgtggttttgccggcaccggactgccccagaatcacgcttaattcgccttgttcggcggtgaagctggcctcgtcgagcgcgcgaatcacactgctgccagaaggatattccttgaccacatggtcgaattcgatatacgccatcgcacacctccaacgcgctcgtggcagccacctagccccataggccccgccagaacttcctgctatactcaagtaaaacaacactgtgtcggttctgcaaccaacagttggattgtgggttgtcggaatttggggagaaggccatggccaaagaattgacggaaagccgccgcacccgatacacgagacgtgccatgcaggacgcgcttatcgagttgctgcgcgatcagccgctcggctccatcaccgttaaagcgttgtgcgagcgggccgatgtgaatcgttccacgttttacgcgcattatgcgagcatcgaggaactgctgcacgacattgaagacgaaaccatggcctgggtcaccaccgcactcgaacagctactcgcccagccagatcctgccggcatcgagcatgttattgagcgcatctgccagtacattgccgacaatcgcaatcatctccaagtgctgatgagcccgaaagcggatatcggtttccagcagcagctgctgggattgatttacagccagcgcggtgtaggcgaacagttgcaatcttcggcgggttacccagccgaggcgcagatgcgtatgcgattcgccgtgtccggcagcattgggcttttgcaatattggctcgccaccgatctcgcggcctctcccgaatcggtgtcccacaccatcttcaccatgtgtatgcctgccacgcagtgagcacagtgaattcagtgaactcagtgaactcagtgaagcgtgcggtttcataagcatcgctcgctatagcttcgcctgctcaccggccgcgcccacgcccgcgcttgcaatagcgcacaaatagacgattgaccatttctgagacgatacggcggcatagaataacgaacgttgcgcatcacggcaagccccgcgtgcgccaaacccaagaaatgtgagagaagagcacaatgagtactactgatgcgcctaagaagccgcgcgaaaccgacgacgtgccggtgccggccacgctgcgcaagtcattgaaaaaccgccacatccagctgattgcgctgggcggcgccatcggaaccggcctgttctatggttccagtgaatccatcgcgctggccggaccctcgattctgctcgcctacttggttggcggcctcgcgattttcgcgattgtgcgtgcactgtctgaaatgtccgttgaggatccgaaggcgggcgcgttcagctactatgccacccgctactggtccaagcgcgccggctttatttccggctggaactactggttcaactacatcctcgtctcgatggtggagctatcagtggtgggttcgtttgtgaactactggttcccggcgattccgacatgggtgtcggcggccgtgttcttggtgatcatctgcgccgccaacctgctgggcgtctctaaattcggtgagttcgagttctggttcgccatcatcaagattgtggccgtgattgccatgatcgtcggcggcctggccgtcatcatctttgccctgcccaccgcatccggcgtgcgcgcaagcttcgcgaactggttcaccgtgggtaacggcttcttcccgaacggcctgatggggcagaattccgacggttcctggaccggcctgctgatggcactggttgtggtgatgttcagcttcggcggcaccgagctcatcggcatcaccgccggcgaaaccgaggatccgaagaccacgattccgcgcgccaccaatgatattatttggcgaatcctcgtgttctacatcggcgctctgggtgtgatcatggccgtagtgccgtggaacaccatcgatggcaagtccagcccgttcgtgcagatcttcgattccgtgggcattcacgcggctgccggtattttgaacttcgtgtgcctgaccgctgtgatgagcgtctacaactccggcctgtacgccaactcccgcatgttgtactcgctggccaagcagggcaatgcgcccgcttacttgggcaagctcaactcgcgcggcgtgccagtggccggcgtgctgacgtccgccgcgatcaccgccatcgccgtggtcgtggtgttcgtgtggcctgagttcgcgttcaactacctgatgtcgattgccaccattgccggcatcatcaactggacgatgatcatgctcaccgaaatgaagttccgtaaggtggtcgccgcgggcggcgctcccgaggattccgagctggccggtctgagcggccaggaggcactggacgcgattcacttcaaactgccgtttgccaaggtgaccccgtgggtggtgctggcgttcctggcgctggtcgtggtgctgatgtgcttctccaccagctaccgcatcgccgtcatcgccggcgtgatctggctggccatcctcttcgccgcctaccagctcactcaggcgaagaagtaaggctccatttgcgaatagctctcactgatgagcactcagtgagagctattcgcaaatgggatttattcatgaaacagctcatcgatgccgacgagctgaacgtcggattgagacgccgcagcatcgtcgaccagtgattgatcgaaaccgccgagcgaaaacagcaggtatgttcgctggccgataccggttcgcgcagcacggtctcgcagtagattcagcacggaacggtccaccggcgcattgcggaatttgcactcgcccacaatggcagcatcagacgcattgtcaacggccatcacgtctatctcatcctgacgatcccaccaacggccaaccgcacgcgcacggaagggcaaccgtccagcagcactctcacgccacatccattcacggcacagaccctcgaacggtttgccggcaaaatcatgtaataccggcttgatatgacgctcgtatacgccttccacatcgccccgctccaattccgaacgatacggaaagacaaacgaataccagaatcggaagaaattgtcgctcagctgatacagcccacgcgaacctttcgcccgctccttaggcttcgccgtgactgggaactcacgttccacaatccccagttccataagattggcgagatacgacgatactgttgcgtttgccatcatcgtgtgtgtcgcgatctcattcagcgaagttgcgccgagcgcgatcgcccgtatcacgctgttatatttcgcagtttcccgcagttcttcgtgcaacaaaaattcaacctcgctgtatagcggagcaatgcgtctcagaatatgccgcttgacatttgcgtctatggtctcatctgggtcaaattcctctaggtaacgcgggataccgcccagtattgcgtaggccagcgccttatcctcgctactatagttggggaagaattgcgctgcatcccaatatggcatcggcagcatcttcaggatgccggtcgcacgaccatatagcggcgatttttctcccaacagctccttttcgatgaagctcatggcactgccgcaaatcacaatcatcagatttgcatgacgcaacgtgtggtcccaaagattctgtagcactgacggcaatgacggatcagatttgaccagataaggaaactcatcgaatatcacaagcctgcggccgccatcgctcggctctggcagccgggttaactcggttaacgccctttcccaagaaggatattgactcagataatccttgcccggggcacccgcctcgaacacgagacgggagaacgatgccagctgttcatctttagtggcattctgcgccgcgaagaataaggtttccttgtcttttgcgagttgaataagcgtctctgtttttcccacgcgcctgcggccgtagacgaacacaagctgtgccctacgctcagtgaaacattcctgcagttgcttgaggtcatcgtctcgtccgatgaatgccatgctgcccgcctcctttatgccatacgccggcgtatttctatcgcatcacgatttattgtatcacgattagtataatcgtgattatacaagctgtgacgaggtgcgggtacgggccaatttgcaaaaaactctcactgagggggaggtggtgacagctttgaggtcgagcttgccgcaggtcaggtagaccatggtggcgaagtagtccatgtcacggaagccgcgggcccgtctcttcacgttccggacgacactgtcggcaccctcgaggacggcgttggcgtacgggtgctcgaagtacgcgacgacctcggcgaagcggcggcggatcagacgggcgggttccttcacgggttcgagcctcgagtgtatcatccacgagcacaggcggtatagcctgacccatgccccggcgggcggctgtccatgcagatgccctgcaggacctcgcgcatccggcacgcgcgggcggtcttcagccgctgccgcgtgaggccgcgcttggtctccagccgcaggtcggagagggccgcctcgttcccgagccacaggtacttcgtcctcttcaacagcccgttctcccgcccctcggccttcctgaccttgtcgacggcctcgttggcgtgcctggccacgtggaacttgtcgatgatccgcctgacatggggcaggtgctctgtgttttagcaagttggcgtccgctttgtgagcggtgtttttccgcagtgtaggcagcgggttttccgcagggtgtgcggtatcggccgctgcctgtctgcgttgtgttggttatttggtcatgag

SEQ ID NO: 26 - DNA, 81394 bp, Bifidobacterium longum
gatgctccaccacctgggccgtcgtcatcggcgtggtgaaatacaactccaccgcacgctctcgttcctcaagactgaacatacgaaaatccttccgttcggtctccaagaaaacgtccgcagccccatttacctgcattcgacgcaatcaatgcagcagcattacagcagcaagccgattgagcaaaatagcaaaagccgccttgcgcaaccgcaagacggctttgacgacaatggtgaggctgtgctcgcttacttcttggaagcgttcacggcatccacagccttctgcagcgattgagtataagccttgtaccaatcagcctgctcgttgagcttcgcagtagcggacttgaagccggcagtgtcgtcagctacgcagccttcgtataccggcagttccacgctcagttccttgttgagggcgtccagcgtggaggcatcctttacatccttcttggtgagcgcagcagcttcggaagcatcgccattgaccaagttgttgtagtcattagtggcgttgcgcacattttcggaagcggcggcgcaagcggcgactgcattgttgtactgagcatcggagtaggcgcggaagccgaacacaccggccacgacgataatggccacgaccaccacggcgataatggcgacggccgccttagacatgtgcttcttctgagcgccttcattgcttgcattgttggcgttgtttgccggtacagcctgctgcccagcggacatacttcgatctccttcgttctcgtactttcatacacacgtatgcgctcttagcgctcttatgcgcactcatatgcagggaagtcgcttttcaagcggctacttccctgaaaacaaaaaaccctcgcattccgcgagggtcattggctgggatgcctggactcgaaccaagaatggctgaaccagaatcagctgtgttgccaattacaccacatcccaatttggcttggcgtagcaactccaaggagttgttcgtcgtacccccaaccggatttgaaccggtgttggcgccgtgagagggcgtagtcctagaccgctagacgatgggggcatattcagtttttcaaccggctgctcggtgaaccgcgcaacgagtgataaatatacgcaagtattcacccttacgcaacttacggcgtgtcgcgcggaatttcaacgatttcaagtgctacgctgccactactgatgaatttgcatgaactctactgacggattatcagtaagcactactgatgaattaccatctaatgcactgatgaaattgcagatgaggcaatgatctttgccttgcacattcatagccggcaaatcagccttcaagaaccaaatgaggcgcttatgttcccttgcgacagcgagcgcgtcgcgatgcttgtaatgcaatgtcacgtcaaagaccgccgcccggttacctatcaaccgtttcatggacgcatgaaggcgaaaccacctacaaggcacgtttcgtgacctcactgcacaaaccagccatgttcaacctcgtacatattctcactggcatgcggcgcagcggtaagactttccagctgttccagctcatcactgaatacaagaaaaggtgggcatctgcacatgcagacgcccaccttgagtgtccttacagctcagccgagcacggaaggaaccttagctcacaggtgctcgcgcaggcccttcaggcgagcgagggaaaccggcttgccgacgatctccatggactcgaacagcggcgggctcacgcgacgaccagacatggccacacgcaccggaccgaaagcgaggcgcggcttgtagccgccctcctcaaccagagccttgttcagggtctcatgcaggttgtcggtcttccagtcagcctcatccacagcctcgagtgcggcgatggccttgtccagcacctcgccggcagaatccttcagctgcttcttggcgtcgtcagccggctccaagtagccctcggtggagagcagggagccgaccatgccggcaacctcacccagcaggcgcacgcgcggctgaaccagcggagcggcggcggtcagcacctcacgctcacggtcggtcagggcatcccagttgtcggcggaaaccacaccgtcgcggtgcaggtacggcaccgagcggcgcaggaagtcctcgggctcaagcatacggatgtgctcggcgttgatggagatggccttgtcgatgtcgaagcgggccgggttggccttgacgtcgcgcacgtcgaacttctcggtcatctcgtccatggagaacacgtcgcggtccggtgcaatggaccagccgagcagggccaggtagttgagcaggccctcgcggatgaagccattgtcgcggtggttgaacaggttggactctgggtcgcgcttggagagcttcttgttgccctggcccatcacgtacggcatgtggccgaacagcggcatctccttggcgatgccgagttccataaggtaacggtaaagcacgatctggcgcggggtggagctcaggaggtcctcgccgcgcagcacgacgttgacttccatcatcgcgtcgtcgaccgggttggtcagcgtgtacagtgggtcgccgttcgggcgcacgatcacgtagtccggcacggagccggccttgaactcgatggtgccacgaatcagatcgtcaaaggcgatgtcttcatcaggcatcttgatacgtagcgcaggcttgcggccctcggcgcggaaggcggccttctgttcatcggtcaggttgcggtcgtagccatcgtagccgaactcggccggacggccggcggcaaggttgcgctccttgatttcctcaggagtggagaaggactcgtaggcgtagccggcttcgagcagcttggcggcaacatccttgtagatggcggtacgctcggactggcggtacgggccgtgagggccacccacatcgatgccctcgtcccagtcgatacccagccaacgcagggattcgaggatctggttgtagctttcttcggagtcgcgcacggcgtcggtgtcttcgatacggaagatcagcgtgccgccggtggcgcgagcttccgcccagttgaacagggcggtacgaatcatgccgacatgcggggttccggtcggcgacgggcagaagcgaacacgaacgttcttgggcagttcgggtttggtgttttcagcatcagtcataatcccctattgtgccgcgcgcgccggacgcggagagcagcgctcctcgctcttttgcttcgttattgatgtttcgggccaacaccatcccaaaacggccattttccaacgaaatctcttttgcctgccatttgcttttcttttaaaagcaaaatcaaaagaaaagaaaacagcaaacgagaatcagcaggccaggcccacgaacagcagatcccagtcttgagattcgtcttcgtgcgattcgcgctgctcaacggcggcatccgtgtattcgtggttcatggcattccctacatctctgtatgttgctttatgcatagcgccaaaagcttcgtctgctttccagttccgccccgcaactgtgcgcaatattcatgcaacaggttacacaaccgatcgataacgttcaccctcaactgatatcgatttgataaccatcgattctttccagtgcattcaccacaactttggacattatttggcgcaattgttgagttttccactcatgcaatggaagaatatgatgtgacacataggtcttatgaaaggggaatcaatgtctgatcccaacaatgtgcctttgcctcagcagcctgaggccaacggtacgcccacacctaatcccgtaccgcagtatggcgcaccggccccggcgcagccctcacagccggcgcagcccgcttacggacagccggcatacggtcagcctgctccgaccgcgaactcttatggccaggccgtaccaacctacggtcagcccgcgcccgacgccaacacctacggtcaatccgcaccggcgtacggcacaccggcccccgatggcaatccttacggcccggttccgccgtcttacggccaatacgccgcgcccactgccactgtgccgctggataagccttactacggatgctccttccaagaagccttcctgcgcttctggaagaagtacacggtgttcaagggccgcgcgtcccgcagtgaattctggtggtgggtgctggccgctttcggcatcaatatagtgctggacatcctcaacaccgccacagatgaaaagcttggcttcctcgccaccatttggggtctggtgaccctaatccccaccctggcactttccgtccgccgtctgcatgacacgaacaagcctggctggtgggttgccattttctatatcgcgatggttatcggccttatcatcatgattatcggcggtggtgcggcactgtacggcgggttcaggagccttggcagttatgactatggttatggcagcatggccgccggcggtcttggcgcggcggtcattggtgcgttgattacgctggccggctgcgttgtctatatcgtgttcatggctcttcccagcaagccggagggcgcacgttttgacgatggcgcggcggcaacccccatgcctcagggtgcttacggcgcaccatacagcacgcctgtacccccgaatttcgccgctccgaacgcgcctgcacccggcttcaaccagccggccccggcttacggccagccgcccatgccaacccccgactatggccagccggctgcacccgcacctgattacggtcaggtgccggccccgcagtacggccaaccggaggccccggccccacagtacggccaggttccgccgatgcctcaaaacgccggcgccgaatccgcaacaccttctgagcacacggctcccgccggcgacaatgcccagaaaccctggcaaggccagtaaccgatatcggtgaacttccgttgaagaagttccccgcaaccaatgatgaagccctactcaacgcgagtagggcttcatcattctcggcactgtattatcggcactgtattcagccaactaccccaacggcatcacggcaatggactgcgaaagcatatacgattcacccggactaagggcaacgatacggtctcggcacgccgctgcctccacggccacaaagccacgccattcacccgtcttggcatgggcaatggcgttgccgccctgctctccgggattccacaccaccgtctgcggcgagccggtcttgccgatgcgaatcacacgacccagcacatggtcctgcaattccagtgcagcatcggaataatacacacggtccaccggctgatcgccgaacatcaccgatggctgttcttgtagttttggcgggaatccggcttccgtggcatccagatatgttgcaccccgcaaaccgaccagccgcgcgccgagcacatcgccgacatgcagatacgagtgcagcgccgcctcatacgacatcggctcacctcccgtgttggtaacggtcagcgtcatcgtcagcgtatcgctggcacacacctcgtatgcggcacggaaacgcacgttgggttcatcctcgatccatggcacttcgccagtcgtcagtcgttcggaatccagcacataccgcacacgggcaccggtaaacgcctcttcgtccagcgcccactggcgcaatcgtgcgaacccatgaatcggtcgcttcgcagtctgcccgccatgcacaaaccccggcccgaaccaggggaagcacaccggcactcccccgccaaccggctgaccagcttcgaaatgccatgtgcggggcgtccagattacatccggctgccccgccggggcccagcgcagcagatgcgccccgtaatcgctgattaccgcgctaccgccgtcattggtgagcgtgcgcagattgacgccattgcccataagtgtttcttcttccgttgcgtaagcgatgttcttcaccacatagacgatttccttggcacggaggaatcgcgagcaggggtaagagaaccgatcaggcgggctaagctgccttgattctcacaactccacggtttctttgccagggtcatctttaatgtgcgcaaacttggcggccaaggcctccttgttgcgcttttcgtcttcttccttggccttcttcttggcttcgtccgggttccagagcacatcgtcgcggtgcttggtccattcggcaccggccagcggggcaatgtattcggcggtggcggtcagcgtgtccgcgccagcggccttagcgcgcgtatcaatcagctcaagaatctgctgatcggtcaggcatatgcgcggaatcgagcactgctcgcgcagctcgttgacgtacagcagaatcggcagcaccttgaccgcctgagctgcggcgtcgccatcgtgttcgccgtcaccggtcaccacgctcagcagcgcatcgcacacggcgagcgcagtggcaaaacgggtggccacatcagcgggctcgctggacgtagacagacggccctgcgcggcgtcgtcttcaatctgggcttccacggcggcaatcgtctcacggacctgagccgcaacatcggtgtcccaacgaacgtccaacgcttcggcggcgtcaaagatcagctgtacatcgccggattcggagtagtcggccatcgtgtcgtaggcatcgttggcggccagcagcgtatcgacgatgttctgtggacggccgggaatctcatcggcgccttcatagacgaattcggcatcgggcaccgtgacgtcttcaccggtcagcacgcgggcgaatgcgcgcgtgacgcgaacctgcagattctccgcgtacttggcgtcattgtccatctgcatagcttcggtcaacggccacaggctgatcagcgccgagccggcttcggcggcctcagttaccgtcggcaatgccgtgacctgtgcgattgcctcacgattgagttcaatggtcatctatgctcctttgcgtccaccactcgattgtagtgcgtctcttgactcccctcagtcacctacggtgacagctcagcagcaattgtggacgggccacgcccgcgcctcaatagctcgcctatcggctcgtcttcgcctacaaacagtccactggactgtttgcttcgcggctcagcctcagagaggggaaccaatgtcctaacaccagtgtgccgttacttgacgttggccgctgggtcgacatacgtgattgacatcacacggccggtttcgttgtcgtacgtcaccgaggtcacggaggcgagcgccgtgtgccgcaggaacatccagtgctcggggtggccggtctccagataatggcgataactgaaaatcggcgattcgtggctgaccaccacaatctgctcgccggggtgctgggccaccttctcgcgggcgaagtcgtccatacgcgccgcgatgtgctgataggactcgccccagctcggcttgtacaggttggtgacgagcttccagttgccgttcttccacagcgcgccctcgccatggccgatgcgcttgccacggaactcgttgccggcctcaatcacccgttcatcagtagtgagcgtgagcggagcctcgccacgagcctcgcgcacggggttcagcgcatcgagaatcgcgccggcggtctcgcgcgtacggtcgagcggcgaggagtagacggctgcaatcgtattggtttggggattcttggccaagtacgtggcggtggcttgagccatgcgacggccaaggtcggaaagatggaagtcgggcagtcgctcatagagcagatggtcggggttatataccttgccatgccggacgaaatggatggtagtagcgctcatgagtcgcctttctgcttcccgccctgaagggcataagaacgttgtcttaatatccccaatctaccgcgtgtcgcggagtggacacccgtagagtatccatgacgcaaatatgcggatgggggaaaatccgacgcaaactttgcgcgaccatggacaacacatcattcgatgagggcttcgccggcaatgccacaccagcgggggacatccaatcgggagcggaaaggagcgtagtgctgttatgtccaataactcgtccaactcgaactcgggcgccattctggccggcatcaaggaagcaggccacaaagtttttggtgggtatgcggaactactgcgcattccgcataccgcccgttattccatcggctcggtcatcgcctgcatgccattcccgatggtcggcatgaccatcaccatttccgtacagcattattacggcaactattcgctggccggcatgctcaccgccattcaggcgattgcgctggccgtggccacgccgctgctaggcaagctgaccgacaagttcggccagaggcaggtctcgattccgacgattatcgtttggattgtggccgccatcgcgctggtgacggcgattaccaaccgcgcgccggaatgggtgctgtactgtctgacgccgttcctggccgccattccgccgtggggcgcgatgagccgcgcgcgctggaccaagattcttaagggtgaccgggagcgcacgaaccgcgcgctgtcactatgcggcgtgctcgacgaatgcatgtgggtgatcggcaatccgctggcctccacgctggccgtgatctccggtttgctggcgttctcgttcaccggcatgtgcgtggtgatcggtgcgctgatgttcctgaccgagctgaccactgagccaccgtcgcagaccgcgctggcgcgtgccgagggcatctcccgcaaggaataccgtgagcgcgaggccgccaaggctgaggcgctgaaggcggaaaccgccgccgaggagacccgccgccgtcttgagcgtgaaggcgtgaccgatgaggccacgattaacgcagccattaagcaggcggtcgccgatgcgcgttcgggcaagaaggcgtccatttggggtccgggtctgattgcggtgtgcgtcacctggttcggtttgggcgcattccagtcggccacgggcatctcgattattgcgttcgccaccgaagcgaatatgaagcagtacacgggctttgtgtttgcctgcttctccttcagctcgctgatgggcgcattggtgtatggcgcgaagaactggtcgattgccctgtggaagcgcttctacttctgcctggccgtggtgaacatcggcatcagtacgttcctgttcgccaagcatctgtgggtgatcatgatcatctacttgattattggcgtatgccaggccccgacgtggatcaacggcaaccagctcatgttgcatctggtgccgccctctcgcttgaccgagggcatggcgtggatgggtgcgatgaattctatcggctcctccgccggttcggcgattgccggccagttcatcgaccgcatgggctcgcatggcggcttcatggtggtgaccactttggcactggtctcgctggcgattgcgctgattggcttcaagcagatcaagggctccaccgagcagccgaccttgactgaagtgagtgtgtgagacaaaaattaagccccctctgacgagggggcttaatacgtcaaaccgctacttcggccagcctttgggcgtgtgttccagggaccagatgccgagcttgtgggagaagctgttctgccacttggcttcaagctcctcggcattcaatcgattttcagcggacttcagacggttcatcgcattggtgtgcgtatcgtcgagcagccacttgcgaatcaagaagttccagatcattaccacggcagtggccaccagcttgccgatattggtgcgcaacagatattcggcatgctgcgatacataggcatcgtggttcatgccataagtggaaatccagataatcgcgtcattcatgaacagaccgactacagcgcccgccacgaagataaggatctccatccagcgcgccatgtcatcacgatgcttgaatacgaatttcatgctcgccagatagttgaaaatcagcgagatgatgaaagagatggtggcagccagcacgttgtgcatgtggaatatgccaaccaataggttgaggataccccagtcgataacaaaggcgatgacgcccacaatgccgaacttcatcagttgttcaatcagttttctcacaagggtattcaacactattgggctgactgcggaacatatattggctggaaaggccaataatctccccaaattggccttgccccggtccgttctgcaagcagcttcctacatccgcatgccatgttcaacagcaaccgctgaggctagactggaagcgaaccgaatcaaggaggaattatgcccgttattcacactcatgtgtccgtgcccaccacccctgagcagcgcgaggcgttgaaggctgcctatggcaaggcgattaccgccgtgccgggcaagtccgagggctggctaatgtgcccgttcgaggacaatatgccgatttacttcggtggtagcgatgaccagcccgccgcctatgtggaagtcaacgtgttcggccgctctgtgccgggctctgcttgggaaaagctgaccgagagcattatggccgcgctgaactccacgctcggcattcccgaggaccgcacctacatccgttacaccgccaccaccgactggggctggaatggtggcaacttctagttgccaccattcccctcgcagcatagctgctcgcatcgcctacggaaagcccggtgggctttccgtttaacggctcagggtagcaacttctagtttgcgtatgctggctcccctcagtcagcttcgctgacagctcccctcaaagagggaagctcagatgtagaaagcccgccggtggcgggctttctacgtttcaaggggctgatttccaacattcagaagctctactagcgtttcaaggggcttttaaaacaagaaaaccggagtataaacattgcaatttcaatggtcatactccggatttcgcaatcgaagagcccctcgaaacgcagatagacctccggaaaaccgaaaatccgcccctcaaaagcgagttacctcacctcatgcctgtcatcacacgatcttgggcatgggggtggtgaggctggtggtcaggttgacgtggaccagaccggcaccggcatgcacctcaaccttcttcagggtcacggtgcgctcttcttcgggggcacggtcgttgtcggtcatggtcgccggggacttgaccgccacgaacgccagatcgtccagcgagatgcctgcgctctggcacagttccatggcctcggacacggactcggtgaagcccggcttgtaaatcacgcgctcggccggtacgccgtaggcgttctcggccacccacttggcgttctcggtcagggccatgcccttgtgcgagtgcggttcggccggcatggagccgttctgcaacgcgtcgacgaaaccgtcaagctgcggggccagcgcctcgccgccgtcgcggaacaggttgccgatgatcggcgtgcggaagcccagctcgtcggcggtggccttcagggacggaacctgatcgtcctcgccttcccacaggttgatgagcgggaaggtcggaatgtccaggttctccaggcgctgcacgtggaacgggtagcgccaggccagctcgggatcgtcgcgccaggtggaggcacgggtcaccacgatggcggcggacggccactgcgcgccgtattcgcggcaggcgatgtccagccacttctgggcgccggcgtcggtgccgtaaccggcctcgacgatgaccacgtcatgcagggcgcaggccatttccacggagaccagcgtcggaatgccgatggacacgttggcgaacgggccaccgtgcacgtagaccggggagccgtttacggtctcggtcttggccggcttgaccgcgtcggccagaatgccagtgatacgccacaggtccacgaattcgccgaaggtcacggccttgccgtccttggtgccggcgatcatcttggacacgcgctcggaaatctcgtccatcgagcgggagagcaccacaatctgcatgagctcgcaggtcggcgtgagcacgaccttctccggcacgttgcccttgccgtagtccacggcggtggagcgcagggagcggctcggcacctcggagacacgcggcacgagaatcgtgtcgagcttgccgtcatcgatggccttctcggcgaaggagacgagcaggttctgggccgcctcgatggcgcccatttcgccgcacagaccccagtcgatgagctcggggtgggtcagggaagccttgccgccgccggaggcaccgcccttggaaccggctgcggtgatgcccatgctcggctgacgcagcacggcggtcgcatcaatgccgcgcttgttcagggcgtcgatcagggcgatggtcgtggtggtcttgccttctccgcgcgatgccttgagcggcgtatcggcggtgacgagcaccaccttgccgtgcttgcgcggggcgtcagggttctcggccaggtacttcatgtagccgaatgcgtcgatcttctggaccagaccgtactggctggtgaagtcttcgatggtggtcatataaagcctttctgtgtttgtgtgatggggcggggtggtggggcggcagtcgccgcctcttcgcctaaaaacagcccactgggctgttttcttaacggctcagcccctcagggaggggagctcaatacggactaaaagtcggacatgtggaagccgttcttcatttccatgctgcgagtgtacagcacggagtcaagcagcttttcggtttcctccttgagctggtcggccatggtctggttggcggcggcgagaatctcgcgcacctcggggttacgcagcgcggcgatggtctcgtccggggtcatcggctgcacatcgccatccacgttgtcggcctcaaattcctcttcagcggcggactgcgcagcttcctcggcggccgtcaagcccagacgggcgatctgctcgtcggtggcggcgaccaagcggtggcccatcgcaccggtcttctcctggtagcgctcaacggcgttggacgtggagcggaaggcgccatcgcacagggcggcgatgatgcggttggcccagtagaagttctcggacgtcacgcgggtggtggtgtcctcaaggtaggcgggcgtggtgtccacgttcgggaagaacggtaccagcgtgttgaacgggttggagccgtatgccatccactggatggcgcgggaggcctgcgggcggtacgggcggatctgcatcaccgcgagctggctctggcggttgatgccgatcgtgcggtacatgtggcgggtgcgctcatcgcccagctggccgtacggatcgaacggggtgccctggtagtgggagctcagcacgtacttgatatcctcgatggtcaccttgcgctcaggctgacgggcccacgggatgtcgtcggaggtgggcttgtggtcggcgtccgggccgtcccacacctcgtcgtacgggttgaggaagcgctgcatgtaccaggcgcgcggggtgttgtacacgtggtcggagtcggagtgggagccgaaggcatcgcgcgggttgaacggggtagtgttctccaccgcgaggtccaaatggttggtttcgatgaattcggcaaggtcttcggaacacatgtgcgcttcctggtcacccagagcgtcctcaaggtcgaattcgtcgataccgagctggttcggcatggtcacgtaggcctcgtccggcacgcgcttggcaatccagtgatggccgcccacagtttccagccaccagatttcgttggagtcggagaaggcgacgccattcatctcgtaggtgccgaattcctcaagcagcgcgccgaggcgctggacgccctcgcgtgcggtcttgacatacggcagcacgatggtcaggaagtcctcttcgccgatgccgccgggcacctcgggctcatcgcccttggccggcgtgtattccacgaacgggtcggcgccgagcacgcgctcgttggtggtcagggtttcggtggcgctcatcgccacgttcgcctcgttgacgccggcctcgccccaaataccttccttgaggtccgcgttcggcacggcggtgtactgcagcgggtcgtccggcagggtgatggttaggtgggagatcaccgacttgtattcgcgcggctgttcctccggcttcacgacgatgaagcgcttcgggttgaactcgccgttcgcggaatcctcgttgcgggcgatgatggtcgagccgtcatagctcgcgtctttacctaccagaatcgtggtgcaggccatagtgtgatggtgtcctttctttgttgtggtcacgctcccactggcgggagctggacgacgaagtcggactgaaggtggttttgtactgacccacccccagtcagtgatgctgacagcccccgcctgcgggggctcatgtggctcacgccttgccggtcaggaagatgccgtcggtgtcgggcacttcaccgctgttgcgcagcgcgtgcaacagctcgttgagccagaatccctgattcaagccgggcaacggcttcttggtggcccacacctgcaggtagtactcatgatccttgtccggcggctgcggaccgttgtaccgcatgatcaccgccgggtcagtgctgcggcccaagaacttggaggccgaggagttgcacccctgcacggtctcgggaatcatggccggcagctgacgggagaagtccggcgggatggccaacgcatgcgaatcattgaagtcgtacatcagcgcatcaatcggcagattggccacggaccagtgaatccactcgaagccgcagaccggaatcgaatccgggtccacgaactcccagtgcaggtagcgggcctcgggatccacatcatcgatgtagaacgggaaggagaccacaggcacgccaccattgaaatattcaggggccgcagccttggcgaaatcgtccgggatgacggtgaaatcggcggaaatcttcatacgtcccagtatcgctcatatgtgtgacgtactgggagctgtgcgttacggggtctctcccccagtctcgctgcgctcgacagcccccactcatcagaggggggctagttgcgtcgggttatgagatcagggcgcagaagagggactcgaataccagtagcgggttgccgttgccggctaggcgcttgcgggcgtgggccacttcgtccagacgggtcacggcaccggcccggttcaatcgcaccgacaattcggtgatcgacgagcggttctccaggttgatgaggcccaccgaatcctccgcattgttctgcagcaccgccacatctcggtagatggaagcgatggagttcagcgcacgatccaatacgtcgcgcgtacggcgggtgaccaaacgcttcacatcgtctttcttggcaatctggttgaatgcgccacgcagtttcggcgggatgcggtcgctcggtgccagtccgttgatgcggcggaattccgcttcctgaccggcggtgatgcggttcgcgtctgcctcggcctgggccttggcattgtcgataagattgccggccaacaacactgcatccgaggcacgggccagattcagcacaccgaccacaagttcatcgcggtcggacataacccgttcgtcggtggcgtacaacttggcgatgccgatatggccttcggcgagtcgggccgcacgctgcgccacttttggctcgacattggtggtggaggtcaggaatccggccaccgcctgggtggagggcacggcgaggttcacgatgcgtgtgcgcgagcggatggtgggcagcacgtcctgggcgctgggcgcgcacagtagccagatgcaatgctcggccggctcctcaatctctttcaagagcacgttggtggtgcgctcaagcatgcgatccacgtcttcgatgatgatgatgcgccacggcgcggtggcgggcatctgctcggaggtagtgatgatctcacgcacctgatcgataccaatagtcaccttgttcgtggtcagcaccgtgacatccggatgcgtgccggcaagcacctgctgggtgacgcgcgtgggctcagcgctcatgccgtgatccgggctttccagcgccgccgcgaatgctcgggccatgttggaacggcccgatccgggaggtccacagatcagccacgactgggtgatctggctcgggtcgccctgcgcgatacgactgagcatgtcgattaccggcttttggccgactagtgaatcccatacgctcatgcgagctccttgatgtcggattcgatggcagcccataccgcttcaatgctctggctcgcatcgataacgcggaaacgattcggctcggcggcggccaagtccaagaaggcctggcgggtgcgggactggaagtcatcaccggccgattccatacggtcttccgcgtgttcgaggcgatggtgggacagggctgggtccatatccagcaaatacgtgcggtcgggcagcaggttgttggtggcccacatgcttaaggatcgaatctcttctggcgtgagttcgcggccaccggcctgataggccaaggaagagtctaaatagcggtcggtgatcaccacttcaccgcgctccaatgccgggcggatggtttcggcaacgtgctgggctcggtctgcagcgaatagcagcgcctcggcgcgcggtgcgatgtcgactgcgcccccatccacaccgtgcaacagcagttggcgaatggccttgcctaacgcagtgcctcccggctcacgggtaacgaccacggtacgcccctgagcctcaagatacgcatgcagccgctcgacttgcgtggtcttgcccacgccatcgacaccttcaaacgaaacaaacagaccgctcatgctattgaccttagcgttaggcgcagagttgcgcccaacaggcagttaaaccagctctacctccgtttcaaggggctgatttggtcttttctgaaggtctacttccgtttcgaggggctgttgcccaagtagacaacgttccaaaacggcggaatgacgttggcgcggagccgttcatactcgtggttcagcagatgaccagccccttgaagcggaagtagatattctcaaaacgagaaatcagccccttgaaacgcaagtagagcaataattccgctcagccacgcttgggaattacggcggggcgctcgtagtcctcgttggcggtcagccagtcgacgtcctttttcacagtggcgggggtggaaccgagtttttcggcgatgcgctggttggaccagcccttgttcgccaacttcttgacttcggcacggcgttcggcgcgcttggcctcctgcgccgaaaccgcagccgaggtaccgcccttcttgcccttgccggcaacggccttggcgccaccagcacgcccagcaccgcgacggccacgggtggagggaccagccgcacgcttttcggcgagcagtcggaaggcgtcatcaggggtgatggattcaggcgtgtactgacgcggcaccgtacggttggtctcgccatcggtgatgtacgcgccgaaacggccgtccttgatggtcacgttcttgccggtgttcgggtccttgcccaaatcacgcagcggcggcttggcggcaccacggccacgcccgcggccgtacttgggctgcgagaacagttctttggccttgtcgatatcgaccgtgaagatctcgtcttccgaggccagcgagcgggtctccgacttgccgtcggcacccgtcttggtcaggtaggggccgtagcgaccgttgttggcggccaccgtgcattcggatacctcgccggtttcggcgttggtttcctcgtatgtgcccacttcgcgcggcaggctcagcagctttagcgcgtcttccagcgacagcgattcagggctcatcgtcttgaacaacgaggccatcttcgggcgcgacgcggcggcggccgcggccttcttcgaacccttcttggccgcagaagcaccagcagtatcgccagcagcgccagccgaagcctcagccggcggcaccaacgccacatacgggccgaaacgcccattgcgcacctcgacggtaccgccggataccggatcaacgcccagctcgcgcggtccaccggagtggttgtcgatcaaatcgcgggccacggccaccgtcagctcatccggcgcgatggtgtccggcagagacgcgcgcttcgggttgccttcggcgtccagatgctccatgtcttccagatacgggccgtaacggccgacgcgcacgtgcaggccgtcgccgatgtcgatggtgttgatggcgcgcgcgtcgatctcgccgagctgcgcgacctgctgttgcaggccttcatgcgcctcgtcggcgttgcgggcggcgccctcgccggaaccgaagtagaagtgggtgagccagtcgcggccggattcctcgccgtgggcgatgcggtcaaggccgttttccatctcggcggtgaactggtagtcgaccagcttggggaagttcgtctcgagcaacttggtcacggagaaggcgagccagctggggatcagcgcacggccacgctcgtatacgtaaccgcgatccatgattgtggagataatgctcgcgtaagtggacgggcgaccgatctccttggcttccagcgtcttgaccagcgtggcctcggtgtagcgggccggcggctgggtttcatggccgtccggttcgatgtcgcttgcctcgacctgctggccgacgctcatcggcggcagggaggtgttggattcggaggcgtcacccctgacggccttggcgtccgtcttgccggcggcagcagcctggtccgagccagccccagcgccgggagcggcggccttgggcttgcgcccctcccccgtggccttcataaagccggggaattcgatgacggtgccggacgcctggaacacggcctcgccctcggtggggccggccggcgcagacaggcgcacggtggcggtggaaccggtggcgtcagccatctggcaggcaagcgtgcgctgccagatcagcgtgtataggcgcagctggtcgccgggaagtttggaagccagctcgtccgggtcgtggaagcgcgagcccgccgggcgaatacactcgtgggcttcctgcgcgccagcggttttggtggcgtactgcttgggctcggcggagaggaacttgtcgccgaaatggtaggagacggcgttgcgggcggcggtgatgccctcctgcgacagcgtcaccgaatcggttcgcatataggtgatgtagccgttctcgtacaggctttgggccgcgcgcatcacggcgcgagcacccatgccgaggcgattgccggcggtctgctgcagggtcgaggtggtgaacggcggctgcgggcggcggcggtacggcttggtttccatcgacatcacagtgaaatcggcggtcttcagcgccgaagccacggcggtggcaccagcctcatcaagctggcgaacgttcgccgcgaacccgtccggggtcagctggccgtcggcaccgaaatccttggagccggcgagtcgcttgccgccgagcgcgatcatgcgggcggagaattcggcacgctcccccagcgcgtcaggcgcggacagcgtggcgacgatatcccagtacggcgcgcgcttgaacgccatgcgttcgcgctcgcgttccacgatcaggcgggtggccacggactgcacgcggccggcggacaggcctgggcccaccttgcgccacagcaccggcgacagctcatagccgtacagacggtcgaggatgcggcgggtctcctgtgcgtcgaccatattgccatccacatcgcgcgtgttgttcagggaggcgttgatggcgttcttggtgatctcgtggaacaccatgcgcttgaccggcacctcgggtttcaaggtctgcaccaagtgccacgcgatggcctcgccctcgcgatcctcatcagtcgccagatagagttcatcggcgttcttcagggccgatttgagttcgctgaccgtacgcttcttgtcgccgtcgacaatgtaatacggcttgaacccgtcgttgacgtccacgccgaacttgccgaacttggccttgtctgccgcgggcacctggctgggctgcgcgaggtctcggatatggccgaccgacgccatgacggtgtaccccttgcccaggtagtcaccgatcttgtgggccttggtcggagactccacaatcaccagtttggtagccatacccactccttatgtattgcgcgaaacacacgacgtttctggcgtcataatactcatgaatcatgtccaactgccaaattccgccgttgtgccgggcaaattcggccgttcgcaccccatgttttaccgtttgggcggtgccggcggagcgccgatcagacccagccggcttaagggcgctgcagtaatctgacgcagggccagcaacagtccgaatgcgagcatggccacacccgcaatgcccacaacagcgctgacattcgccccctgaaccgcccagctggcgctgacattgagccccggcaccacctgccagatcacataaccgctgtaggcgagcaacagcaggcccccggtaatcagcacgctgccgacgatttgcacgctcactgaggagacgcggcgacccggctcgtccatgccggacttgcgcgtaactgccagagcgagcagggccaatcccgccaccagcaggatggacatcgccacatccgaagggcgatgccattgtccgtatatcacggagacaccgacggtcaccgcccagaccacgccgatgacgcccgccaaagctcgaaccgcacgaggcacggtaagcagcagaatcaccgcacaggctgcggccagcatcgtgtgaccggaaggcgcggaattagcggcaggagattcagtgttgatgatgaacggacgcggcaacagacccttgatacgggtgacggccaagcagaccacggcgaacacggcgatttgcccggccaaccaccagcggcgtcgaatcagcgccgtaataatgccgattgcggcaattgtgcagctgacagcgataaccagccaggattgtgcgacggcgttcatcacgccggtggcccaggacggtacatcgttgtgcaggtttttccagaccagttcgtcgtacgattgtccgttttcggtaaacacgcacccccaccacacgccgaagccgatagcgatcaggagcagaccgaataccacgcacagtacgcggctggagattcgcgggcgcacggtaagcgggtcaagccgggccaagccgcggtcgatatcagatgccccatccgcatcgtccatgtccagcggcctgaaatcccgtaaggagcctgatgtggatgccgatgcatctgaaccggagaccgggccgagcgcagccaatgggtcaacaacgttcgacgacgagtcaggctgtgctgcgcctgagccgaccagattgaccgccgcatgcgggtcgcgaattctaggggtctgtgcgtcattcatacgttcgactgtacggccgcgccccggacaggggaccacgctagtgccagctcacagccaaatccgcacataaagaaaacctccacgcacccgtcagaggccacttacccttgctgcattcctgccctgggggagttgggtgacatagcgccgcgtggaggctggggataagtctatggagacgtatggaccagcgcagcgacacgaaacgtgcgcgccgggtcgcacgacaggccaaccagcgcattcaggcaatattcatgcagcatcaagaagcgtgcccaattgtaagaattccggaaaaataccggcataaacgcgtgtggctacgctcacgtcaaacgattgttcaaggccaacagttacggtggacaccatggcttcttatactcgtcgtgcacattcgggaggcaatggccccgctctgaggcaaccgcgcaccgcgcaaagcagagccggccactccgcacaggagggcccctatacgccccaggagagccgttcccgccacgcaagccacaaggcttccaatagccatcgagccccgaacaggaagaaaaagaacacaggaaaaggcaagcaccgtgtactgaaatgggtgctgggcatcttcttctccctgattggactgggcttgctggccggtatcgcagtattcgcatacctgtacaccaccactgaggtcccgcaacccgagaagttcgcgttggccgagaaaaccaccgtgtattacgcggacggcaccaccgcgatcggctcctacgcggagcagaatcgtgaaatcatctcttgcgaggggctgccggactacatcggcaacgcgattgtggcgtccgaaaaccgtacgttctacacggataaaggccttgatctgaagggcatcgcccgcgcattcattaataatgtgaccaagggcacgcgccaaggtggttccaccatcacccagcagtatgccgagcggtattacatgggcgaaaccacatcctatgtgggcaaggcgcgcgaggccatcatggccatcaaaatcgcgcagaccgaatccaaggacgaggtgctgtgcaattacatgaacaccatctatctgggccgcaactcctacggtatccaggcagcggccaaggcatacttcaataaggacgccaaggatctgacgctgtctgaggcggcgatgatcgccggcattattccgtcaccgtccacgtgggatccggccgataacgccgatatggccaaatcgcgcttcaagcgtgtgctgaacatcatgcaggaggatggttacatcactgccaagcagcacactgatgccaagttcccgcagaccgccgcggtggcgcagcagaacgaatacgcggggccgaacggttatctgctggatatggtgcgccgcgagctggtgcagtccaaggcctttaccaaagaggatttggatactggcggatacaagatcatcaccaccatcgacaagagcaagcaggatcttatgcagtccatcggcgacacccgtctggacgacatgcccgaatccctgcaaatcggcggcatagcgctggacccgaagaccggtgaagtattgtccgtatacgccggttcagattatctgtccaagcagctcaacaatgccgatcaggccgtattcgaaccgggttcgactatgaagccgttcgctttgctgggggccgcgcaatccggcgtcagcttcgatacattgttcaacggcaattcccaccagcacttcaccggcttggatcaagaggtgaacaacgctctggagaacaactggggcaacatcaatctgtatcaggccaccgccaactcggtgaacacggtgttcatgaacgtcaatgagcatctgacgccgaagcgcacggccgcaatcgcccatgaagcgggcattcagggcgatatcgatgaaaactccatgtacaacgtgctgggcatcaacgccctgaccgtgtgggatttggcgcaaggccattcgaccatcgccaacaatggcgtgaagaacaccttgcatatggtgtccaaagtgcttgattccaacaataaggacatgtacaacgcgcccagcaacggcaccaaggtgttcgatgccaacgactgcgctttggtacagaaggccatgcagggcaccaccacgtacggtacggcggccggcacatccagcatgttgggccggcccgtcgccggcaagtccggtaccgccaacgacgaaatggcttcgtcgttcgtggggtacacccccagcatgatgaatgtgtgggctatctggaatccggacgataagggcaatccgcaagtggtgccagccttctccggatacggcgtctcttccactggataccccgcccacctgttccaggagttcatggctcaggccttgcaaggcaccgaggcggagcagttcccgaccgctaaagacaacggcaagatcggcggctccgacggcacttggggcttgggcaagggacagagcagcgacctgtccaacaacaccaacaagcagtccaccgaagacgcgcagaagcaggctgagcaggacgcacagcagaaggcggccgaagaggaagccaagaagcaacagcaggctcaggagttcgcccagcagtgcctcgccaatccgagctattccaccgagtgcccgaattatcccggcaccactaccggcggagatggcaacgccggcaacaataccggcggtgacaacgggaacaataccggcaacgataatggtaattccggaggcaccggcgggaacaccggcaccaacggcgtcactcagtagtaagtaaaacacagacaacaaggctccctctgatgcaatcagagggagccttgtttttgctctgctagcgctcagcgcttgcgctggaaacggttgatggcggagataatcgacttcagggcgctagtggtaatcgacgaatcgatgccgacgccccacacgatctgcgcgtcatcggcctcgccgacctggcattccacgtacgaggcggccatggcgtcggtgccgacggacatggtgtgctccacgtaatccataatcgaggcgtcaacgccaaagttggaaatggcgttgaggaaagcggcgatcggaccgttgccgatgccggagacctcgcgctccacgggcgcatcgaccccgacgttcacgccgcggtcgagcagacgagccttgagcacggtgtcggagccatcctcaccggagctgacggccaccttgagcagcttcaagcggccccacggcacgagcgaggcgtcatgagtatcgcccacaaccacaccggcggcggtcatgccggactgttcgaccggcaggtactcgtccttgaacagacgccagatatcctcgtccttgacttccttcttggtcgtgtcagcgtagttctgcacgatcttgtcgaattcgatctgcagacgcttgggcaggtcaagattgtggttggtcttgagcaggtaggccatgccgcccttgccggactgcgagttgacgcgaatgatggcttcgtacgtacggccgatgtccttcgggtcgatcggcaggtacggcacaagccacacgaagctgtcgagatcggcgccagcacgctcggcggccacctgacgagcctcgagacccttcttgatggcgtcctgatgcgagccggagaacgcagtgaacacgaagttgccggcgtacgggtgacgctcggaaatcttgatctggttgcagtactcaaccgtcttgcgaatctcgggcacgttggacaggtcaagctgcgggtcgatgccttgggtgagccagttgaggcccagcgtgaccaagtcgacgttgccggtacgctcgccgttgcccagcaggcagccttccacgcggtcggcgccggccagcacggccagctcggtggcggccacgcccatgccttcgtcgttgtgcgggtggagggagagcaccacggagtcacggtcgtcgaggtgggtggagacgtactccacttcgtcggcgaacacgttcggcgtggtcatttccacggtggcgggcaggttgatgatcatcgggtgctcgggagtcggcttgataacaccgatcacggcgttgcacacctcgacggcgtactccggctcggtgccggtgaaggattccggcgagtactcgtagtacaggtcgatgcccttggcctcgttctcgaggtccttgcacagttcggcggcgtcggtggcgagcttcttgatctcctccttgttcttgcggaacacgacctcgcgctgcaacacagacacggagttgtagaagtgcacgatggcgcgcttggcacccttgagcgcctcgtaagtgcggcggatgaggtgctcgcggcactgggtgagtaccacgatggtcacgtcgtccggaatcagctcacgctcgatgagcatacggatgaagtcgaaatcggtctcggaagcggacgggaagcccacctcgatctccttgaatcccatggagacgagcaggttccagaaacgcagcttgcgctcggaatccatcgggttgacgagggcctgattgccgtcgcgaagatcgacggagcaccagcgcggcgcgcgctgcagtcgcttgcccggccacgtacgctccgggtaatcaaacgggatctgcttgtcgtaggcggcgtacttgttgtacggcatacgactcggcttctgcggatcgccaatgaatcgcgccggaggcagcagcgggtcgttgttccccccattggacgctgcggctaccgctgcgagatcaaaaacggatgattgatcctgacccattgttcctcctttactggttattgcgcgggccctcttgcggacgcgactgcggcgttgtgccagggcggcgccgggccacgcggatttgtcaatacgcacgtaacatcctacaggccggttcgggcaaacccgcgggaaatgccgtatcgtggcatttgcttatgcacctggctgacatgagggcactcagcgtcggcgccgggccacgctttgactccggcacaacaccccgcctgcgataccccaccagatggccctccatacgtcggcggcgggccaaatattggtactgcaccgacagccaaacggctcagcgtcgtcagcggaccaacttatggcgaaataccgactctgggaaagcttatcgtcggcaaattgccaggctatggcacactaccgacgctacgaggcccacaaccatcggcaacgcgacaaatattggcccaccgccgacgctagcctctttgagcgtcggcgccgggccattctatgaatcagtaacgacgccaatggtctcagaacgtcagcatagggacgctgtctggatctccaccgacgctgcatgacaaaatcgcggcaccatcaagcaacaacacggctgcggcaccccgccctgccccgtcccttgctgtgccagtcctgtgaacgcgcgggcgatccgccgcccggcaacatagactgaagagctatgacgagcttgcgattccgcgaagacggcagcttccgcgtgctgcaaatggccgacgtacaggacggccccgatgtgttgcccgacaccatccgcctcatccgcgaggccatccgcgaagccgatccggatcttgtggtgttcaccggcgaccagatccgcggctatgatcccgcctacatcgacacgttcctgcgccgccgcggcgaagagccgggcgctcgcgtgcgcgcggtcaccgagatcgaggccaaaatccgcgggatcaagcgtcaccccgtaattcgcaaaacatccgatcgcgtggccgatcgtctcaccgaagccggcaagcctgtaccagccgcgctgcttgaccccgataccgtgacgaacgccgtcgccgctgccggcgccgattcgaccgacgtgatcacgacttccgaagtaggcgattccgttgagaccagccccacgcccgagacggtttccaccctcgtatattcaacgcaatccggcaaggccagccccgcacacgagacgccggcgaccctcgacgaactcatgattgagacccgcgaaaaggtccgccgcacgttctccggtttccttggtccggtcgtcgaggccggcgtgccctttgccgccacctacggcaaccacgacttccaatgcggcattctggccgacgaacaggatgacatctaccgcgaataccccggctgcctgaaccccgacgacagtctcgagcccggcacgttcgcgctgcccgtcgagtcctccgatggttccggccgcgtggccatgtccgttatgatggtcaattcaggcgattatgccggcaaacccgaagaaaacgacgcccaatacccggcgtatgtggtcaatccgcgaggactcgacctggccgacgccgacgggtacggcacccccacccccaaggccatcgaatggctggggtccgtccaaaccgagttgggcgagcgcaatggcgacggcaagcccgtgccggccatcgccttccagcacattccgccgcaggaattctacgattgtctgaaggaagtgcccgcatggacgccgaacgccgtggaaggcgcgcgcacgcacgccgggcgttgctatgtgctcaaccatgaggtctgccgccccggctcgcggctcggcgaggcgatcggctgcgcggacgagaatgtgggcgaggtggatgccttgcgcgaggctggcggctatttcgcgctgttctgcgggcatgaccataagaactctttcgttggtcatgtgcatgatatcgatctgggctatgcacccacgtgcgggttcgaatgctatggtcccaagtcgcggtaccgcggcattcgcctgtttgaattccatgagagcaatccggcgggctatgtgacccgcatgctcacatggggtaatctggtcggccgctactccagcaacgagctgcgcgtctggttcgaggatcattgcgttaccggagcggtcagcgcacgcaacgagctgcgccgcccgcaggtgttcgccgtggtggccggcgcgatgagccttggctttatagccatcatccgttcgctgatcaaggccgcgcgctaaacctacttaaacaggctcaccccgcgacgggccgtgcaatacgcgttgcccagccaggtatggcgggaattgggccagacggctcccagtcgcggtgcgttctggctcatccagatgctcggcacgcggccgtctgcggagcgtgagccgagcagattgaagccgttcttttccagcagccactccgggtgctgggtggcgatggccaagccttcctcgagggtgagcggcaggcgctcatcggagtcgataagcttgcgggccacatccggctcgcgattgatatagcacgtgccggtgtgcggattgacgaccagatagaacgggccttccggcggcatgaagccgtcttgaggcaggaagctggcgatgtcacgcggcggcatggtggtgaagcctgccatgcgattgatggaggttcgtgcaatcagcgactcaggcgaaaccagttcacgcgtgggcaccagcaggatgttcgatcccaaatcggaatgctcgagcgccccgatcagaggtcgggccagcgagcggaatgcggcggcggaaatatccgccacatccgggtagccgagagccacgatacggtcgagctgtttttgggcctctactgatgcgatagacatggctaccagtgtagaacatcgccttcgcttcattgggcagccaccatctgggaagaccactgccgttgttccgcgtgtttcgtacaattgcattgttttacggccacccgcatgacggccgtccgacgtaagtaatccatcgaaacccagaggtcatagaggtcatcatgtccgaaaaattgaaggtcggcatccttggtgccaccggtatggtcggtcagcgttttatcacgctgcttgagaatcacccgtggttcgaggtggtcacgcttgccgcttccgcgcacagcgccggcaagacgtatgccgaggctgtcggcgaccgttggaagatggaaaccccgatgcccgaatatgtcaagaacatggtggtcgtcgatggcgacgatgccgagtccgtggcttctggcgttgatttcatgttctctgcggtaaacatgccgaaggaccagattcgcgccattgaagagcgttatgccaagaccgagaccccggtggtctccaacaacagcgcccaccgctggactccggacgtgccgatggtggtgccggagatcaacccggagcacttcgaggtgatcgagcaccagcgcaagcgcctgggcaccactcgtggttttatcgccgtcaagccgaactgctcgattcaggcctacacgccggcgctggccgcgtggaaggaattcgagccgcgcgaggtggttgtgagcacttaccaggcgatttccggcgcgggcaagaccttcaaggattggcccgagatggtgggcaacatcatcccgttcatctccggtgaggaagcgaagtctgagaaggaaccgctcaaggtgttcggccatgtggacgccgccaagggcgagatcgtgccgttcgacggcgacctcaagatcacttcccagtgcatccgcgtgcccgtgctcaacggccacaccgccaccgtgttcctgaacttcggcaagaaggccaccaaggaagagctcatcgaccgtctggtgaactacacgtccaaggcttccgagctggagctgccgcacgcaccgaagcacttcatccagtacctcaccgaggatgaccgcccgcaggtcaagctcgacgtggactacgagggtggcatgggcgtttccatcggccgtctgcgtgaggattccatcttcgattggaagttcgtgggtctggcccacaacaccctgcgtggtgcagccggcggtgcccttgaatgcgccgaaatgctcaaggctctcggctacatcaccaagaagtagttgaaactgagtccgaaactgagaaagccctccgcaaggagggctttcgtcatatataccgcaaaaacgcggctcagtggctcagcggccagtaccgccgtacaccacggcttcgatttgatcggcatcgagaccgtatgcggtgtgcagcgccttgacggcgtcgttgagctgatcgagcggcacgagcgcggcgatacgaatctcggaggtagaaatcatcagcacgttgatgccctcatcgctcagggcctggaagaacttggcggccagaccggcatgggtcttcatgccaacgcccaccacggccaccttgcctacgttggtgtccacatcgaaggagtggtagcccagcacttcctgcttgtcgagcagtgtgttctgaacctgcttgacggccgattcgggcacggtgaaggagatgtccgcagtgccgacggatgcgccggcctgcacgatcatgtccacgttcacgccggcggtggccagctcggtgaacaccttggcggccatacccggctcgttcggcacgccacgcacggtggccagcgcctcggaacgatcgtgggcaatgccggaaatcaccggtgcctcggggcccaggtcagggaacaggtcgcccatggatttcgcttcttcttcagtcatgtcttgccttgtcttgcttgaaattacttacgattatcgttcgctgtagccgcgctcagtcgaggttcggcagcgtacgcgggtcaatgccgtcgggcaccaccaatgtgccggggcgacgggagaacgaggaacgcacgtgcagcggcatgttgaaacgctgagcgtattccacacagcgcagtgccagcaccttggagccgcaggacgccatctccagaatggactcgtaatcgatggacggaatgcggcgggcggaaggcacgatacgcgggtcggcggtgaagatgccgtccacgtcagtgtagatctcgcagatatcggcaccgagcgccacggcaagcgccactgcggaggtatccgaaccaccgcggccgagcgtggtggcgtcacccttggcgttgatgccctggaagccggcaacgatggcgatgtctcccaatgagagcgcgttcttcacgcggtccggtctcacggccttgatgtgggccgcgccgtaacgggcgtcggtgaagaagccggcctgctgaccggtgaaggagtgggcacggctgccttcggcgtgaatggccatggccagcaggctcatggaaattcgctcgcctgcggtcatcagcatgtccatctcgcgctcgggcgggttggagtcgatgctcagcgcctgatcgataaggtcatcggtggtgtcgcccatggcggagaccaccacggccaccttgttgcccttcttttccgtctcaacaacgcgcttggccacacgtttgatcgattcggtatcggcgaccgacgaaccgccgtacttctgcacgatgagagccactgctgtcctttgttcttctcttagggggagtttgctcaatattctacgcaaacgcaacgattataaaggttgccgcgttcaccccgcgaccccgcgccgacatgtggacacgggcatggcctacgttgttcagcaaaaattcaagttttcaccggtggttctttgaggcagccgcatccatcctttgagattcgagcggttaactatcaattaccggcaaacgaaagcaaaccggcgaggtttccgcagaccccataactgaataccttcttcttcctctctccttttcaaggcccggtcccgcagcccgggccttttccttttgtgttgggaacgatgggtcaaacgcacgatacgagctcacggagcaagcgtggccaacggcactaccaataccccatcatcccggcgataagcggcagccgtagcggtcagcaccatcaagaatgacggacggccttcgtgatcttgatcaattctgtcagccaactttttcaaatgggccgccgcaatatcaacctgcttttctccgagcttgacctcaatgagagcccatcgtccatcatgcaggccaatgaccgcatcagattccaatcccgtcttatcccgataatggaacacatctccgccaagcgcatcagcatacacacgcagatcgcgaatacacatggactcaaacagcaagccaaaggtctcgaaatcattaaggagtttctccggggtcgcgtgcagtaccgcacaagctatcgacgggtcgctgaagtgtctggttgggctcgttctcactgcagtcttagaacgtaaacgagggttccaagctggaagatcttcagttacgcaagctcgcgacaatgcatctaaataatcggagagtgtaccttccgaaggcggttcaccctgcatatccgccgcgatagtggattgcgacgcctgagaagaaatattgcgcgcatacgagcgcataatcagacgcatccaagttttattgcgctttataccatccatacgattgatgtcagaatcaagtagttcttcgacataatccgcggccatgcgcaaggcaacatttactcgagattcgactactgcttcaggccagccaccgcggcatagcgcaaacgcggtgttttcaatatcgaaatcggagaaacccgaaacatcatggttgccatcgaacaactctcccaacgaaacaacgcccgtcgattcctgcgattcaaataaggacatggtacgcatggttaatcgggcaattcttcccactccggaatgagctggttcctgttgaggagtcgccgatccagttaggatgaatcggccacgaccgcgccctcgatcgatggcgaaacgcaccgcgtcccacaattgcggggccatctgccattcatcaatgagtctcggctcctcacctcgcaggatgagagaaggctttgtatcagccaaggccaacagcgtagcactgcgatccgggtcctgcatgaagacctgactcgccgactgcctttctgccgttgcagtcttgccacaccattttggacctttaatctgaacggcaccagaagactgcaatgcctgagtcagcaacccatcagccactcgaggaaggtactcgccacgttgaatctccgagctctccactgccatatgtgccctcccgcaaaccgtcgaaacatcaacctataaatcactctattgcggaagttggaccattctaattgtggaagttggaccattttcgttgcggaagttggaccattcctattagggaagttggacactagattacgaactagacttttcctttttgcagcaacagtgccaccaacacgatgggcgtcatcaccgcctatcgccagacccttttccttgacctaaaaagatgagatgcccagacagtgccatcttttctctgagcacactagccaattcggaacgcagcggcgaacccgtgatccgcgcatcctctgcaaccgcgcctttgacgttcggcaatctggtgaatgagcttttgctcaggcgttcttcgcgattcatttctttggtcggaaaacagaatacgcgggaacgcccctcacgcctacgaaaccaacggctcgacgacgaaccgacatccacgaaaacagcaatagcgcctctttttatcggggtaacatattccctctttatgcattcatacccccctatttgaaagctctgccaaatattgccgacgccgcgacttatcatgttgccatactttgcaatcctttgcagccccttgcatctcaacggcttgtccgaagtaagccacatcgctgacggccgtagcaacgttgttcgtatcgcatttttcagacttcttatgcccccctatattgcccccatatggcccccgtcggcatgttgcatgaaaggcttggcacggagtaacgtttcgcagtgtggcgcgtgcggtgttgccatttgcgacagcacctatgccacgcacgactaagacagacccggccgtcttgtataagcaaatcatgagcagatcaaacggaggaacaggcgactatggcattgctgcatcgacgttcgacgagtaagcgtgcctcacagaaaatgcgggaaaacaacgcggtcatgccggatgacacatctgcaaatgacaacgtttcctcagcgcgccccgagcccacagcattcgttccaactccatttgacgaagtcatcgatatcagcgatctcgtggccgagcgccgacgcctgcagcgcaatctgtgggcgatgcgcatcatcaccattgtgttgctgatcgccgcaatcgccgtggcctgcttcccgctagcgttgcaattcgagtccgaccgcaacttggccgccaccacagccaccacggccaaagaagtagctggctggccttacccgcaggcggaagacaagctcacggcggcccgcgcatacaacaagaagctcgctgaatccggccagcctatcttgggtgaagccgtcgatccgttcgccgccgctcaagggggatcccaagccagcggcgaggattccgcctcaaagaaagacaaggaataccagtcactgcttaataccggcaacggcgtgatgggcacaatcaaggtgcccaagcagtccatcaatctgccgttttatcacggcacttccgaggaagcactggcttctggtgccggccacttgtacggcacgtcgctgccggtgggaggtaaatccacccattcggtcattaccgggcaccgcgggttggttgaagcgctgatgttcacccgtttggacgaggtgaaagagggcgacttcttctacatcgaagtcatgggcgaaactttgggctacaaagtggaccgcatttcggtgattttgccggatgacacgtcgaagctcaaaatcgtgccgggtgaggatcgcgtcactttgatgacctgtacgccatacggcgtgaacacgcaccgactgcttatctccgggcaccgcgtggcgattccgatgccggcccccgagccgaatgacgtgcttgacgcgcgcaatatcgcccttggtgttggtctaggcatactggcggcaggactgttcattatctggttggcacgacgccacaaggccgcgcgtatcatccgccacggcgcattctggccgtggatgcgccgcaagggcgaaagcgccaatgatacgctggcttaggcctcgcgccgaccggccagtgccctgcccagcgtgatttcgtcggcatactccaagtcggagcccaccggcaggccgctggcaagtcgggtgaccttgacacctacgggtcgcaatagctgggtcaagtagctggtggtggcctcgccttcaatattcgggtcgagcgccataatcacttccttgacctcatcgccttctaagcgtttgagcagaccgggaatacgcaggtcggcagggccaacgttggccattgggttgattgcgccgccgagcacatggtataggccgtggtattcgcgcgtgcgctcgatgctcatcacatccttgggctcttcgaccacgcagatcaccgaacggtcgcgtctcgggtcggcgcataccgggcaggggctggattcgcacacgttgccgcaaatatcacagaagcggatcttggccttgacctcttcgatggcctcggccaaatcgcgcgcttcatcttcgggcgcggacagcatgtagaaggcgatacgctgcgcgcccttcggcccgatgccgggcagccgcccgaaagcgtcaatcagtcgttgtattgcgccgtcataagcaagtgccatgggtattcctcgttattcgtcctcattattcatccgagtgcttcttggcaggctggatgttcttggggttcttcggatcatctgccgcgaattgctcgacttttttgacctcgaatagctttttcagatcgtcgagattcatggccgtcgcctcgccgagcgactggtcgctcatcgagtattcgtcatcctcggccgcgacttgcggttgtggtttcggctggggctggggctggctattccacgggtcggcattcggggtcggctgtgcgggttgcggttgattccacgggtcaccgccggcagccggctgcggaaccgattggggctggttccacgggtcatcgcccgacatattgcccgacactgtctgaggaaccgaagaagccggagtctgggactgaggctgattccacgggtcgtctcctggctgcggagccgcctgagcatggttcccctgcggttgattccacggatcatcgtgaggagactgctgatatggctggttccacgggtcggcttcggccggttgcgacgccggtgagaccgcggcctgagactgcgtctgattccatggatcgtcgctcgcgccggcaactgccgtaacggaagatgcggtggctggctgcccagtggactgtccagtgggtccagcggacgcaacggacgcagtgggtgcaacaggagcagccggagcggcccacggatcaacaccgtcactgatgtccggaaccgcaacatgcttcttgtgatgctcttcgggcgcaggcgtagcagcgggctcgttaggcgcgaacccgtctgcagattgcggcgaagcgttgcttacggccggcttggcccaagggtcatcgtcactccagttcttcgctgccgtggatgcactggattgtccggctcgatggctgtcgtctgcgtcctcggcttggcctgttgcagtcggcttcggagctttcgtctcgctccccatatgaatgtccaggctcgcgcccaaactcgacgcggccaatccagccttggccatggcaatctgctgcttgaccttggccaattgctccgggctcatacgtttgacggattcgactcgctcgccattcgccgcgaccgcagaaggtgcaataaccgcattggcgccgaactcgttgcgcacggcatccatcaccacggccgccgccttcttaccgctgttatccacggccaaggcgaaagcgtgctggctcagcgacttgtcgaacgtcatcgacaagcaaggcagacccttacggttggggccgaattttacggtcggcaccttgtctcgtgacacatattcacgaatggtttccggcaaagcggcgacggctgcatcccacttctcgtcgatggaccgattatccgatgccgcaggcgaggtcaccggttgagccgggacggccggcgacgcggcgggcgcgccccacccggcattggcggcaggagcggcaccggcagcagcagttgctacagcaggttgcacagacagagagcccgcgggtcggtcgctgaccgggccgttgacagggccattgcctccaacagattcatgggaagcggtgctctgaggcgcggctgcttgctggttgcgtgcagcaccggagaatccgccatgtgaggctccggcaaacccgcctcgcgatgcgccggcaaaaccactggcacccataccggaagcggctggcgtagtcgaagtcgaagaagcagccgcaggcggcataccagaagaagctggcgcgggagcggctgttgcaaagcctgattcactgccggccaacaatcgcgcggccagcagttccaagcgcatacgcggagaaatggctccggtcatggcacccaacgtagtgttgatgatgtctgccattgcggtcagtgcgcccagtcccagcgccttggcttggcggtgcagatcgtccatatcctcggcctcagccgtgtcggacagcacggattccgcacggtccccggccaacgtaagcaccagcagatcacgcacacgagccagtaggtcttcgacgaatcgtctcggatcgaatccgccgaccacgactttctggataacgccgtacagggcttcgccgttgtgatcgattaccgcatccacggcctcaccgatcagtgcctccggcgtgaagccgagcagggctacagcggcatcatgggtgataacgccttcgaccgaaccaaccatcagctggtcaagcacggacagggtatctcgcatggagccgccaccggcgcgcatcgccagtttcagcacaccgggctcgggcttgatgccttccttgtcgcagatcgtctccaggtagggacccatgacttcctgcggcaccagacggaacggatagtggtgggtgcgcgaacggatggtgccgatcaccttgtctggttcggtggtggcgaagatgaacatcacatgttcaggcggctcttcaacgattttaagcagcgcattgaagccctgctgcgtgaccatgtgggcctcatcgagaatgaaaatcttatagcggtcgcgcgcaggggcgaaaccagcgcgttctcgcaattctcgagcatcatccacaccgttgtgcgaggccgcatcgatttcgaccacgtcgatggaacccggaccgccggtggccaggtccttgcagctttcgcattcgccgcaggggtgggaagtcggccctttggcacagttgacgcaacgggccaggatacgcgcggagctggttttgccgcagcctcgcggccctgagaacagataggcatgtgtgagcttgccctcgtccaaggcgcgcatcagcgggaccgtgacttggtcctggccgatgaccccttcgaaggtgtccggacgatagcgacgatacagtgcaagtgccatagctactaacctacctttgccctcagaattaaccgataaaaagtcaagataaaccgggctcatagttgccgaatcggaaaactctttatattccaacgacattcacctgacaacggttaccgcatttttattgttattaaccgctttctttgtattaacatagtgtcaataacggttgtggtcaggaggcacccatgagcgataccctcgacgagaaacgccccacccgcggcgatgcccggcgcgacgccatcgtgcaagccgcgcgcaaggtgtgtctggaaaaaggcttctccaaaatcaccgtttccgacatcgcaagcgaagtcggtatgacgcgttcgctgttctaccactacttcgaagacaaggaagccgtagctgacgcagtactcgataacgtcatcgacgaaatcctcaccacgttgaagcagtggaaccaagcgcgcgaaacaggcaacgtgaacaaggcattagacgacatcgtgcatgtgctccgctccctgatcgccgacgagagccccttctcaaaccgtatgatccaagacggcaacgccgaactgtatatcaagttcattgaccgcgcggcggaccgtattgccgactacattgcccagaccaccgtacgtgatttcgagcagatgcatggcctgccgatcaccaacgtccatgagacgttcttcacactgattgtggggcttatctcgctgattcgctcgcatccgaacatcagcgaccgaaccatcaaagaggtcatggcgcagacgctgcatatcgaaagctatgtcgtctgaggtctgacggccattggctctggtaccgctctcccgcactcccctcagtccgcttcgcggccagctcgtccgcaattgcggacagcctacggctgactttcttctggttcgactatcgtcgaaccctcgcctacaaacagcccactgggctgtttgctttacggctcagcctaatgaggggagccaatataatcgggtcacgcgaactggccggtcacgggatcgcgaccatctcgggcaatggcgttgagcacttcctgtcgggaatccacctcacgggcggctacggccggcggcactagcacgcgcaacgcgcagtcctcggccactaccctaaatggcaaatgcccgatatattcgccgtccgccatcagcaccggcggctcgtctccttccgttgcccgcgtgacttcgatttcacggatacgtttccagccgaacacctttgaagcaagtagcttgccgttataggcattcgaaatggccaccgcgcattcgccgaagttcggcacgtggtccatccacaccaggtccaacaatccatcggagaagcaggagtacggcgagacctcaatgccgccaccgatatgcctcgaattcgcaatcgtcagcaatggtgtgatgatgtctcgttcatccgtggtcccgtccgccaatgcggctttgatgtggtaaccataacgcttcatatgcgtcagctccaccagcaccgccgcaaagtagcgcatggtgccggtcggcagatgcgaatgattcgcacggtcgttgatgctcgcgtcaagaccacaggacagcatgcccgcatagtaccggtcaatcggatgctcggcggacttgctctcctggtactcgtactcctcgccagtggagggatccacggcatagccgccgtccaaagaggtcacgcgtcccatgtccacatcgatgtgtgatccacgcacgatagcaccgacgataccttccactgcggtttcgatacggttgaccggcagcttcagtcctcgtgcggaatcgttgcccgaccccgtggccacgatgcccaacggcttgccactgcagcccacggcgttcgctccaagtgcgatcatgccgtcgccaccgaccactacgagatagtcgtactcgtgcgcgcgttcacgcgcctgattcagggaatcgtcgaaactcgtgccggtgatgtcgatgacatcaaagttatgggcacggccggcttcctccagcagacccaatacctgcgcgtccaccttagcgccacggcctttatcggaagtggggttacccaccatggccaccacgcgacggcgctcgttgcgttcactctcgctcatgctctcaccttagccaaaggcccagaagcccgccagagtatcggtgctttacggtccattattgtgataattgtctccttccgtacaactcaccggtccggcccgagccatccgctccacggatgatgccaccaggaccatggtttccaccttgatggttaccaacacgtcttcatcccgcacggagcaggagcccaaaactacaccattcgcttcagccatgttggcggcgagcgcacatggatcaccgatatccgcatgccacagcgcatacgcggcgtcaaaggcgataaggtcggcgagggaacgcgctcggttctggcagatcatgaggttgcccacacttgccgccaccgcgagcgcaatgcccaccaccataaccagcatggctccggccatcgtgcccgatccctcctcataacgcattccctgcaccgcagttcctttctgttgcggccgcccagccagccgaccgttattggcttatcgccgtagcgttgccggtaacccgcgttggagttacatccagcggaccgggcaataccgaacattcgaccgtcacactcgtcgattggccgtcgtgggcaatgctgacgtggggctctcccccggcaacgtccgcagctatgctgcgcgcggatgattcgtcaccggtaaccacaaactcgcgtgcagccgctgccgcggcactttgacagtccatggaaacgatgaccacacgtcctattgccaatatcagcccggcgatggcgataatgctgggcaatacgattgcgaattcggcggtggccgatcccgtgcataggtctggcggcagtctggcgagccgccaccggcatgtcatggtcttcatggctgtcacccgactttcagagcctgtttgatgatgttggtcagcaacgtcttgatggcatccgacttcaggatggcgaccagcaccgccgcaaagcctgtagccgcaacgagtacgactgcgtattccgcagtggccgcgccttcttcgggctcagccatgagggtgcggatgcgtgcgtccatgaggcatagccgttctttcgccttggcgttcagcgtggccacacgagccttgctgtgcgcaaagatgccggcctgcccgtcgacgatgacggggataggggtattcattggcgttcctttcggtaaggaggggaagctgcgcagtggcttcgcaccttccccatgcgtgtgtgagtggttggcccccgcgccgggttgacgcggggtgcataccactgtggactatcaacgcttcatgcaccagggaaaacggggtatgtggttctagcttgccgagttatccacaccccgacgtgtcgtccaccaccaatgtggataaccaaacgcagccaagtgcaataccgagcaatacaacaagattcaccctaagcgcactcagttcacgcctatattcacatcatgaaggacgcaatcgccggaatgactcctaccagcacgaatgccggcagaaaacatagccctgtaggcatcagtagctttaccgacagcttcgcggcattccgttcgatggcggcacgctcgtcacggtccagctgttcaatggcggattcgaggcgcacgccaggcatatcgccatgcgtccatgacgattccaaagccgattgcagcaggccaagatctcgttgcgttctgctggtacgttttccggatgaactatcagctggcgcaccctcatgctgaacagccatagcggcatgccacgcatcagcccagggaacccctctggccagggagctcccgacctcgctcatgcgagcgccgcagtcgccgccgacggctttgcccaccatgtcaagcgcccggggaatcgaggagccctgacgcaaggacacctgcaacatacgcaatatgagtatggtccatgacgacccgcaatcatgcgctacggccggttcctcgcccggcaagcggctgtcatgacgagacggagccttatacagccaactagcgatcgccgcacagcctgccgcggcgtgtacccacaccgtactcataatccgctgcctttcaacaatgcccgcatccatgccaagccggcagcataacaacatccccctaataccaagcagaccacaccgcgtggcgatccaagcaagaacgccaatggtctagctcccagaagctcgcccaatgccacagtgacggccggaagcgcgctcagcagccccacagtggctttaggaacggcacatgcttgcgatcgcaggttctgcatcagcctcatctgccggtaagcagtcaataccgcttccagacatggcactgcttggcaaccgagctcatcgctcaaaaccgctgcggcggtgaccccgcgtgcagcttcaagtacctgcgctggtgattcgtcgggcagacgccgctgttcgaacaccgttatgagccgttccacagtaatgcgctgagtggcgaagcgtctgctggattgttcctcgaatgcttcaaccaatgtgccgccacctcgcaatcgcgcgatggcggacgtaatcacctgcgcaacgcccacgcgaggtgagccggcatatcgaggttcgtttatggctgcggaatcgaccgcacgcccgcagtaagccagccgatacagcctcccggacttgttccccggccatatcagcacggcgagcgccaccagaacagcacaccacatcatcacccaccaccactcggcccgggaacgatgccccatcgttcaatgaagtgcccccattcggcggcataccgaggaggatggcagccattccataccgccagcggtgttcctgccagttcaccatgtgctacacgcagttcgccgatctgcgtgatacgccgctgtccgttcactcgctccaaatgcaccaccgcgtcgaaagcgcctgccgccagcatggccaacgcctgtggactgactccggcgagtaatccaagcgaaatcagcctggacggtactcggttcacgccgtccgcatgcacagtggtcatgccaccgtgatgaccagaattgaacgcgcgcaataggtcgacgatttccgcgccacggcattcgcccagcaccacgcggtcggggcgcattcgcaacgtcgctttgaccaagtccgtcagacttatggctccgacgccctccacattcgcctcgcgcgttaccaacgacacatgatcgccacgccccagttctcccagttcacgaacttcctctacggtgacgatgcgctcgttcacatcgcattgcgccagcagcgccttgagcaaggtggtcttgcccacgcctgttccgccggtaatcagcactgtggcatgtctgcgcaccagtcccacgaacatcggcagccaagcagccgggaatacacctaattggctcagatgtcgcaacgatgccatggtcctgtcagggaaccgtatggagattgcggcaccttgtggcaccaatggggcaatcaccgcatgcacgcggatgccgtctggactggcggcgtccgctatcgggcaggcatcatccagtctgcgcccaagctgcgcgcacagttggacggcgtattctcgaactacttgcggcgagcgaaacggcacacgcaatactgtttctcgcatgccgttgccgcggtccgcccaaacgcggccatcacaggtcaccgccagatcggtaacctgcgggtcggatgccacatcattcaatagaccgaagaacacagttctgggcactgcgccgggctcatcagcccgagtgattacggcagccataccgcatcaccggtccttgcaagaagctcccgaaaccgggcgaatggcctgctcgacaagatcggcaagcaagctcacggctttgcggctgcctttggtcaccgatctgatgccgaggccttccagtacgtctccacacagattgacacttggtttgacaggccccaataccgtggcagtcaaatagtcctgcgcctcaccaatacccacgtggcctctcccacgtggagcgccacgtggttccacgccgacgatatgtggcgcttcacagccccatgaatccagtctggaccggtgcgacttggctctggccagccccatcaccgacaattccgcggcaatcacctgcatgccactgcgcagatcgggtacggtctcaatgagtccaccctgaccggcatctacgatgacaacgtcgttcgtttccgccaaggctcgaatggccgcttgaacttcccaccagtcaggctggcgcgcgctccaagggtcatagggaagtactcgcacaccctcccacatcatcagctcatggttcatcgcatcgccctcgatgcggccgaggggtgcgtcgacttggctgaatcgtaaacccggctctcgttctacacccagcagcaggtcaaggcatccggccacgaaatcagcgtctatgagagcgcagctgtgttcacgtctcgccaatgtccatgcaagcatggaagccatgacactcaaccccacgcctccatgacctgacgtcatcgtcacaatgttatggaagctggtgtctgtagttagggcgagtgccggagcctcgcccgatctctgccgttcgcatgaggccaacggcctgggcggcggagtgtagtagcgatgcgctggaatcggcgcatcgtccgtgggcagcggaatgcccggaggtgctaccgctggcgaggtgatcctacgcgccacgcggggtgtggtgttgctattcataagccgattgaaacgtgtccgagttcaatgctcaacacgaatcgaccattgtggttctagcttgctgagttatccacaccccggcatgtcgtccacgacaaatgtggataaccacgctgttgtttcacgcccatctcatgcagaaaaggccctgacctcatatgcacagtcagggccttcattttcacgacgattccttatgcggtaatctacattccttgcttacttatcgaggttcttgatgccgtcttccatgacgtccaactgagcatcggtcaccttggccggcttcttcttgccgaacttggccttgagcagaccgatgatggtcggggcgagcgaaaccagcagaatcagcacgatcaccagttcgaagtgatcctgcacggccggaatgttgccgaagaagtagcccagcagcgtgaacaacgtggaccagcacaggccgccgagcactgagaacggcgtgaaacggctccaacgcataccggaaataccggaaatgaacggcatgaacgtacgaatgaacgggaagaagcggcccaggaacacagccagcgggccccacttttcaatcatgccctcggttttggccagtcgctcaggagtcagcgccttcaccttgccggattggataatacggcggccaaagaaatgaccgatgaagtagttgcactggtcgccgataatcggcgcgcaccaaaccaccggcagcaaccagaacagcggcagcgcggccttgccggtcgcagcatccggggctgcgaacacgccggccgcgaacaacagcgaatcaccgggcaggaacgggaagaacaccacgcccgtttcgatgaatacgatgaggaagatgaatccgagggtcggcgccacgcccatggcaatccaaccggcaatcgcggcacgcggatccttcagcagttcgatgatgaaattaacgaagcccatgtgtttcctatgagtcctaaatcttgtattgagctgccagcccaatgaaccagacagttatatgcaaaccgtcaaataccctaccagccggcctataacatcaggtcgactggggtttcccacacaaactccgcaatacaaacgaaatttctactcccccaaacgctgccgcacaaaggcgtccagcgcggccgcatcgatgccctcatacgagtcgatggaggcaaactggccaaggccggaagtgtcggtgcgaatccagccagtctgcgcaatcagtgtggcccccgaggcggcgccggagcgcagaccggatgaggaatcttccattaccacgcacttgaccatgtcttcaggcgcgatgccgagtctctcagccgcggccagatatggggcagggctcggcttgtgctcgtacggatcatcgccgcagacgtagccggcaagcaatccatcagcctgcttcatgatgttctcggccatgcggcgaggcgaagtagtgaccagcatggatgggatgtcggcttccttgagcgaatgcagcacgtcttgcacaccaggaatccacggcagacgttcgacctccgccttgaacacataatccttgagctgcttgtcgatttcgggaacgctcaatgtgcagccatgcgcaatcatgacctctgccacgtgtggtaccggagtgccggagcactcccaaccgaggtcctcgttccactcgccgccattgttgtgcgcgatctcaatctcaccgtcatgccagagcggctcagaatcgatgagagtaccgtccaaatcccagaacacggctttgagcagcatagttacctccgtccacatgcccgcacgccaattggcgcctttactcttgctgcattccattgcaccaatcggatgcgacaaccatagcgcgtcagcacaccgcccctgcgcctcagcgcatggtcagcccaccatcgacgtgcagacattgtccggtaatgaagccggccatgtcggacgccaacaacgcgacccctccggcgatgtcatcgggacgggcaaggcggccaagaggcgtcatggcaatgattcgttcacgaacatcctcggtggtggctgcgctggatgcggttccggccgtcaaacctgcggcaatggcattaacggtaatgccgaagccgcccagctcctgggccagagagcgggtcatgccgaccaagccgcctttggcagtgatatacgaatggtagggcacgatgggcgaatcgaccagattgctggagatgttgatgatacgcccggaggtctgggctcgcatcagcggcaccacatgtgagcacatcagatatgcaccatgcaggcatccctcgatctgtgcgctaaactcatcccaatcgcctccagcaaaagtggaacggcgacgcgggtcaaaggagaagcgtccgaaagcattattcactaagatgtccacgccgccgaatgagtcgacagcggtacccactagcttggaagattgcgattcatcgcaaacatccgcctgtacagctatagccaagcctcccagcgagtggatgtcttcaacggtgcgctgcgcgctggcggcgtcatgtacgtaattgatgacgacagcggctccgtgcgatgccaggcatttcgccacagccgctcctatgcccttgccggaaccggtgatgatcgctgttctgccatccagattcaccattggacgccgtgccatatcgctttgctctgtcattacccttgcctttcgccctgctaccagcctctgctgcccgcaacagcacaggcctattccatatccatatcgaacgaatcgctgtacgcgtcgctgccgcgttcgacatccaccacgcgcaacagatcgatgaggttgaagcccccatcatgatgccagccggatttcgcccgatccatctcaccgagcggacagatgcgattcacaccgacctcggccaatgtatctgcaagaccaaacagtctggttgaatccacagcgacaccgcagctctgcagccagccacggcaggaagtcagtcttctggcagcgtccaacaaatctggcaccgccaccacgttgacggtgcggttcaacggcgacatcagcgaagcaacatcctcgtcggcaccgctaccgtcaagttctcgatacagcaccgaccatgccgtgctatggccactggcgaacaccgcggccttcccgcccatcaaggctctcatctcagcgtcggtgcgcgcccgctgaatggccacgttctcggcgtcactcaatacggagcgcggatatttgcgctgctgattctcaagctcgccaccgagcagctgagccacttcacgaggggtgagggctccatcagtctccacgaacacggtctgcggagccaggcagctttgctggtcatatgtggcgatgtcaacagccacacgatgcacggtatcggcataggtatcaggacgcaaagcctctcggccaatgaacgccaacccgacttttgctccgtaacctagacagggcttggacccggcgactttgcccgcaatcaatttggtagtctgcgaagaaccgtaaacaaccacggcatcggccgcatcgatggctgaatcctcgagctgctgcgagccgcccttccatggaaccaccgcaatggcatcagcgaggtcggaattgaccatcgcaatgctgcgagcaaagaacgcaggcatcaccggctcggaaaatgaagatttgccaagaatcgcgcctttgaccagcagggtcatcgccatgctccacacgggaatccccggcacattgctggagaacacctgataggtgagcgctgggcccacatatttagagtatccccccgccttgttcggccggaattcgtcgagcatagacggctgaccgatttcggagtcaaggaaccggagcagttcacgacgcctgaactggcgcatataccgtttgagctcaatccgcaccatgtcaggctcatatccggtgattgcgggaatcagcagttcagcctgacgccgcagctcaaaatccggatcggcccatagttgggccgcgtcggccacgatgtcgagaatatcgttgacactcatcgcggcaagcgtgcggttgcgaacatcgacaagctgcttggcaagggaagtcacctttgagccatccagtcgcggatagcgcaaacgcttcaccccatccgatgtggcgacctcatagatttcgtaatccgaaacatccactcccgagggcaggtggaagacatcaatggcctgactcacggattcatcaacggttggcactgatgacctcgtctaccgcgattgagcacccacgagcctcggctcccttcgccctgccctgcagcaggaatccgtccggggtccgatggccgaggtcctcggtcagaataccgatgcatgaattccaattggcaaggtcgtaatgggctatcacaccggtctcaccatccttgacgggagtcagcgtttccggatcgaggaagaccgtgcgcacccaggcggggttcgccttgagatagttgctggtgccatccgtataccacgacagaatattttggtcatagatctgcgagctcaactcggtcatgccatacatgttgacgcagtggtggcgcggcacccccagtgtctgttccagctcatcaagcatctggtcttcggtgatgtcgcgcttagtgctcttgaagccgccagtgtcgaacaaccggctatcgggggccagcgcgaacgtcagatcatgctcatgcaggtaatcgaacagatacagataggacgacgagacacccatcagcatcaccggttcaccgtcagacaccgcacggttaaggaaggcgatgatttcatcgaacttgagtccatgctcgtcgaagaacacaccgctgccttcgctgccgcagcactccacggccttggtaaggtagcgcgacagggaggagttctggttcatgtcccatgccggcgaaatcacggcgatgcggatacgctctcgatccggcatgatgaaatgacggaacggcacaatcattgattcatcccacacctcaagatcgggatggaagttgcgcccacgcatcttgccgccatgcgtggttccgctcgtcatgaatacggcttcgcactgctcggtcggtatggtcgaaaggtcaaggtgcttgaacccgtccaccggcatcggcggaatctcccgccaatccttgagcgttgcgggggtgacgcgtttagccgcgcagtaacgacggtacggcagatcatacgtgtactgatagatgaacacgtcgcgcgccaacgcaccaaacgcctcttccggggcctgctcacagccataggtatggataaaatccagaatcccgcgcttgatacgacgcgcgtcatccatcacatcagtcattgcatcgctcctgtcaatatccaatatcaaccagcattatcgttcatcgtacgccgcagcgccagtcccatccgccggatcggctgctggaacatccacggacgccggcgcacgatgcttcgccaccaaatccggaagagcgacgaaaagcgcattgagaatgatggcgctgaatacaccgaccatgatgttgttgccaaagaacacgcttgcgccgccggtcaggccggagagcgccttgggcagggcgatgccgagcaacagagacatgccgatgaccgtttgacggcgctcgtcatcagcgaccttgcgcagggcgcgcaggccggtcacgattaggctggccgcagccggcaggaaaatgcctccgacgactgccgagggaatgacggacagcaacgcgcccgcctttggtacgaagcccagaatcagcaacagcacagcggcgatgatcacaggcgtgcgcgtgcgcaacttgccttcgccggtcaggttgagcaggccgacattttgcgggtaggcggtggtggtgaatccaccaatcagcgaggaaatggctgaaccggccgcctcgccggcaagaccgtagcgcacctgcttgcgttcgaggggcgtgccctgaatctcagaagccgcctgatagacgccgagagcttccatgacggcaaccatgtaggcgatgaagaacgggatgaagatcttccagtcaaatgtgaacggaccgtagggcaggaaggtcggcaggcccagccatcccttggatgccacaggagagaagtccaccatgccaaatgctgcggcgaccacggtgccgacgacgagcgcgatgaggaatgagaacgacttgagcaggcccttgccgagcaacgacaggacaagcacaatcgccgtggtcagaatcgacacggtcaggatgtgcggatcggcgaacgtcttgtcgccgggagccccgcctagaaactcgctcagcgtgaatccagacagcgagacaccgaccataaagatgaccacgcccgaaatcatcggagagaacaggaaccgcatccgctctatcacaccggtcaggcacagcaacaggaacacaagcgaagcgatgagaatggacgaactcgccgcccccagcatgccggccgtacctgccgcgatcatcaacgcgtcaaacgcggctgacggcccctgcaccaccggcaggcgaaccagccgagtggcctgaaccaaagtaaccagaccagagacgatgaagatggcgttaatcatattcgacgacagggcaataggtaagccgattgctccggccacaaacaccggatcaagccagacgttggaaacaagcacatgctggaaacccagcagtacgttctgggcggtcagctccttgcgtattgacatacgcttcctctctctcaacgcgtatatgggatgccgagccgaacagaggagttcaaccgtcgcattccctacgcgagtgttagctcacaggttcgaagggttcggcacataccgtctcagcctaaagcaccccttacgaatcggttttcgcacgtcaccgtaacaaaccttgacatctccgtcaagaagattcgtgcttttcggcagctgcccgatgtgagataacaaacagttttacgaatggagaaggaatcgaagcaatgcggccagactcaccaaccccacaggaccatggacttggagtcggcgggagtgtagttggagtcgccggtggcgccggcagcgatatcggcggcagtatcgcggccgggcagttcgcgggtttcgcggcggatggcgttgcgccagaggcgggcgcggttggagcgttgtacctccacgatattgccgtcacggcctgcggcgaaaacgctctcctggtcgccggtttgcatgcgtttgacttcgcggcgcagttggcgattctcttcttcgaggaccaaaatgcgcgcgataccggaaaggttgatgccctcatcctggctcaggcgctgagctcgggtcaggcgggcaatgtcgcgcaggcagtagcggcgtgcgccgccatcggtgcgctgcggacgaaccaaaccgaggcggtcgtactgacggagagtctgggggtgaatgttggccaactcggcggtctggccgacggtgaagatgggcagttcgatgtcgaagccgacgtcatcggctccgtcgagatcggccctgcccatcacgagcgcggttgcgcacatcgcgtataactgcttcatctggttggctaaccgcgccattgttcacctcctgattacaggctgagatagtcgccggctttttcgtcgaattctttggcggcgtgcttgacggccagacccggcttggcggggaccatgatctgcacacggccgatcaggtcgcccggctggttgctgcgctggacgccaagtcccgcgagcttgacttccgcgccggagctggagcctgccggcaccttgaaggtgacgggattgccgtcgatatccttggcctcgaccttgccaccggccacggcctggcccacagttacgggcaggtccatgacgatatcatggccgcgcatcgagaatgtggcatcgggcttgacagtgacgtgcaggtacaggtcaccggccttgccgccgttgatgcctggcttgcccttgccggccagcttgattttctgtccgtccttgacgcccgcaggcacgtgggccttgaacttcttgccgtccacggacaaggacacggtagcgcccttgaccgcctgacgcagggtcaggctgatcttggagttgcggtcctcgccgttttcggggcgcggggcctcctcatagccatagccgccggcattgccgtacggcgattggccgtagccgccatacggctggccgccctgacctgcagcaccgccgaacatcgagaagatgtcgttgatgttgttggggccgccgcccgaagtggagaagcggatgcgcgagccattgccgccggcaccctggccgaacatggaaccaaagatgtcggagaaaccggaagcatcgaagccgccggtgccggaaccgccggcgaagcgggcaccgcccatgccgaactgacgaatcgcgtcgtacttctggcgatcttccttcttgctcagcacgtcataggcttcggagatgtccttgaacttctcctcggcttccttggtcttgttgacgtcaggatggtatttgcgggcgagcttgcggtacgccttcttgatgtcgtcgtccgaagcgtccttggagacaccaaggactttgtagaagtctttgctgagccattcgttttcagccattcatgtctcctttctagaaaagtctttatgattggctcccctcagagaggggagccaaggtaaatatcaactcattgcagcgagctggatgtcagttttgcggggaggctactactactcgggcggcgcggattacgcgatcgccgatgcggtagccggcctcgaccacggtgtcaaccgtttccttttcggcatccgcgtccggcttgtgcaggatcgcgtcatgcttggtggggtcgaagtcctcgcccttttcgccgaacttctcgacgccgaacttctcgaaggccttgtcaatcttggtggcgacggccttgaacgagtcgtccatctcgctgtgttcgcgaatgcggtcgatatcgtcgagggcgggcagcagcgcggtcagcacgtcgatgatgccgtgctggcggaagcgctcctgctccttctgcgtgcgattgcggtagttgatgaactccgcacgttcgcgttgcagggcttcgaggtagtctgcggcttccttcttggccttgccgagcggggtgagggtgtctgcggaatcggactggccttcgccagtcttctctccctcagctgcggcaggagccgcgtcggctccttcattggaaggagcctgggcagccgaatcctgcgcagagccggactcggcggaggcgtcagcccctgaagaggcctgagcggcagcctcagcatctgagggatccggcaggtcgttcaggtagtcgtccttgttgaactcggacatcacttgttgtccttgtcgtcatcgtcgtccacgacctcggcctcgacggtgtcgtcgtcggaaccggaggcggagccagcggaagcgccggcaccgtcagcaccagcggcagcaccctcggcaccctgctgggcgtagaggacctggccgatcttctgggcggcggtcatcagctcggtctgagcggtcttgaccttctcggtgtcgtcacccttcagggcttccttcagagcgttgaccttgtcggtgacttccttgacgatgtcgtcggagagcttgtccttgttgtcgttgacgagcttctcggtggagtaggcgaaggcctcggcctggttgcgggtctcggcgtcttccttgcgcttcttgtcctcagcctcatgagcttcggcttccttgaccatgcggtcgatctcgtccttcggcaggccggaaccaccggtgatggtcatggactgctccttgccggtgcccttgtccttagcggacacgtgcacgatgccgttggcgtcgatgtcgaaggtgacctcgatctgcgggacgccacgcggagccggagcgatgccggtcagctcgaaggtgcccagcggcttgttgtcgcgagcgaactcacgctcaccctggtagacctgaatcagcacggacggctggttatcttcagcggtggagaagacctcggagcgcttggtcgggatggcggtgttgcgatcgatgagcttggtcatgatgccacccttggtctcgataccgagggacagcggggtcacgtcgataagcaggacgtccttacggtcgcccttgatgacgccggactgcacggcggcaccgacagccacaacctcatccgggttcacggactggttcgcttccttaccaccggtgagctccttgacgagttccttgacggcgggcatacgagtggaaccaccgacgagcaccacgtggtcgatgtcgctcacggagatgccggcgtcgtgcagcacgttgttgaacggcgtgcggcagcgacccagcaggtcggaggtcatttcctcgaagtgcgcacgggtcagagtctcatccaggtgcaccggggtgccgtcaggggtcatggccaggtactgcatggagatgctggtggaggtggaggaggagagctccttcttcgcctgctcagcggcttccttcagacgctgcagcgcgatcttgtccttggacaggtcgacgccgtacttgttcttgacttcggaaaccagccaatcgatgatcttctgatcccagtcgtcaccaccgaggtggttgtcgccgttggtggcctgaacctgaatggtggagaagccgtcgtcatccttgccgatctccagcagggagacatcgaaggtgccgccgccgaggtcgaagaccaggatgcgctcgtcttccttgcccttctcaaggccgtaggccagagcggctgcggtcggctcgttgatgatacgcaggacgttcaggccggcgatcttgccggcgtccttggtggcctgacgctgggcatcgttgaagtatgccgggcaggtgatgacggcgtcggtgacgggctcgccgaggtaggcctcagcatccctcttcagcttcatcaggatctgcgcggaaatctcctgcggggtccacttcttgccgtcgatgtcgacagtccagtcggagcccatgtggcgcttgacggaagaaatagtgcggtcaacgttggtcacggcctgacgcttggccacttcgccgacgaggatctcgccggacttggagaaggccaccacagacggcgtggtgcgcgcgccttcagcgttgacgataacggtgggctcgccaccttcaagagttgcgatgcaggaattcgtggttcccagatcgataccaactgcacgtgccataatgtgtgctccttaattactcgtttgttcttacgttctttgcccaagttccgattggtcgtctcttggaccttccaaacttgagcctacatcactcaacttccatttggcaagttctattcccaatttcaacacaaaaagttgagtatgtttggctcaagttttttgtgggagtgactgacggcgatgacggagtggtgcgtttggagccaaaatccacttatacagaaaactgcaaggggtgactggggcgcgccatcagccttgccatcagacttgccagcggcggcgcgcgattgcggcgcatggggtgtgtcggcgacgttattgtcgctgggggcatcgatgcgctgaataactcagacacagtgtttgtcgccgattttctgcgggaattgtttggcaatatcgccaggtatgccgattcgacgcagcgttacgtggtgctggtttccgccgctcaggaccgcgtcaccattgatgtgacggaccgtccgcgtcaaggtgacgcgacgtttgagggggcggcattccgggcttgcgtactatcgggagcgtgtgctgcatgcgcacggggattgggatgtgcgggagaaacgcgggcagtgggtactgcatgcttcagtgccgatcgataacgctggctaatcgacaacaccggctcatcaataacgccggctaattgataccgccaatcactcgataacgccagccagtcaataacgccggtccccggccgcgccggcgtgggtcgcgagcgaggccgccatcgcgaccgcgcagaccgcggcggccaccgcgacgcccttgtgctgtttcaccttgtgcatgaaaagttcctttccactgaccgcacgatgagtgcaatcgcgaaggccatcccacgcactgcacccggtatgccacgctcttcggcaaccatgccgaacttatcgccgcataccggggcgcacccggatgttgcagaaagctgcaaccgggctcagctgcgcagcaaaatttcttcgagcgcgccggccaccgcatcgggcatgtcggtgatccagaaatcgttggcgtagcgcggaccacggttcatggtgcgcagggcgccgatcgcgccgatgccgagcttgtggaccgcctgcagcgcgagctccttggtgcggtagagcatctgggcgtgcagcagtaggtccatcgcgtccgattcgaccggattgtcggcgatgcgcagaccgccgggaatctcgatgcgcagactggcagccgagctgatgccggtgacggacacggtcaggctcatggtcgcctcgtcgtacgccaccgtcgcctcgaccggagcctcgccggaccatgcacgcacgccgctggccgcgtcaaccggcgcgacgccgcggaacacgaccgtccagtcgcgcaactcgggtacggcggacgtatcgccggtaaccggcgcgacggtgaaggcgctgggcgacgcatcggccccgccccacgtgaacgctatcgcggtgtcggcgctgggggcgccccacgtgccgcgatcctcgcgcatgacgaacgagccgtcggcaccagggaacaccagcacgcgcagggcctgcgggttggcgatagagttgatcgcttcgccggattccgcgacgtcctgcaacggcacgatcgcgccggccttggcgaacaccggcgtgcggtcgagcgagcgccagacctccagtcggcggccagcggcgtcggatgagacgtatcggcggccgtcgaagaagtcgaaccactccccctgcggcagccaggcgtcggcgcggccgcggcaggcggcggcatcgtccggggagacgatcggcgcgaccacgagctcggtgccgaagcggaactcatccggcacctcgtaggcgtccggcgtatccgggttctgccagtacatcggctcgaccagcggacggccggcttcggcggcacggtagttcatggtgtacaagtacggcatcatcgcgtggcgcagacgcagcgcgtccaccatcgcggcgctcacgtcacggttgaagttccacggctccttgccggagaacggcgagttggacgaatgcagtcggttgatcgggctgaacgcgccgagctggtaccagcgggcctccagctcttcgttgcggtagccgaacatgtggccgccgatgtcgtggctccaccagccatacccgatgttggaagcggtggcggtgaactgcggctggaaggcgagcgattcccaggtcacgatcgtgtctccggagaagccgaccggatagcggtgggagccggggccggcgtaccgggagaaggtgagcggccaattgccaccgcgccctgagtcgaggtagtgcatgtggttgagcatccacagcgggtcgagacccttctggcgggtcacgccgccctgctgccagtccagccaccagaagtcgacgccttcggcctccatgcggtggtgcatgtcgaaataggcgtccacgaagtccgggttggtgaggtcgaattccacgttctcctcggtggccgggtcgatgccgacgcgcttggcgacttcggggtaggcgtcctcgaacgcgcgcacgccgtcgcgcgggtggacgttcagtgtggtgcgcaggccgcgccggtgcaggtcggcgaggaaggccggcgggtcggggaacagttcgcggttccacgagtagccggtccagccggaaccgtacttcgggtccacgtcgtccacgcgatgccagtccatgtcgatcacggaggtggtgaacgggatgccctcgcgcttgaagcggtccatcagggccagatagccgtcctgcgtgtaccggtagtagcggctccaccagttgcccatggcgaagcgcggcaggagcggcgtggggccggtcaggcgatagaagtcgcgtacggcctcgatgtagcggtggccatagccgaagaagtacaagtccgtttcggcggtggcgcgcggggatacccaggtgccgaacgggttcgccttgccgttcaccgtgtcggcttcgatgatgatgttggcggcggaatcgtcgatgacggcccagccgtcgcgcgagatcacgccgttgtcaagctcgatggcgccgtccgcctcgtccagcgtgcgggcggtgcctttgaggttgccgcgctgggcgtcgccgtaatgccaggtgttgaactgggtgtcggccacgcctttgacgaccacgctcaggccttccttgctgaacggctgctggtcgtagacgatggtcagggccacggtgtcgatgatgacgcggccgtcacgctcggtgacgcggcgttcgactgggctaccgaaatcgcggttcaggacggtctgggtcgggcggttctcgaatacgccggaatcggaccattcgaatcgcacgagcgaatcggtgatgagtccgatgcgccagtgctcgccggacaccacattgtcggcgcgcatggccggcgtggcgtcgaggcggaagtcctgcggatcgggcgaggtcggagacgactgcttgagttgtggtgactgtgccatggttaccccttctgtacggttatccacgatgatacgagtgatgcggccgcggctccccgggactggtgggagactgcggcgcggttcggattcggccgaaaccggccgggtttacttgcccgagccggtggcgatgccggcgatgaactgcttctggaacaccaggtaggcgatgaccaccgggatgatggtcacggaggtggcggcgaacagtccgccgtaatcggtgccgtactggccggagaacatcttgatgcccaccgacaacagctgcttgtcgtcatcggcgatcatgaggaacggccagaggtagtcctcccagttccacaggaaggtgaagatggcgagcgcggcgatggaattgcggctcatcggcagcaccacctggtggaagatgcgccagtcgctggcgccgtcgaggcgggcggcgtgcgggcggagcagggcatcctcggagttgtggacgttgaacagcacgggggcgttcttgttgcccttgcgcgagagcggggtcttgacccagtagtcgctccaagccacctgcgagatcttgaaggtgacgttcgggtggatcttctcgtactcgcggagcatggagatcaccgggtcagtgctttcgtcgccccaggaccagtagcccagttcgatgggctggccgtcgttgaccaagtggttggggtcgtaggtgatggtgtcgcccatgacggccaggcccttgtcggcctgggtgtcgacgacgcctgacgaaccgctcgaactgcaaccggttgcaagtgccataatgctcacggttgcagtcagcgcggcgagagatttcttgatcttcattatctcccttacttcctcgcaagctctaagtgaaaacggttcagtatacgggtgtcgaactagttcggcaacccggctttctcagccatgcaaaccgttacatttgcaacctgttacattccaaagctattgagaccatattggtctatattttcggcgtgtcgcaatatcgcaacccattgcactatgactgtcgtaaaacgtactgcaatgatttacaatgaagagaagtttgtcacaccgtcaactttgaaaaaccgggaggggccatgaaagccagcatcgaggacgtcgccaggcaagcaggcgtctccaccgccacggtctcccgcgcgttctcccgccctgacatggtctccgccaaaacgcgcgccaaggtgatggaggccgcccaacaactcgacttctcggtatcccgcatggccggcatcctcaaatcgggccgctcccaccgcgtggcgctgctggtgggcagcagcaagctcgactggttcacctcgcgcatcatcgaaggcctcaacgaagtgctgcgatcggccggctacgatctggtcatccaaccgatcggcgatgcgggcgcgcgcgaggagttcttcgacgaactgccggtgcgcggcaacgcggacgcggtcatcgtctcgtcgttcgccatcaccccggccgaaatcaggcgactcaacaccacgcggatcccgctcatcggcatcaacacggcctcgcaggggttcaccgcctccgtgggcatcgacgacaaggccggcatccggctgatcgtgcgccatctgaccacgctcggccaccgcaacctgttgtatttgtacgagacgttcgatgccacgatgggcttcagctcgcacaaccgcgtcaccggattcctggaggcgtgcagcgaactggacggcgtgaccggccagacgatggacatgcaggccggcgacgatccggtcgacgccgccctcaccgcgctgctcgcgcgcgacgacgccccgactgccctgtgcttccatcaggattcgctggcgattccgctgttcttccgcctgcgccaatgcggcatggcgattccgaccgacctgtccgtcaccggattcgacaacagcacgttctcgggcgaggtggggctgaccaccgtgcgccagaagccgtacgacatggccgtcgccgccgcgcgcaaggccctggaccttatcgaggggcgcaccctggaccagccgcacgagatcttccccgtgcaactgctggtacgcgactccaccgccgcgccgcgggtgcgcggctgagcggggccgaatcagtcgttattcgggccgctgttgtcggactgggctttgccgttcctgcgagctatcgccatgaacgtgacgccgacgatgacgggcaggaggatggcggcgagcgttgcggcgcggcggatggcatcggacgttgcctttccggacttggcgtcgcctgacttggcggacgctgcggaatcggcggacttggcggcggtgtcatcgcccttatgcggtgtttcgccggtgaaccaggcgggatcggacggatcgtatttccgggtgccggcccagtttgcgggcgtcgcgccggcgtatagggcgacggccgagcccttggccacggtggcggtgaaggtgccggccacggcgttgcggaagccgatcatgccgcggatggcggtccagcgttgcgcgcagtgccaggtgccggcggtttcgatgccgtcggtcggacaggtcatgtccggcacggaggtgcgggtggcgccgggagcgccgtcgtcgacgccggcgtagtagtagccggagaagatgtgcggctggccgtaatcgtaggcgagcatgaaggcgttggcgagcaggtagctggtgccgtcacgggtggtgagcgaggagccgttgcgctcggtgtcccagttggtcacccatacggccgccttatcggaatccacccaggtcggtccgccgatggcgtccaggccatccgaacgaatcgatgcaggccggcttcgacatggacctctacctcgactggcgccgggacggccacccgaacggctacaacctgttgctgcgcaataccgacacgcctatggagcacgaaggcgattccagttatttcaacgccgattcaggtgcctcaatcgcctcattcctcacggaatacctgccggacgagctctcttccgacgccgacgtgctgctcagtcttggtgaaccggccgtgagcggcgggcagctgacgctctccccgcaatcgttcgtcgtgtttggttaaacccgttcgacctcacctccgccggcgaggctgtcggcaaagtcgactggggatagtcaacgggccatcacgacaaacaccaacacctctagcctcgtccaactcaccgaatgtattgcaatcgttgtcaatatgagttacggtagaggcagaacagctcgaacattggtctgtcaggttgccggaacctcaacgcagagcggccctcgaacagcaatgcaaacgactagcagtacccgatttgcaagcaaggagtcatcatgaccgacgcatacggcaacgacgcagcaaccagcaccggcaccatcgcagacaccaccaacaacgccgcttccggtgccccgcagcgcgcggaaagcacggaacgactcgcccgcccgctcatcaagctcgccaaagcctgcggacttgccacctcattcatcgaccagctcggcacctacaccgaaatcagcgacgcggccttggtcgccgtactcaaggccctcgacgtggacgcatccagcgacgaggccatcgtacgctccatgacccaacttgaggtggaaaacagcaaacgtttgctcccctccaccatcgtcgccaccaccggcaaaccgaccggcatcaccctgaactgctcgtcggacgcggacatcaccgcctccatcgaactggaggacggcaccgcgtttggccactttgccctgctgccgaacctcaattccggcaagccggacttgaccatcgcacccgacctgccgatgggttaccacacgctgaccgtcacggttgacgggcgcgagggcaaggcggccatcatcgccgcccccgcgcgcattcccgtgccggaggcggtcgccgagcaccagcggtggggctggatgacgcagatgtattccgtgcggtcccgcgaatcgtggggcatcggcgattacggcgatctgaagcgtcttttggcagatgccgccgagaagtccaaggccgacttcatgctcatcaatccgattcacgccggcgcgccgattccgccgcttgagccatcgccgtatctaccggaatcgcgccgattcctcaacgtgacgtacatccggccgcaggatatccccgaatatgccacactgccggccgacgtgcgcgcgcaggtggatgcgctgcatgattcggtggccgcgcgcaacgacgaatcgaccccgatggacatcaacgcggcgtgggaggccaagcgcccggcgctgcgcctgatcttcgaagcgggccgcaacaacaagcgcgagctcgaattcgagcatttcaagaccaccgccggcccggacctcgattccttcgccacatggtgcctgtgcttcgaggtatggggcgcgccgtggggcgagaaccgttggttcttcgagaagaccatcgacgacccggccgtgcgccagctcgtcgaggagcaccacgacctgttcgagttcaaccgctggctgcagtggatcgctgccgagcaggtgaacgccgcgcagcaggaggcgctggaccacggcatgacgctggggctgatgcaggacatggccgtgggcgtgcacgggctcggcgcggatgcctgggccaatccggaacgcttcgcctcaggtggcgtcacggtcggctgcccgccggacttctataaccagcagggccaggattggggccagccaccgttcaacccgcgctacctggaggccaccggctaccaggtgtaccgcgagatggtgcattcgatgtacgagcacgcgggcgcggtgcgcatcgaccatgtgctgggcttgttccgcctgtggtggattccgcaggggctcggtgcccgcaacggcgcatacgtgacgtacaaccacgaggcgatgttgggagtactggccatcgaggccacgcgcgccggaggcatggtggttggcgaggatctgggcaccgtaccggattacgtgcgccgcattctggccgatcacggcgtgctcggcactgacgtggaatggttcaaccgcgtggacgattcgccgaacgccggcgacccgtaccgtgcacccaaggactatcgcaaacaggcattggcctcggtgaccacgcacgatctgccacccaccgccggctacctgaacttcgcacacgtcaagctgcgcgaggagctgcatctcctgagcgagccggtggaggcattcgccgcctcggcgatggccgagcgcacggccatgatgaaccgtctggtggagaacggctatatctcgcagaccgtggcggatgatgtggaaggccatgtgcaggaaatcgtggaagcgatgcacgccatgctcaccgatacgccgtcgctgctgctgcaggcagcgctggtggacggcgtgggcgaatgccgctcccagaatcagccgggcacttccagagagtattcgaactggcgcgtgccgctggcggacagctcaggccacgtggtacataccgacgaggtcttcgacctgccacgcgtgcagtccctagccgccgtgatgcgccgagagaagcggtgatcgattccggcaatgggaaattggtctaaatcggcccctcgtaatcgagatagccgaagacgatgacttgttatgggcatgttatcgttgtcatgacaatgattgttcgcgacggcgaaggagcgacggctatgaccaaggcaagcattcaagcggtggcccgcgaggccggcgtttccgtatccacggtgtcccgaaccttcgccaagccggatctagtgcttccagagactcgagaccgagtgatgaccgcggccgaaaagctcgactactccgtctctcgctcggccgccgcactgaagtccggccagtcgttccgcattgcgctgctggccagcgagaccatcaccacctggttcaatgcaaacatcttcgccggccttgactcggcgctgcgcccctccggctacgacactgtgccctaccccatgcgcaacgccgccgagcgccatgacttctttgcggatttgcccgtgcgacgcaatgcggatgcggtgattgtcagctccttcgacattgagccggctgaagtggagcgactgaagcatatgcacgtgccgattgtcggcatcaacattccctccaccgatgggttcgacgcaggcgtgagcattgacgattacgccgccacacgttcggccatcgagcacctgattgcactcggccaccggcatatcgcgttcgtcggcagcgccccgaccgaaaccaacatgcgctacagtgccgaggctcgtttgcagggcgtcattgatgccgctgccgcccatccggggatcgagctaacgcccctgagcattcaacgcggtcttggcgaaagcaacgcggcattgaacgccgtactgaacgcctcccccagcatcaccgccttctgttttgaggatgatgaaatggccgcacccgtgctgtatcgcctgcgtcaatacgggcggcgggtacctcaggacatctccatcatcggcttcgacgattccaccctgtccgccgccgtgggactgaccacactgcatcaggacccgttcgcaatgggcgtggccgccgggcacatggtattggatgccattgcgggcaagtcaatcgaaccggcattcgtacggccggacactccgctaatactgcgcgaaaccaccgcgccgcctgccgcaacagcagcgtccgcgcaggcgtgactacgttaccaccgcaaaacgccgataaatcgacttttgcatgcgtaattcacatgatatcgttgtcatcatcaatacaacggttgggccttcacacagcagttcgagcacaaccggaacaacccaaccacaacgcacccggaacaggaaggaatcggcatgaccgccaacaacctcaatgacgactggtggaagcaggccgtcgtctaccagatctacccgcgcagcttcaaggacgtcaacggcgacggactcggcgacatcgccggcgtcaccgagaagatggattacctgaagaacctcggcgtcgacgcgatctggctctccccgttctacccctcggatctggcggacggcggctacgacgtgatcgactaccgcaacgtcgacccgcgcctaggcaccatggacgacttcgacgcgatggccgaggccgcgcacgaggccggcatcaaagtgatcgtggacatcgtgcccaaccacaccgccgacaagcacgtgttcttccaagaggccctcgccgccgagcccggctccccggcgcgcgaccgctacatcttccgcgacggccgcggcgagcacggcgaactgccgcccaacgactggcaatccttcttcggcggcccggcctgggcgcgcgtggccgacggccagtggtatctgcacctgttcgataaggcgcagccggacgtcaactggaagaatccggacatccacgaggagttcaagaagaccctacgtttctggtccgaccacggcaccgacggcttccgcatcgacgtggcgcacggcctggccaaggatctcgaatccaagccgttggaagagctcggccgcgaatacagcgtggtcggcgtgctgaatcatgacttcagccacccgctgttcgaccgtcgtgaggtgcacgacatctaccgcgagtggcgcaaggtgttcaacgaatacaacccgccgcgctttgccgtggccgaggcgtgggtggtgcctgagcaccagcacctgtacgcttcgatggacgagctgggccagtccttcaacttcgacttcgcgcaggccaactggtatgccgacgagttccgcaaggccatcgccgcgggtcttaaggcggcggccgaaaccggcggctccaccaccacgtgggtcatgaacaatcacgacgtgccgcgcagcccctcccgctacggtctgccgcaggtcaagggcgcgccctaccaccagctgccgcacgactggctgctgcgcaacggcaccacatatcccgaagaccgcgagctcggcacccgccgtgcccgtgccgccgcgctgatggagcttggtctgcccggcgccgcctatatttatcagggcgaggagctgggtctgtttgaggtggccgatattccgtgggatcgactggaggatccgaccgctttccacaccgctcaggccacgatggataagggccgtgacggttgccgcgtgcctctgccttggaccgcttccgacgagcccgctctggccgatttcagccgtccggctccggccgacgatggcaccggcgagaaccatgtgccgctgtgcgccgccggccagttcggcacgggcgcttccttcggcttctcccctgcggttcgcgccgatggcgtgacgccggccgccgacccgcacctgccgcagccgctgtggttcaaggattacgcggtggacgtggagcaggccgacccggactcgatgctcgcgctgtatcgcgccgcactggcgattcgccaggagtcgctgaccgccacgcgcgacaccacggccgagcaggtggacatgggcgacgatgtggtggcgtacacccgcgcggcggttggcgggcgggtgttcacctcaatcaccaacttcggcaatgccccggtcgcgctgcccgatggctccgtggtgctggcgtccggcccgctgacccccgaaggccagctccccaccgacacttctgcgtgggttatcaagtagatcccttggaataagcgaaaggccgccgttccgaatgaatcggagcggcggccttttggtatgcactggggaccaccctcaggcgcttacgcgccagcgtactgcaacacggacagcctgaaggctgcgattgccggctcgctgttcgtgcgcacctcacccgaggggagccaaggaagaatcactgaacctgagcgcgggcgatcttaccggtgaaggaattggcctcgtcggcatccttgacgccatccttgttccaggagaacatggcgcgcagcttcgggccgacggtctcgatgcgctcgttggagtacttctcctgcagctccttgaagtgcggggcgccggcatcctggtcgtcaatgaactccttggcgaaggagccgtcctggatgcgctgcaggtggtattccatgcgcttgcggcagtcctcgttgatgacggtgttgacgtagtcgccgtactgagcggtgtcagagcaggaccaacgagccttgttcagaccgccctcgttcatcaggtcgacgagcatcttgagctcgtggcagacctcgaagtaggcgatttccggctggtagccggcgtcggtcagaacttcgaagcccatctcgacgagcttgttcacgccacccatgagcacgttctgctcgccgaagagatcggtctcggtctcttccttgaaggtggtcttgatggcaccggcgcgcagggcaccgagggccttggcgtaggccagggtcagagcccagccgtcgccacgcggatcctgctcgacggccacgacgaccggcacgccacggccagcggcgtactcacgacgaacgatgtggcccgggcccttcggggcaaccatgaacaccgggtgatcctcagacggcttgatgtagccgtagtgaatgttgaagccatgagcgaacgcaacagcagcacccggcttgatgttgggctcgatgtcgttggcccagatggtgcgctggtactggtcgggggccagaatcatgatcacgtcggcctcggcggaagcctcggccacggacttgacctcgaggccctgctccttggcgaagtcgaccgacttggaggtcggacgcaggccgacgaccacgtcgacaccggaatcgcgaaggttcagcgcgtgggcgtggccctgggagccgtagccgatgattgcgaccttcttgccttcgagaacagagagatcaccgtcgttctcataccagatctgtgctgccattattggcactccttttcagtagtgggttgtggcgccgctgggcgccgggggtatctacggtgtgcagataagtcctgttttgcgaggattgtgtccttcaaaccgagttcaatcctaccgagaacgccgtcgcagccccgctggagtccacaacgtgagctaggtcactattggagtatggacagccgtgtgcagagaacgattctcgataacaactctgcacccttttgaacagaatcgcacaatcccacatatggggaaaggctgagatatcaacgaccttgcatattcggtgttcgtttgcctgcaagaaatcagcgcatagttgttattgagaatgattcgctgcgcgcaacaacacaaaaccgccgctcccgtatgggcgggaacggcggtttgctagcttaaatccccttcaggggcgacaatcactgaacctgggtacgagcaatcttgccattgaaggactcggtctcatccttgtccttggcctcggcgttattccaggagaacatggcgcgcagcttcgggccaacggtctcgaggtgcgggtgagagtactcttcctgcagcttcttgaacttcggagcgccggcagcctggtcatccatgaactccttggcaaaggagccatcctgaatgcgcttgagctggtactgcatgcgcttcttggtctcctcggtgatgacggtggaggtgtagtcgccgtactgagcggtgtcggagcaggaccaacgagccttgttcagaccaccctcgttagcgaggtcgacgagcatcttcagctcgtggaacacctcgaagtaggcgatttccggctggtagccagcctcggtcagcacgtcgaagccgaggtcgcacaggtggttgatgccgcccatgaggacgtcctgctcaccgaacagatcggtctcggtctcctcggtgaaggtggtcttgatggcgcctgcacgcagagcgcccagagccttggcgtaagccaggcacagcggccaggtcttgccgtccgggtcctgctcaacagcaacgacgaccgggacaccacggccagcggcgtactcacgacgaacgatgtggcccgggcccttcggggcaaccatgaacaccgggtgatcctcagacggcttgatgtagccgtagtggatgttgaaaccgtgggcgaaggccaaggcagcgcccggcttcagattcggctcaatgtccttcttgtagacggctgcctggtactggtcaggcagaagaatcatcacaacgtcagcctcggcaacggcctcgccaaccggcttgacctcaaggccctgctccttggcgaactccacggacttggaggtcggacgcaggccgacgaccacgtcgacaccggagtcacgcaggttcagcgcgtgggcgtgaccctgagaaccgtagcccaggatggccaccttcttgccatcgaacacggacagatcggcgtccttctcgtaccagatagttgctgccatttttggcgctccttttatttatttgtttatttatggggttgaaattttcttgcgttctgcggggtttcgctgagcgatattctgttgtggctttccttgtgggcttttccgatatgcaggtttagtcccgtcgcatcggaaaagccctgtaggggttcacttagtggaattaggggttttcacgttgtgaacatcgtcacttggtaaagtcaacgtccttagtctccttgcaggtgagcacggagacgaggcagcacacggccatcacggcaaggtagaggcccacggagtggacgccccagtgggagctcagccaagtggcgatggtcggcacgaaagccgcgccgacgatggcggccaggttgtagccgatgccggagccggagtaacgcacgttggcgtcgaacagctcaggcaggaaggcgccgatcgggccgaaggcgatgcccatcagggcaaagccgacgcacaggaacaccatgttggcgaagaagttcttctggccgaccagaccaccgtccagcaggaacgggaagagtacggcgaacaccacaagtgcgcaggaggagaaggtcagcacgcgacggcggccgatcttgtccgcgtacaggcaggacagcacgatgaacagggcgaacacgcagatggagatcatgagcatgagcaggtattcctggttggtgaagccaaggttgccgccgccttcgccctgctccttggtgccccaagcgagggaccaggtggcgagcgtgtagaacagcgtgtaggtcacagccacaaggaaggtggcctgcagcacctgacgccaagacttgcggaagacctcggtcagcggggacttgacaaccttcttctgctcctgagccatacggaagatcggggtctcctccatgtgaacgcggaccacgagaccgacgatcaccaggatggcggacagcaggaacggcacacgccagccccaagccagcatcgcgtcctgattgttgaaggattcgagcacgaagtaggtgccgttggacaggaagaagccgatcggggcgccgagctccgggaaggagccgtacagtgcgcgcttgtcttcaggcgcgttctcggtggcgaccagtgccgcgccggaccattcgccgcccaggccgatgccctggatgaaacgcagcaggcagaggatggcgactgcaccaacgccgacctgatcgtaggtgggcaggcagccaatcaggaaggtgccgacacccatggtcatcaggctgacgaccagcgtggtcttgcggcccatgcgatcgccgaagtggccgaagatcagcgagcccagcgggcgggcgatgaaggcgacggcgaaggtcagcaagctcatcagcagtgcgacggtggggttgtccttcgcggagaagaagatgtgcgggaagtagtttgccgcggcggtgccgtaggcgtagaagtcatagaattcgatggcggtaccgaccatcgacgcggcgatcacggtcttgaccgaatcgcgtaccaaggtagcggctttacctgccgcctgccctaagccagtctcttcgactgctgcagtcattgttactcctgttttgctctcgttcactctcatcggcgggcgattatttcgccccacagggaggttgttgttctgtcgctgtgttgttgccgtgtactgtccgctaccgtttccgtctgcgggattctgccgtaagccttgtgagcgcaacaaaaaaagccccgcatcatgcagggccgtgccgattgtgtcagcttgattggccctgccttcgttgacggggcttcaagcatcagtgccgaattagtccgccagcgaagacgggctaataattcgtgcggatacaaacgcagaagcattgaatccagtcatcgcgtggcctcctttcggtatttcctcaggccgttcgacctgaactggaatgtaaacataggtttgtatgtcttgccaatccagcaagggttcacattgtggacattgtgacgtaggagtcatgtgagatgggtgactgtgggcggccgtgactcggttcccctcagtcgcctacgccgccagctcggccgcaattacagacgggctaccgcccgcagtctgcctgctcgcctcccggctcgccttcgcctacaaacagtccaccggactgtttgcttcacagctcagcctcagagaggggagccaagataggagtcaccgggtggtttcgccggggatgagggctacggggatgacttcttcgggagtgggttgggtgtcaacgtccgaagcgctatcgttcttggacggagaggcggggccaccgtcggcggcgatctgtgagtccatgcggacggcgagcgcggcggcgatggccgggaagtcctgtcgaatcgcggtcaggcgtttgccggcggtttcggccatgagagtgccgtcataggcgatgacttgcagatcagcaggcacctcgataccccgtcgtgaggcttcctgcaatgccacggatgccaccacatcggagccgacgatggcgtcgacatcaggatactgttcgaaaatggcgcatgcggtggcttcgtgggcggcgatgtcggccacggtgccggcttcgacataatcgcaggcaatgccggcctcagccagcagacgctcgacggtgagatggtagcgaatcgtggggaaagtggtgccttccgcgaactgggaacgcgggccaccaacgagcaccacgtggcgcgcgccggaatcgatgagctggcgcgcaatcagacggcctccctgttcatgatcagaccggacgaccggcacaccctcaccgagcgtgcggtcgaaagcgacaattggccgatggatggaggtccagtagtcggccggatgctcggtgtgggccgccatgatgatgccgtccatcatgtgccgctggagcatgtcgatgtactcgctctcgcccttgtctgtatcggcggtggagcagagcagggttttgaggtcgcgcgcggcgaactcgcgctgcagatgcgcggtgagtgtggagaagaacgggtgggcgatggtcggcatgatcacgccgatggtgttggtgcggtttcggtagaggttgcgggccagctcgttgggaatgtagttgagctggcgcatcgcggactcgactttggcacgcatatcggccgagacgtagccggtgttgttgaccaccaacgaaacggtgcttaaggacacccctgccgctttggctacgtcgcgcatgccgaccatggttttgctcccctgcgagtactggactggatcactgctgaccagtgtactcgaaccggtttattattcggcagatttggtggtgagggtgacgattccggccagcagcaccatgacgatggcggacgggaagagcaggtaatagccgaagctatgctcgaaggcgttcaccagtagcgcgccgatgatggcggcgagcgccagaccggccgagttggcgagcgcataaatgccgaggtcgtggccggctcggcgcgggtcgggcaaagagtccatcaccagttcaagtccgagcgaatcatagacgccaaaggcgaatccggaaatcaacgcaaacagcagcatgccgttttcacgggcagtgccggtggaccagacgccaaggccccatgcgagcgccaaaccagcggcatacagcaggcaggcaccggccaccacacgggccacgggaatgttcttttcctcgattcgctcggaaatcggcccggcggcccaggaggcgagcgcggcaccgatcaatgtggccacagccataccggcaatgaggaatccggccggaatggtcagcggcgcggacgtaagtaccacggccttgccataaacccagaaacgtacgagataccacagaaacacaccggtcagcccaacaccggccatcatgcacgtacgggcggcgaacacccgggagaactcgggagcgtgggccggcgggcgcaattggtcaagtacctgactgcggtcaaaaagctggttcggctgctcagcgctagaaggctccttgggcagaatcaatacggtggcaataccggacactgcaaatagcacggcggtgtaactaaacggcgcaaacgaattgaacatcacaccaagcgcacccatgcacacgccaagcgcttggccgagcatcacaccgatgccatgccagcgttcgatgcgagggcggaacttgtcgggcacccgttcgctgatggcgctggtcaacggcacggaaagcatcgcataggcgaactgtaggaacacccagaaaatacaaagcacaatgatgccgatattctgccccagaatcagcgtgatcagcgcgcacagcagacctccgccaaccatccacggggtacgacggcccaatggcgtgcgtgtgcggtcggacaacactgaaatcagcggcatcgcaaacatggaggccactacgccgacaatcaccaacacggccaggggcatcgccaattcggtggcgacgggcaacgggcggccagtggccggattgatggcgatatgaccggcaacagcagtgtcatagccgaacgtacgcgcaatcgcgttgggcatggcaatggtgttcaacgccacccaaggtgcgccgaccagaattgaagcagcgaagaaaccccagttgagtcgggagacctgacctgcggtagggcgttggccattgacggcgaccatgggatcgcgcatgtcgaggtaggcggacgacatatccggcgcgggagtgtccacactggcggctgcagcagcggctgccgaagaaccggcggaagccaatcgcacagcctgggcctcaggctggtccgcagaggcttcgggcgggcggcggcgattcttgatggccagtctggccacggcggctttgtcttcgggacttaggaccttgtccaaatccgggcgatcatcaatacccggacgcacatacggttccaacatgatgctgctctttctctgttctgctgctcgtctcgtcgattccggcgggatgcttgggccgcgcccgcaggagcatgaccttcaaccccgcatacgcaaaaccgcccgggcgcactggcttcagtgcactgcgggcggtttgctctccatgaacccagcttacgccgggcgcactacttggagcgcgcacagcggagtgacgtttatgggccaacggttagtcgatatcggcaatcggcgggttggcgagcagatcgtgggtttcgtggtcgccggcggcatcgctccaggcaaggctggcgaccggggtggcgttgtctgtgccgaggccgcgtccgggctcgaaggtgagggcggccgtggacgcgccgtcggcggcggtccagcggaaggtgatggacgtgtcgccatcgacctcgtagctgaactcgccatcgaatgcagacagctcgttgcggaacttggccagggcgttcagggccttgaccaccgggcgttcgaggttttcatcgatttcggcggtggagtagtagtggcggttgatgtcgcggccgttgttggtgcggcgcagcagttccatgtcgttgcggccggcgagcgcgcccacgtagtagacctgcggcacgcccggcaggaagaactgcacggcgcgggcggccaagtagtgctggtcgttgcagccgagggccgagtagtacgtggagttgacctggtagaggtcgaggttggacgcggcggcaccggtggcggcctgggattcgccgtgggtgttggcatggatggtgttgaccaggttgtcgacgtcctcgtcgggcacgaggcccttgagggagcggtcgagctggtcggagccgatgtcgatcacgccgatgccatcgtgcgtatcgagcacggtgacggcgttgttcgggcggatctcggtccagtgggccacgggttcgacgtgaccggtgaacagcgagtgcagaagcagcggcggcagggcgaaatcgtagacgcggtccaccttggaggcgatctccacctgcttcttgtaatagctgtgaacctcgatgaggatttcaaggccgcgcttgacgccctcctcacgcagacgggagatcagcttgaacgtcttcggagtcatgaagcagctcgtgccagcttccttagcgccgtagccgacggcgtcgaggcggatgtagctgacgtgagaggcggccatctggtcgaaaatcgacatgaggtattcccaacccttgtcggaatcggtgtcaatatcaacctgctgcggggtgaagctcacccagaccaagcgcgtcttgccggcgaacttgtagtgggtgaacggcaggcccggacgcggacggtagatgccggccaggtcctcttcggtggcgccgttcgggaagacggagctcatggtcagaaacatcgggtaatactcggattcctcacctttttcaagcacgtcttggaactgcttggattcccagctcatgtggttgacgatggcgtcgaccatgatgttgtgggtcttggagagttcggcgacgtcgtcccagctgccgagacgttcgtcgactttggtatggtcgatcgggtcgaagcctgcatccgcaccatcgaacggagtgaagaacggcaggatatgcacgccgtcatacacgccgtcgaagcgggtgcgcaggatgtcggtcatcgagctaagagtgccatcgccgagacgatcggcgtatgtgatgagttgcactttgtttttcatgggacctcccttggctcatgggcgcgggtgcaatttgcgtgcgcatctgcctgtttgttgtttacgtatttgcatactcacgtatgtatcgaaccggttcgatattacctcgaaagggacgtcaatgtccagtcgcgcagtgaaatgcgcgtgtcgaaccgattagatgcggtgttctatgcagcttagcctgtccgactccaatgtgtccgattgataaggggctgcggacattttcttggagataatcacgcagccattccttggctttgacggtattgtaccgggctcatccaaccaagcgactgtttgatgcgctcgtggttgtaccagcgtatgtactcatcgaccaaggcgagcacctcgttgcgggtgtgttcctcccacttctcggggtagaccgcctcggtcttcatcctgccgaagaatccctccgcggccgcgttgtccggcgaacagcccttcgcgctcatcgaacgcgtcaggttgttgtccatgcagatgcggatccattccggccaccggtagtggcagccgcggtcggaattaaaccgacatcggtttaactccgattaagccgggtttgttgttaagccggggaacggttcggggtcttggtggctggccgtgtcccatgtggtttcccggcttaacgttccgggttatttgagggtgtgtagttgtcggagtcgttgctcgctgagccatgtctccttggaggggtcggggccggggttggccgcatcgacggctttgcgcatcatgtcgagggtcgcgaacgcgtagaacgcgctggttgtgctcatgctttcgtggccgagcagttgcatgatgagcggtagcggcacgccctgttggtagaggtccatggcgcgggtccggcggatcaggtggcagtggacgcgttcgggcatggacgggcacgtcccgcggcgtgctctggccgccgcggttttgaggatctcgtcgatccggtccacggagagcggctggatggcgccgttcctcgtcgagtggaacaacggcctgtcgccgtcgcgcatggacggtccgggatggaattcctcgaggtaggcggccaggtgggttcgtgtcctttctcccaggggcacgacccggctcttgccgcgtttgccggtgagcgtgaccctggccggcttatccatacccacgtccgcgatggtcagtgcggcgagttcgccgatcctggcggcggtgtcgtacatgaggatcaggagcatgcggttcctgcgcgatttggcgtcgccggtgccccatgcggtcagcaacgctttggtgtgctcctccccgaggtggtcgacgggtttgcgcgcgggtggtttgacacgtatgccggccgcgtcgttgcccagcgcggtcaatgccgggtgttcgaggcccgcgtggtcgaggaacacgcgcatcgtcgtcatcctcagcatgatggtgcggtccgagtacccgcgctcggtccgcatccattcgacccaccggcccaggcgcgcccggtcgaaatgcccgaaaccgatgtggctgcgctgcgtgccttccgtggtttcgagccatcggacgtaggattccaggccgatgcggtacgcctcgacggtcttcggcgagctgccccgcaccttgggcagccagtggtgcagccagtcgcgcgcgactcgccagaagtccggttcaccggagctggcggccgttttccttgccttgctcatggttcctccgtttccgggaccacgcgttcggcgtcggcgacgaggtccgcgtatccgtccatgaaatcggggctggcgtgcacgtagtagagggtgctgtcgatgccggcgtgtcccatgtaggccgccagatagggcagcatcgccatcacgtccacgccgtcgcgagtccaccgctcgatgttcgcgaacgcgaaccggtgccggaaatcatagggcctgggccgtttgccggcttgtggccactcgagcccggcacgcgtccagacgcggcggaacaccacgccgggcatgcccggggagaccggattgccggtggaggcgacgaagaacgcgggacggtcgtctccgaagcgttcgcgggaccgttggtcgcattccagcagttcggcggcgacctcgtcgcccacgggcagcctgcggctgcgaccggccttggaatcgaccacgtcgatggaacgggccttgtggtcgacgtgcccgacggcgagtctcctgacctctcgggtgcgcagcccgcagcaggccatgagcatgaagaacgcgcgagactgccacgcccacggcgacggagactccaacgttcccgcggcccgcaggaacagggcggcctcgcggtccgtcagcaggtacggcgtcggacgcggggatccggccttccactggtcggagagcacgtacgcgtcgggatcgtgggccagtcgcatccacctgccgaagtccctgatgcacgagaaccacgagcggcaacccccgggattcgcgtcgatcctatgggcgatccatcgctccacgacgccccgctccagacgcacggccccgtgttcgaggcaatgccggtcgaacgagcgcaggacc

SEQ ID NO: 27 - DNA, 77399 bp, Bifidobacterium longum
ggttcatgaaaccaagcgagaagatcatcgaactgctcgacgccgcgtgataacctcaacaaccgacaacgtgaccatggaaggccgctcaaaccccaggtgttgcaaccaccactagaatctgccgctgccacacgctggcagaccaacaccactgtgtgcattctctgcgtcggcggcagtccaaaacttggcccagcaacgacgcttgctgtgcccagcgtcggcagagggccaagaattggacgcatacgacacagaacgcaccctcagcgtcggcagaactccaagatctgtaccgctgacgacggtaagccctccacagcgtcgtcagagatacaaaatctgtcccaacaccgacgcctgccacccccagcgtcgccggagtcccaagtctcggcccagcaacgacgcctgcgatccccacacataagaaaccgcacctccgatcatcgaatctgaattacttcagtccaacaaccggggtgcggttcactgaggagagttccgtcagtatagctatatcagtcgtcgccgagcgtaacgtgcacaccgccgaccagagagctgaccacgttgtagatcagtgccgcaatggtggccagcagagtgaagatcaccacttcgacaatcgagaagatggtgacgccggagaccacggtggtaagggacaacacgttcttgagatcgaaaccgcctgcatcaagaccggtggaagacacaatctgcgtaatctggctgaatacaccgaccacatcaagcagcacccatacgatcgcggaggcaacgacctgaataatcgccacggcgatggacagcatgaacgtcaccttggccacggaccaagcatccacgcgggtcagcgacaagctcatgcggcgagccctgggggcgctacggcgaggtgccggacgcacgggagtggcggcacctgaagaaggcaacgcggattcttccggatcgctggacacggagcgtgccacgcggggagcgtgctcagtaccgatcagcggctcgacatgctcgttctgcgtattgccgactgccggcggtatgatccggggctcgttgtcttcgagattctcgctcatcgtttctccttaacaggcttggcggtagcctctgctgtatgcgaggctaccagcttttcaggacgctgctcacgcctcgtccgcgttgttcacattctcgccggattgtgcggtctcggcggtgccgttcgccgcggcatcgccgccatcctcgggctcgtccttctcctcgttacgggcgatggagagaatcgtgtcgcccttgtcgggcttggcaaaggtcacgccctgggtgttgcgcccggtgcgcttgacttcgtccacgttggagcgaatcaccttgccggacttcatgatggccataacctgatcgtcttcggacaccacgagcgcgccgaccagagcaccacggccctcgaccagttgcacggccttgatacccaggccattgcggccctgcagacggtattcgctgatggcggtgcgcttggcgaagccctcgttggtgaccacgaacaggtccttgtcggagtcgccagggaccacatccatggccagcaggctgtcgtcgttacggaacttcatgccctgcacgccggcggtctggcggcccatcgggcgcagctgctcgtcgtcggcctggaacttgaggctcatgccgagtttggagaccaggatgatgtcgtcctcggcgttgcacagcgcggcgccgatgagctcgtcggcgttctcgccgttctcgtcggccatgaggcgcacggcgatcaggccgccctggcgcggggaatcgtactcggccagcggggtcttcttgaccttgccggaacgggtggcgagcaccagatacttggacacctcgtagttcgggatggacagcacggtctggatggactcatcaggcgcgaactgcagcaggttggccacgtgctggcccttggagtcgcgcgagccctcgggcagctcgtaggccttgatgcggtacacgcggcccttgttcgtgaagaacagcagccagttgtgcgtggaggtcaggaagaagtgatccaccacgtcgtcctcgcgcagcttggtgcccttgatgcccttgccgccgcggtgctgggagcggtattcgtcggccttggtgcgcttaatgaagccggagtgggtcacggtgaccaccacgttctcttcggcgatcaggtcttcgacgttcatctcgccggagaacggcaggatcttggtgcggcggtcgtcgccgtacttggcgacgatctcgtcgagctcgtcgccgatgatcttgcgctggcgttccggcttggcgaggatgtcgatgtagtcggcgatcttacgctgcaattcctcatgctcggccacgatcttgtcgcggttcatgcgggtcagcgtgcgcagctgcatggccaggatggcgtccgcctgcacctggtcgatgtccagcagccccataaggcccgtacgtgcggtgtcggtgtcttcggaggcacggatgagggcgatgacctcgtccagcatgtcgagggccttcagatagccctgcaggatgtggtcgcgctcttcggcctcgcgcttcaggtacgcggtgcggcgggcgatcacgtcgagctggtggttcacccaatggcggatgaaggcgtccaggctcagcgtgcgcggcacgccgtcgaccagcgccagcatgttggcgccgaaggtctgctgcagctgggagtgcttgtacaggttgttcaggaccaccttcggcacggcgtcgcgcttgagcacgagcacgaggcgctggccggtacggccggaggtctcgtcgcgcatgtcggcgatgccctggatcttgccgtcgcgcacggcctcacgaatggagacgacgaggcggtccgggttgacctggtagggcagttcggtgaccaccaggcacatacggccgttgatctcctcagtgttgaccacggcacgcatggtgatcaggccacggccggtgcggtaggcctgttcgatgcccttgtggccgaggatggtggcgccggtggggaagtccggtcccttgatgatgcggatcaggttttccagcagttcctcgcggctggcgtccgggtggtcgagcgcccagtggacgccgtccgccacctcgcgcatgttgtgcggcgggatgttggtggccatgccgacggcgatgccggcggagccgttgacgagcaggttcgggaagcgggccggcagcacggtcggctcctgggtcttgccgtcgtagttgggcacgaagtcgacggtgtccttgtcgatgtcgcgcaccatttccatggccagcggggccatacggcattcggtgtaacgcatggcggcggccgggtcgtcgccgggggagccgaagttgccctggccgtcgacgagcatgttgcgcatcgaccaggactgggccatacgcaccaaagtgtcgtagatggcggagtcgccgtgcgggtggtacttacccatcacgtcgccgaccacgcgggagcacttgttgtagccgcgatcggggcggtagccgccgtcgtacatcgcgtagatcacgcggcgatgcacgggcttcataccgtcgcgcacgtccggcagggcgcgctcgacgatcacggagagggcatacgccagataggactcgcgcatctcctgctgcaggtccttgcgctggatgcgttcgccggtgtccatcaggccgtagtcggtagtgtccgcctcctgcgggctcaacggctccatcgagccgtccggcgtgaactgctcgtcgccggtgttgttttcatctgccactgttgttcctttagttgtctaagtccgttgtgtacctccctctgacgagggaggttggaggattccgttacgcatcgatccaacgcacgttcttggcgttgcgctggatgaagaggcggcggggttcgacctcatcgcccatcagcatcgagaaggtctcgtcggccgcggcggcgtcctcgatgtgcacctgcttcagaatgcggtgctcggggtccatggtggtctcccatagctcctggtagctcatctcgcccagacccttgtagcgctggatgccttcgcccttgggcagctggcgtccgttggccttgccttcggcgagcacgcggtcgcgctcggcgtcggtgtacacgaagtcgtgcgggcccttggtccacttcaggcggtacagcggcggcatggccacgtacacgtagccggcggtgatcatcgggcgcatgtagcggaagaacagcgtcaggttcagggtggcgatatgcgcaccatccacatcggcatcggccatgatgatgaccttgtggtagcggaccttggagatgtcgaagtcctcgccgtagccgccgccgaccgcggtgatcagcgattcgatggtgtcggacttcatcatgcggtccaggctggcgcgctcggtgttgaggatcttgcctcgcagcggcaggatggcctgcgtgatcgggttgcggccctggatggcggagccgcctgcggaatcaccctccacgatgaacagctcgcactcttccgggttgttcgactgacagtccttgagcttgtcgggcatgccggcggactcgaagatggacttgcggcgggtgttctcgcgggccttcttggcggccagacgggcgcgggaggcctcaatggccttctggatgatgttcttggcctcggccgggtgggcgtcgaaccagtcgccgagcttgtcggtcatcacgcgctgcacgaaggtcttggcttcggagttgccgagcttggtcttggtctggccttcgaactgcgggttggtgagcttgacggagatcacggcggtcaggccttcacgcacgtcgtcgccggagaggttctcgtccttgtccttgaggatgcccttgtctcgcgcgtaacggttgaccagcgaagtcagcgcggcgcggaagccctcctcgtgggtaccgccctcggtggtggagatcgtgttcgcgaaggtgtgcacggcctcggagtaggcagtggtccactgcatggcgagttcggcggagatgccgagcttcaggtcttcggcctcgaagctgatgacgtcctcttccaccggcgtggccttgcgcaccttgaccagatagtcgacgtagtccttgatgccgttgaggtactggtaggtgacggtctggtgctttgcgccgggctcgtccgcggcgtcgccggccacctcgtcgccggcctggtcgttctcacgctcgtcagtcaggctgatcttgaggcccttgttcaggaaggccatctgctggaagcgggaacgcagcgtctcgaagtcgtagatggtggtctcgaaaatcttcgggtcggcccagaaagtcacagacgtaccggtggactcgccttcggtcatcggctcgccctgcttcaagggcgcggtggggtgctggtcgatgtacgtctgggtccagtggaagccctgacggcgcacttcgatgtccacgcgggtggagagtgcgttgaccacggagatgcccacgccgtgcagaccgccggacactgcataaccgccgccgccgaacttgccgccggcgtgcagcttggtcatcacggtctccacaccagagacgccctcgccgggcacctcatcgaccgggatacctcgaccatcgtccaccacacggatgccgttgtccggcagaatggtgatctcgatatggctggcgtatccggccagcgcctcgtcgaccgagttgtcgacgatctcatagaccaggtggtgcaaaccgcgcgggccggtggaaccgatgtacataccggggcggatacgcacggcctcaagtccttcgagcaccctcagatcggaggcctcataatgctcgggggccatggattcgtcaagttcgccttcggtcaattccgcattgttgatgcgttccgcagccgccttcagctgctcctctttgctggtttcgtctgccaacaggcttccttccgtgactacagggtcaacctccgtcatgaaggtcattcacggaggtgatatggcttacgaggcccgtaaagggctcttctagccatttgaccatactgcatgtgattttactcgtctaacccgacgagcgccatagcgaggcttctgcgaatttgtttggtatcttggctaccgccgccgagcccatttgcgtgtgtatccggcggccgggccggtcacgcgaatctcggtgatggtcaatcctttgagattgcgacggatggtatcggtgagttgggggataaggtaggtcagctgcgtggcccagaccgtggattcggcgcggatggtcagtacgccgtcagtgaaatcggcgactgccgaatggctggcgatggcctgacccaccacttggtcccaatggttgcgcaattgcgcaagcttcatattcgccgtccagacgccgttgccggcgatggtggtcatcacgctgcccagttcagccggatcgcgccccggtttgccgaagttttcgatggcctcttcacggcggcgtctgtagtccttcaaggtcgccccgcgacgggagagccgctcgaatatttcggccggcagtttggtctcgtccaggttgagttggcgggcgatcggcgggttcatgacactttccgttctacggacgcgctgtccaccgcggttttttcgtcatacccacccaaactctcattttcccgcgaattggacaaattgcccagagttggcaatatcacggaagctggttcgtccagtgcggccacgtcgatgcgatgggccgattcatagtcgggcacatcgccttcagcggccacggtaatcagcacctgatcctgttttctggcgaaatcaagaatctgcgtgcgccggctgtcgtcaagctgggcgaacacatcatcgagaatcacaatcggctgcaatcccaaccggtcacgcactatttcgaacaatgccattttcaaggccaacgccatcgtccacatctcgccgttcgaagcgaactcgcgggcgggaataccgcccaactcaaggttcatgtcatcgcgctgcggaccgataaggttcacgccgcgagccacttcaccggggtagatgcgttggaaatgctcgctaatctgcggatgcggatcgtcgaacatcagcacttcgtcgaatgaaggcgcataagtgagcgtcacctgctcgccggcaccggccaagtcggcgtaaatcgcggcaaatggctcggcaagcagaccgatcacatgagcgcgcatacgggtcaacgccacaccggcttcgatgaactggccggtccagatttccaaaccgctcagaaccgcatccatcggctggccattgttgacattggcattcaattgcttcaacaatgtggcacgctgtttggcgatgcgcgtgaactgttgcaacgtctgcatgtatccgggctcgagcagagccgcagcctgattcatcatggtgcggcgtgctcccggatcgccggacaccaaccgctgatcttcgggagtgaaggaaacgctgggaatcttgccgatgatatcgcgcagatacagcgacgaccccgagttgatgcgggctcggttggcaccacgcgcatgaattgacgcttcatacgtagtggtttgaccggcatcatcagcgacgttcgcgcggatggtggccgtggtctgcccgcgttcgatcagcggcaacgtgctggacgtgcgatggctcgatccggtggacagcacttcgacggcttccaccagattggttttgcccagaccgttcttgccgaacaggatattcacgcctggtacgaaatcgaccactacctgactccatgagcggtagtggtcgagtgcgagacgggagatgtgcattagcgaatcgttggaaattcagggatttcagttgttaaagcgcatcggcacgagcaggtatcggtagtccatggactcgtcggaatcagcttcctgctggccattgaactcgaccggcttgaccggggtcgtcattttgatgcgcacgaatggttcggttacggcggacagaccctccttcaggtaggacgggttgaatgccacggtgatgtcgtcgccatccatgtcgatgtccagtgtttcgttggcctgagcctcgtcgaccgatccggcggacagcgccacttcctgaccggtgaaggtcatgcgaatcggagcattgcgttcggcgaccaaagccacacggctgatggcgtcgagcaaatcctgcttgttgactacggcctgaatcggatattcgtcggcgaacaggcggtcgaccgccgggaattcaccgtcgatgagctgggaggtggagacgcggccggcgttttcgaagccgagcagcgtcgggctatcggcatcgaaatcaaggcggatgttctggtgctcgtcaagagcacgggccacatccttgagcagggagccgcgaaccagcgtggtggtgtcgacgtccgggttctgcggagtccaagtgaaggtggcgcgggccaaacggaagcgatcggtggaggtcatgacgaccttgtcgccttggaattgcatgcgaacgccggtcagtaccgggcggttttcttcgcgggagacggcaacgcacgcctggttcacggcctgaacgaaagtcggggcatcgacttggccgagcatggccggtaccacgggcagatccgggtactcggtgtcgggcatgagctgcaaggtgaacttcgacttgccggacgtgatggtcagcgtggagccgtcggtgaccaggtacgttttctccgaacgcagcgatttggtgatatcggccagcagcttgccctgaaccagtacggaaccggcttcgtcaacgccggcttcgatgtggtggcgagcggaaatctcgtagttgaaggcggagaattgcagcgttccgtcaatggcttccagcttgacgccagcgagaatcgggttggagggacgtgcgtcgatgactcgggaggtccaggctacggcgtcggccagggctgcggtatcgatttcgactttcatgtgtgattgttcccttcgtcggattggctgaggaatattctagccgttaggtggcgaacttacgtacgctggatgaccggctgttactatggcgatgatgcttttcacgtaactgagtaagtaatcgccataataaggccggtggatagtgtggataagtagggctgagccctacaactgcaacggttcataagtccctgaaaattgtggacaaattctgcatggcttgtggataagtgggcgagttttccacagccagttcgtcgaatttgagttttccacatcgaggtcgcggttatgcacgagttttccacaacaaaatagtgggtaatccacgagttatccgccgagtttacccacatctgtgcacaactatgtggataacttttttggttttcgcactttcgcacggcgtgttgaagactgtttttcgtcgaggagaatcgattctggagaccgttttcggcacttttccgtctcgctcgcccaaacccgcaaaatcggtcctcagaatcgattctctcgtttcatggtttttttgcgtgttccccttcgaaactcccctcagtcgtctgcgccgacagatcccctcacaaaggggagccatgaggaatctaatgtctcgaatccgttgcctcgacgtatccaccagaatccgcctgagcaaccaaaaacggcacttttcggaaagtcagtccaaaaagtgccgtttttcgtctctcagaagcgttgtgtcagttggtgttgctttgcttgaggcgaaccgtgagctccataacgtagttatagatctcctgtttttgctgcattcggtcactgattcgagtgcaggcatgcattactgtggtgtgatcgcgtccgccaaagacctggccaatatccatcaggctcatactggtcatttcgcgagccagatacatggcgatctgacgaggaacagccacgtttttggttcgtgatttaccgacaagatcctcaaacgtcaggtggaagtacttcgccacctgactgatgatgtccgtgggcttgatttccacatcggtggtgaagaagtcctgcaacgtctgctcggccaaggcgcgggtcaccggctgattactcagcgaggccacggccgtaacacgggttagcgcgccttcgagttcacgaatgttctcggtgaagcgttcggcgatgaggtccaacacatcgctggggattttcgagccgttcatcgaggcgatcatgcgaagaatggcgattcgggtctccagatccggcggcttgacgtctacggtcaggccggattcgaagcgcgagatgagtcgagcctcgaaacccttcaaattcttgggcgctacatcggaagcaatgacaatacgcttatttgcctgatgcagtgcattgaacgtatggaagaactgatccaaggtggcttccttgccgccgaggaactggatatcgtcaataagcaacacatcaacctgtcggtatcgacggttgaattcagcaatctgcccctggctttggttcgggttttgcagcgcgtcaatgaattcgttcgtgaattcctcagacgtgacgtatcgaaccttcagcccgggatccttgaccagtgcatagttgccgatggcgttcagcaagtgggttttgcccaggcccgatccgccatagatacacaacgggttgaaatcctgcccggaaccttcggccacggccagtgcgaccgtacgggcaaaacggttggaatcgccgggcacgaaggaatcaaacgtgaagttcttattgagatgagtctcgggatcgcgattcatcttctgctgaccgaccgggaactgcggctcggtggcgggcatcggttcccgcggtgcggctgccggctttgcaccataggattctttaccgaattcggcgacagtcggagaaatttccgaaggatatggctgcgccggctttgcctccgaaagcggttcgggctcggttttcggcacgaccttgaacgcgggaaacatattttcgccggttaccgtacgcaatgcctgaagcagggaatcgttcaaatcaccctgaatggcttgaagcgtgtcgttgttgtccacacacagcacgatggtcgaaccgaagacgccttcaggaacaacgccttccaaccagcctttttctcgtgggctgagcgaagcgctgtgtttgagcaccgtcagcgtgtctgaccagatgtgggcggcctcgattacggggtcgccggaagcgttaaccatggtggccccttctgtcgctgtggcgaaatacgtacaacagataatatttactctggtttagacaagttatccaccgtgtcgcgtgttgaaataactggattgtgaataacaaacatgtaatttgtggataacttttggccgtgaatggttggtattccgccgattataagagatttggggcgtgtctcgcaacgtgtcgaaatgtgaaaatactccgtccgttttgacttgagggtaggggtgagagtactttggtatagcttgactcacgtgagggcagcgcgaagcgttgccgaatagacctaggagcaatggattatgaagaggacgttccagccgaacaaccgtcgtcgccacatgaagcacggcttccgcctgcgcatgcgcacccgttctggccgtgcggtgattaaccgtcgccgtgccaagggccgcaagtccctctccgcctgatcattccgatcagtgccacaggcatagtcgaggtggagaggcttcaaagccatcgtgatttcgtcaccgtgctgaaacgccggcgcaaagcaggtggcaaggatatcgtcgtacactatttggtgcccgacgaccatcatgatgatgacgaccggacggtgcatcgccgtttgggattagctgtctccaaatcggtaggacatgcggtcacccgtaatacggtgaagcgtaggtttcgtgtattggccagagcccatgaggatctgctgcccgcgcattgcgatatcgttttgcgcgccaagcccagtgcagcgaccgcatcgttcgcttcgctagatcagcagatcgcgaaggcttttgccacggtggcgcataaggtggctgaggcatgacagcttctttcaaggcggtgatgattggtggggtgcgctggtatcaacagcacatctcggcaaacacaccgccttgttgcaagtattatccaacgtgctcgaattatgccattgaggcattggaacggtatggcgcgttcaaagggggagtgctcgccgtgctgagattactgcgttgccggccgtggagtcgtgggggaatcgacgatgttccacaacggtattccgttttttacaggttttcgtggtcgaaggctcatgaagagcctcgactgacaccattggccacaacccaaagagaggcccaacgatgaactcaaatgaatttctgcttgatagcgggttttggggatttctatataaaatcctgactcccgttgagtggttgcagacctggatcatgaagatcgtgcatgacttcttcgtgatgctgggcgtgagcccgattggtgtctcatgggtgcttgccattatcatcctggtgctggtggtgcaggcttgtatcttcccgctgttctacaagcagatgaagtcgatgcgcaagatgcaggcattggcgccgaagatgcagcgtattcagaacaagtacaaaggtaagacggatcaggcttccagggaggccatgagccgtgaaaccatgaaactgtatcaagacaatgacgtcaatccggctggctcctgcttgcctatgctcattcagggcccggtgttcatgtccatgttctacacgctgtccgccattccatacattgccaacggtaaacgcgatgcgttgggcgcgttcgacgtagcaaccgccaagcaattcacccaaaccgatgtgttcggcattgtcagcgtgaccgataacttcaccagtgctgccgctagtggcaaggcggtcatcggtatcttcgtgttcctgatgtgtttctgcctgtggtttatgcagtacttcagcatgaagcgcaacatggcagctgcttcgatgaacaagcagaccgagaccatgcagaaggctatgctgtggctcttcccggtgatgtacatcttctccggtgtcgccatgccgttcgccgtgctggtctactggctgaccaacaacgtgtgcaacctctgccgcacattgtggcaggtgtacgcattcccgacccctggctctccggctgcggcggacaaggagaagcgcgatcatcgtaatgagaatgctcgccgcgcaaaggccggcctgccctctctggaagaagaagcattggccaaggccaaggaagaggccgagcgtaaggccactcagggctatcagcgtcaacagcccgtgcgtaagcgcaaaaagaagtgacgactatgtcggtgcgagttcgatgtttcacgtgaaacattcaacacgcaccgacattactttctctgttcgggggagcagggcttagacttggaattcaaacacgacatgaaggagtagcgtatggcacaggatgacgtgaagtcgatcgaccagctcaacgaagaggctgacatcgccgcggattaccttgaaggcctactggatatcgccgactatgagggcgacattgagatgggcgtgcgtaatgaccgccccaccgtgcaaatcgttgctgatgacgatactgacatcaaacatcttattggccgtaatggtgaagtcgttgatgctctgcagcaattgactcgtctggctgtacagcagaagaccggcgagcgttctcatctgattgtggatgtcgacggtttcctgaagcgcaagcgtcagcacctccgtgatatcgccttggatgccattgacgcagtgaaggattccggcgagccgtatgacttgaagccgatgaattccttcgaacgtaaagtcgttcacgatgtggttcgggaagaggggctgaagtctcgctcgcacggtgaggagcctcatcgttacgtgacggtgtatctcaagaatagagtcgaggataccgccgaagacgacgagcttgatcaggagtaattgctcggcgagtttttttgagatgacagggacgttcgacggatgtcgtctttgaacaaactaaagtgaccgcatggagaatggcgtcgtaatgagcggcgccattctccatgttgattgtttcacgtgaaacatggtgagggagatggctatgacggatcagctgcaggggtcacctgtacttgctgaggtcttgggtgatgcgttgccgaagttggagcgtttccatgccaagattgccgaagagggtgaacctcgtggattgatcggcccccgtgacgtcgatatcatttgggaacggcatattctgaattccgctgcgattgtgccgtacgttcggaatgcgacgaatggtattcgcttcaaaacagttgccgacgtcggcagtggtggtggttttcctggattggtggctgccgcgtgtttgccggatcatgacttcacgctgattgaaccgatggagcggcgaatcgaatggttgcatgaatgtgttggcctgatgcaactgcagaacgttgagattattcgtggacgctccgatgccgtcatccagcaggtacggaagcgggaaattcatccgttcgctgttgtcacgtgtcgtgcggttgctcctatgaccaaactctctggctggacgttgccgttgctgaaaccgtcaggacagttgatcgcactgaagggacggtctgctcaggctgaaatcgacaaggctggcaaggagattgcaaaattcggtggtcgtcgtccacgcgtcgttgaggcggctgtcggaccggatcttgagcctacccacgtggtgattgtggataagcgatgagtggagtactgattgagttatccacatttccatatgtgcgtaaaagttatccacatttttacgggacgatgtgcagaatgatgaaaacactgatttttcaatgtttttcgtctgcgaatacataatctaacactcaacgtcattcacacttatccacacttatccacattgcatatcgcaattgtggataacgagcatcatgtccatacgaatgagaacactggaacttacgtctgtgcaaggaggagcgatgtccaccaaggatcatcagtcggaacctatagaatcggcttccgaaacgcttcagcgaatattcgatggtcacggttcagtgcttggcagccagatggctgatgaaagctcacgctacgatgtactcaagaaaaccgatttccccaaacctcaacgtacccgtcgtattgccgtggccaaccagaaggggggagtgggtaaaaccacatccacggtaaacaccgctgcggcgctggcgaacaagggcgcgcaggtgttggtcatcgatatggacccgcagggcaatgcctctacggcgttgggtgtatctcatgcatcgggagagccctcggtctatgacgttatcgaggggcgttccgatctgggtgatgttatcacggtctgtcctgattttcccacacttgatgttgtgcctgcatcaatcgatctcagcggtgccgagttggaagtggctgatctgcccaaccgaaacacattgttgaaggaggccttggacctctacctgcgtcaatcagataaacactatgattacgtgttcattgattgcccgcccagcttgggcctcttggtcatcaacgccatgtgtgcagtgaccgagatgctgattcctatccaggctgagtattacgcattggagggtcttggccagctgattaacacgattggtttggtgcaagagcatttcaatcccgtactgctggtgtccaccatgctcgtcacgatgttcgatcgccgaacgttattgagccgtgaagtatataacgaggttaagggacactatcccagcattgtgctgaataccaccatcccgcgttcagtcaagatctccgaagcgccgagtttctcccaatcggtgattgcctatgatcctcgtggcataggtgccatatcgtatggtgaagcagctttggaaatcgcacagcgttcgcaacaagtccttgacaccattgatgcgaggaggaacaagtaatggcatcaaaatcacgacttggtaagggccttggcgctttgttccccacattgccaggggaggagccggtggcggagcagcccgcaatgattgcggaggattcgtctactccggaggccactgctgacataacccccgccaagaaggctactgcccagcaggaatcaaaacctgccgtgcctcagacgatatcgtccagcaaggcagtcaagaaagccgccggtaaacgcgcatccatgcccgcattggacaccattactcatcctagcgacctgtttttcggtacggagaaacctcaaaccggtaaggtcgccgcacctcagcagggcggcaagtcgtctgcgtctcagacggcacatcgtacatccgtcactgtcaaagatgtttcacgtgaaacatctttgactgcatcggcggcaaagaccgctgacacagataagaaggacgagctcaagccggtagccggtggttatctggctgaactcaaactgtctgatatcgggcccaatgcacatcagcctcgtaccatcttcgacgaggatgagttgaatgagctgtctgcttccattaaggaagttggtgtgctgcaaccgatagtcgtgcgcaagcgtccggcaagccagattgctgcggccaaagccgccaagcacgacgagacggaatccagcacgaatccgtttgccggtcatttggacagcccgtatgagctcattatgggtgaacgccgttggcgtgcttctcagttggctgggttggagacgattcccgccatcgtcaaaaccactgcggatgatgatatgctccgcgatgcattgctggaaaacttgcaccgtgtggccttgaatccgctggaagaggcggctgcctaccagcagatgattgaagagttcgggttgacacaagtacaactgtccaagtcggtgtccaagtctcgcccgcaaatcgccaataccttgcgactgctgaacctgccggcctctgtgcaaaagagagtggctgccggtgtgctatcgtccggtcatgcgcgtgcgctattgggcctgagcgatccggaggaaatggacaagctggcttctcgtattattgcggaaggtctttctgtacgcagcaccgaagaaatcgtcgccatgaagattgcgtcgggggagcagccgaagaagcctaagacgtctaagaccaatccttgggttggttccgccatccagcagagtttggaaaatcatttcgataccaaggtgtcgattaagggcagcaccaagcatggtcgcatcgaaatcgtcttttcgtcaccagaggatatggatcgcatcctgcagctgctggtgccgagccaaggcgatgccgattccaaatgggtgtaacacgataagaacattcgtgttgtcgccggcattattgctgtgcagtgcgttgtatgcgcaagacgttatagcctctgcgtgattcctggcaggggcgtatgcccgcgctgtagcccctgtcgcaatagaaaacccctcaggctggagggacaatcacacatcgtgattctccgtcgcctgaggggtctttctatgcctttgaccgatacgtactatccaagggcggcatgctgtaacactgacctagcgttgctcctatgtcacaggcagcagccagaacagcaagccaccatcagtccgccaccatcagtccgtaagataggcctgcgtatccagcgctgcacggcagcccatgcccgctgcgctgatcgcttgacgataagtacgatccacgcaatcgcctgcagcaaagatgcctggcgcactggtcaccgtgctggcaccctgcaccacgacatatccatcatcgtcacggtccacaacaccggccgcaaaatcagtggctggcgtatgaccgatagccacgaatacggcgttggtgtccagcgtgctttcttctccggtcaccacattacgtacggcgatgctgctgacactggccggtgctacagccggtcgtttgagcgtcaagccaggaatggcaataggtgcaccggtgttctgtgtgggggaggaggtgccggtaatggaggtcaccactgtgttggtcatcagagtgatggtcggattggctttggctcggtccaccatgatctgcgaggcgcggaagctatcgcgtcggtgaatcaaggtgaccgaagaaccgaaccgggtcaggaataatgcctcttcaaaagccgaatcgccaccgcctacgaccacgataggcttgttcctgaagaagaagccatcgcaggtggcgcagtacgagacgccatgtccggacagctcctgttcaccgggcaccccaagcttacggaatgacgaccctgtggcgatgataagcgacgatgcctccaattgggagtcatcggagagtgttacacgataggtcggcttgaccgaatcactctcacacgcctcgatggaagagacatcgtctgcgatataggttgtaccgaagcgcttggcctgttccttcatgcgatccataagatccgggccaagaataccttccgggaatccggggaagttctccacctcagtggtgttgaccaactgtccacctggcgacaacgcaccagtgaccataacaggattgagacctgcgcggccaagatagatggcggccgtgtagccagcgggaccagaaccgataatgatgacgttatgtttcacgtgaaacattgtcacacccccatacgatattccgtgtcattcagccagatgcgaagaaggggcggtaccgtcgaatgtatgcgaacggtaccgccccttcttgggtcagttatcggcatagatgccgattagaagacctccaccttttcgatgtacagctggttctgcggcaggctatccgatggcacccacagcagcagatcctgcgtcttgacggctttggtgaacttcacctcagtagtgccaccttcagcaaaggtgaattcggccacctgcttgccttgagtggggtccccagtggtatttgcgcgaatatagcccttaccaccggatgtgcggatggtgataaccatgcggtacgcatcctgcggctggtcaaggtgcatgtagtatgcgtacccggattggccgccaggattcgacaggaagttggcgctggaaatcgtaaacgccgtgttgttctcatggctcggttgcggaacagcgctggaatccttatcgccggacttcttggccttggtcttcttggacgacgaatcagcagtctcggacttcttggacttgtctgatgccgagtccttggattcgctctgagtggcatcactcgattttgaagaatcgtcagtggtgccaccgttcgtcgcgttctcgctgccaccaaatggcacagcgtcagcattgatatcaggccagtcaccttcactggagttgctggaagcatcggcaggattgtctccggaggatcggaacgcatgcactgcccaaacagccgctgccactaccaatatcagagccacaatgatggcaacgaccttggtcgacagtttgccgaacagatgttcatcgggcagcttgctgtcaacctcgtcatccggcacatccttcggtgtgaagctcggaggaatggcgcttacttcggcaatgcgggcctgctcctcttccaaggcacgcagtgattcctcaccgggagccacagcacggccgctggcgtcgaacacgggaatacgactggttgtctctcccgcggtggcatcggaaataccgccggtaacaataggcactgtcaaccgagtattatcacccggaccgccgataggggccggattcatttcgctgtaccagtcaccggtgccttcaccggaaagattttcgtgctcccaggcgtcagaaaggttgaagtcaaacagacggcgggcatcagactgagactggttgccgttagcagtactggacccatcaggcagaggaaccggtgacatcgcgtgcggagcggggacggcggccggctgaaccggcagggaaggggtaatagacaattccggaagactgttgctgttaatcaacgtgctgggaataggcacgatatcagtctcgttggcaggcttcagtatcgccttggtaatcgagcaatcgctttccacgctcggcaaagcaatatcagcatcgctcagttcagagagcggcttccaattacccaacaaggcgtcgagttctacaagggctgccattggcaacgtatgctcgtcgggctcgctcaaggccaatccacgcttgcaaatcacgcggaattcgccaggggtgtcttgcggcaaggcacgcagattgaatgtgggtgtcgcttggcttggcgtgcgtgtcagcagggtatagagtaatgccgcaagctggcgaatcgcataccgttcaggaccgtccgtacgcagatcggtagcggacgtatcggccagcatcgtggcacatggtgcatcggcaatttgcacaccggaggtagtcactcgaacggtgtcggttgtgatgacgatgccgctgggagtatccgcaatgacctcgcgcagcacgttggcgcattctccgataatcgaccggatggcgctgtagctgagcggcttggcggtatccaccatgtagtcagtcaggcattggccgctatccaccggcatgacaatgagaagtacgtcggattccatacggtatttcagtacgggaatcacacgatcagggcgagtggcggccatgcgaccagcgagctcatcgattgcggcgaaagcgctgcgattggtaatgatgaacagctggcaatcctttgccagcacacggtcgttggctttccatgcctgaatgccaggctcctcacgcaacgatgacaccaaggtgtatcggttgagaatcgtgtctccgagttgcggtttcatagtgcgttcggctccgtgtgattggtgttcgagactggtcttagatattctacgtgcggggctatccttgacgggctccgtctcaggattgatttgcgtatcgtcgacttttttccggctgggctgtcacagcaacgtcctcactggccggagtcttgtgtagacgggccagtatcgagtgataggcgctgatgagttccggggtgtgcaccacacacaacacagccacatatactacggccagcacaatggtgagcaccacgcagatggccagcgcagaccaccagctcatgtgcccgcctactggtcgaatatccgcgccgaacagtgcgactaccggtcgtttgatcagccagaccacaactccggaagccagtgccgccacaatggccttggcatatgtcctcgtgatctcccgaccgccaagattgccttcgaacttgcggcgcaacatcatcaacgtcagcggcaacgccagtaatccaccgagggtcaccgagcaggcgatgccgagtacccaatgctcaggaggaagtaccatcatgccgatgatcatgaatattgaggtgaatccatactgcatcaccgcggacaggaaggggtgaaggccgtcctcaaaggcgtagaacgtgcgctggattaacaggaacgccgaccccaatggaatgcccacagacaaggcgataagcgcataggagatcaacatagtctcgtccatcgagacggacggaagcaatgcgcggatgatcggttcggggaacacgaccatggcggcggcgaagaacatgatgagcaggcccacattattcagtgcgctgaccaggtcgtgccgtgcctcatccagattcgcagctgcgatggaacgggagattttggggaacatagccgtggataccgatacggcgatgagcgaatagggcaggatgaacagtgtgtacgcattctgataggtcgcgttgcctgccacgctgaacaggctggcacccgtcagttcgtgggcgcgctgcggtgcggatgtggcgatacgggtaaggataatgccgcagatctcactggtgatcaccacgcccaaagagcctaacgccacgggacccatagacctgagtccaaagccgccaagcccgaagctgggtttgtacttgaacccgatacgggccagcggcaggaacagtatcagcgcttggaaggccacgcccaaagtccaggtgcctgcggtaagcgcgattttgtcggcggtccagaattcgaggggctgttcattggccttgctgaacagcagaataaagccagtaaaaccggcgcaactaataatgttggcaccggttgagctccacgcatacgtgaggaaatggtctttggcggccaggatctgccccaataccgtatacaggccgtagaagaacacctgaggcatgcaccacagggtgaacgaggtggtcagggctatcatctggtgatcgtcgctacccacgtacaggcgggcaagcagagggctggccgccgccatcaccacggtcatggccaataggatgccgatggccaacgtaatcaggcgattcagtcgttcttgggcgtctttttctttcaacgtgcgcacgatctggggcaccagcacggcgttgaagatgccgccggacaccagcgtgaacacggattggggaatcatggaaccggcctgataggcgttggccgccaatccggtggtgccgatggccgcagcgagaagaatcgtgcggagctgaccggtcacacgggaagcagcggttcccgtggccatgatcagggaattacgacctacgcttgaactcattcgtcggggtccttcttccgatggaactgccgccacaggccgataatgcccagtagcacggcgaagccgatgataatgaagccgctggcatcactgatgcgcatcacactggtgatcgcggtgtcctgcgtgttgccgaagctgttgccttcccggtcggtcaacgacacatgggccgtcgatgagccggaagtggaaacgcggatggtgaaggtcacctgagcgtcgctatgcgagggaatatcgatgtcagcggttcgcgaggtgacgatctgcatggagtcagtcagtgagttgacctgcacgctgacggcgtagggaaggtcattgctgacggtgattggcattttcgcggattcgctgaacacggatattgattccgatgggttgatgcgtacgccgttcagaagatcgctggccagtgttttcgtggctttgaccatggcttttcgcgtggctgtcggctggggggagccagacatggaccgcagcgccatatcgtcatgcagcgccagtaaagagccaatccattgcgtcggatcgttgctatgcgaggcggtgtcattggcgtcctgccgggccagggcctgcgggtccaacgacgagacctcgtcggaatcaatctcgttcctcaatatggaggtggccatgcgcatgatgtcatgccggctgtcggccaactgtctcaatgccgaccgggtattggcggtgttggcatcatcggccttgtcgggattgaccgaatcgctgacattgtacggatcggccttggccatggtcttcaggtccgtcagattcaaccaagacgcctgctcgaaggcgctcatcacctgatcgatccagctggcctccgtggtgtgggagaacgtcataagcaggtatcgggatgtatagggctgttccatctggtagaacgcgctctgagcgatcagtcgggccaaccgaccggcatcgctggactcggcctgcgcgtccgtgctggtggcttggcccttggccagcgtgcccaaggtcgattgctccttcagcacggtgacatcgccggcaggcgtatgcaccacgtaggtgcctgtgtgtacggcttcagtctggtcggcatcgaaagaggcatcggcgatcaccgtgtcatagccctgctcgcgtgctgcggtcagcgcatccaacgtccaacagttgttgccctgccatgcgtacgcggagggtgtttcggagtcgcctccgtcggcataccatgcggccgcctgcttggcgttccactgctcagtggtgatgccggccttttcgtaggccgcggtatcgtccagtgcggtataggcggtgatgtcgaagtcggcgggctgcatgatgccggcaatggacggttgcactgcggactgacgccaatacagaggatccgcgatcacttgcagcgagcggtgcttggcgaatgtctgcccaagggatcgcgcggtatcggcatcctgttcggataaggatatggcttgcgtatcagtggctttggccgcgttgctggcgtcggcgttatcggacttgtcggccttgtccgtgctgttggacttggacgatgttgatgtcgaggaagtggtggtttcggcaatgcgattgctgatggccttattatcgacctgccagccgctggcggtgtagggcatggccacggtcaggttcatggccggtgttgtcgcggtgttgagcccatccgaagatcgggtcagaaaactcggcaaatcggcgagtatctgattgccaacgatatacgacagcatcagcggtttcggtccccaactccctatggaggcaagggtctgctgattggcgttcacctcgatggtgacggtggcagtgccgccggcgggaatcgatggcacgtcaacggaacccaactcgttgggggttgggatgggggcgttgttctcggcccaattctgaatatcggtgcgcgagacaaaggtgaacaacgcattggtggtcaggtgcagtgtgccgcttgacgtggccgtgctgtccgtattgctgatgaccgcggtgacacgatagcccgatttggaggtgacgatgggggtgctttgcgtgatggcaatgctctgcttgggctgattctcggtctgattgcccgttgcgtccgtcgtatcggatgaatcagtcgtgtccgtcgtatcgttcgcgtagacggtcaatggagcggccagcatcgccacaacggcgacgccagccgccagtgcgtgtgccagacgtgtgcaatgtcgtaagactccgggtaggttcactcgtttgcctgcctgttcttcttcctggcgtagagccacgcgattttgcgttcgttgggatagctcaacacgtcatccaaatcttcaaaacgcacccagatggcgtcttccgcctcatgatccgggtctccttccaccgtcagttcaccgccggtctgtttgagcgcgaagtgatggaccagcttgtgcacgcgctgcgtggtaccggtgaaccagtagtcgatggtggcgatggaatcgatcacctcgcccaggatgccggtctcttcatgcacttcgcgcacagcggtctgctgcggggtctcgcctttttcgatatgccccttcggcaagcaccattcgagatggccggagcgggaatgacgggcgataatggccacgcggttctggtcatcgaaaatcagaccgcctgccgaatattcgcgtacgaccggcagttcctgggcatccagtgaagcgaatgtggtcggaccgtccgacgtacggcgttgcggcatcatggccggagtcgggccggatggcgtcaccggttctaccggcactgccggttccggcgaggcaacatctccggacgggtgccggccgaagaccgtggccggcgtgggatgcgctgacgttgcgggcctcactggtgctgcagacggcgctgagaccggcatggtgaccggcgttgcggccggtgcggtacgtgccgcaggcggcatcagcacgtcgcgcggagtcggtatcgctgtggtgtgcgcggcggcggccttggcgaccgcaacggcagcatctacggccgcgtgagcggtcgccgcgggatcgttcgtgacgatggttacggacgtttgtgccgtggcgataatcggctcgacctcggcaatcgtctcggcaccggcctcgccggcgataccatcagcctgcccctcgatagtgccgctggtagtggcgatggtgacggtggcatgcatgccgaagacggtggccggtgtgggcatcatcggcttcggtgcgggcatgtcgctggcggcgtccgatatttcggattcggatggttcgggtgtggcgggcgttgcgggtgtgccaggcacaccggaatgttgcgcagtcggtactgcgtctacttcgtcttgatgaacggcctgattggtggagtggctcgcggtgccgccgacatcggaagaatcgcccgaatcggcggaatgatgcggagtttcggacgtatacagcaggtggtcttgggtatggctatccgccgaatctggtgtttgccccagcatgcgggcaaggtcggcgggcgtaatcatattctccaccttactcaaccccgtgtgcaggtggggtaacggtatgctggtagggcagaaaaacgtcgcacgcgggaaggtgcccattggatttcgaagtatggcctgaagccatcgaacttggtcgactgttcgccgaacagggttacgagctggcattggtcggcggcccggtcagggatttgctgctccatagaaagagccacgatttggacttctgctcatccgcacggcctgagcagttcgagccgatactgcgccggtgggggcatgacggcttctgggacatggggcgcaagttcggcacgctgggtgccatgcgccgccgcccggacggcaccgaggtcaaggtggaggtcaccacctatcgctctgacacgtacgatccggactcgcgtaagcccgaggtcaattatggcgacacgcttgagggcgacctgtcccgccgcgacttcaccgtcaacgcgatggctctgcgcgtgcccgacctgcaattcgtggacccgttcggtggtgccagtgatctgtccaagggcgtgttgcgcacgccggtggatccgcgacagtcctttgacgacgatccgttgcgtatgatgcgcgccgtgcgattcgtggcccagctgggcttccgtatcgcgccggacgcggccgaggcgattacctcgatgcgcgaccgcatcgacatcgtatccgccgagcgtgtgcgcgacgaactgaccaaactgctgctctccgaccgtccgcgcgccggccttgaggcgttggtcgaatccggtcttgcggacatcgtcttcccggagattccggccctgcaattgcagatcgacgaacaccaccgccacaaggacgtcttcgagcacacgatgattgtgctcgaacgtgctatcgccctggaaaccggcccggacggcccggtgcccgcccccgacctgacgctgcgcttggccgccgtgatgcacgatatcggcaagccgaagacccgccggttcgagccgggcggcaaggtgagcttccaccaccatgacgcggtgggtgccaaaatgacccgcaagcgtttgaaggcgctgcgttttgaccaccatctggtcgaggacgtctcagaactggtgaatatgcacctgcgcttccacggctatgtggacgagccgtggaccgattcggccgtacgccggtatgtcaaggatgctgggcacctctatgagcggctgaacaggctcacgcgcgcggatgccaccacacaaaacaagcgcaaggcgatgatcttctcccaggccatggatgagatggaggagcgcgtccgcgaactcaagaagaaagaggacttcgacgcgatccgcccggatctggacggcaacgaaattatggagttgctgggcctggagcccggcccgatgatcggccgcgcctacaagcacatgctggaataccgcttggataacggtccggtggaccacgatgtggccgtcgaagaactcaagcgctggtacgccgagattcagtagtccgatactagtccgataccaaaaaaccgtacgctgaatacgtgtcagcgtacggtttttcgcgaagatgaagctgtatgcgctttactgcgccgtgtatgcgtcgtgtttggtgtcggcgggcagcttggtcatgctatcggcggccttgcaaccctcgatattggtgatggtcttaccggattgcggggaggagttggtgtcctgcagatcgttgaacgtggcgccgatgaccacatcgatgagctgatcctcgcgagccgtcatgatcatggtggcgtcggtgaaattgccgatcagcgtatacgcctgattaatggcgttcttgccgaagtagatggtggtgcgttcaacgtcggtgctggaatagttatcgattttctgcacgctgaatccacgattggccaaagcttcacccacggccttggcgaattggccgtgagaggtgccgttcatcacgcgaatgccgaccgaagcgttggacacgtattgcgctttgccgctgctgtccttgaccgcgcacggtgccgcgttgccgtaattcggctggcgggccggagtctccacttcgccgaggccgaaaacgtggaaattgaacagtagggctatgaccagcactactgccaataccgcgccgctgatggaaaagacgatggtctggcggtggcgcacgtacgccttgcgggcttcacgttcatcaacctgatacgtcatcggtggacttctttcatgggtcgggtggctggttgctaccttagcgtcactgtctgacgccgatattggggtgtgcgggagatttggctcgaataatgcgatcgaccacagccgtatcgcgccacacatcgataatgcgttgtgccgctgcctcgtcggcggcgaaagcgaccactgaggggccggatccggagacgaatgcatggctggcacccgcctgcgtggcggcgtcgatggcctgcccgctgcggggatgcaggctgattgccgcagcctgcagatgattgcggtcgccttctgcggctcccacgaggtcaaaggtgtggtagacctcaggagtgctgagttgcgactggtacgcgccgaccaatacttcgccgctgaatccctgttctatcagcgccagctcatcgcggctgccgggggcgatatccgtgatgcgttcgccgaaaccggtgccgtatgcaaggccaccggtcaggcagaacggcatatccgcgcccaacgtggcggcaatggtgcgcagacgctctataggccagttcagctcccagagacgattgaccgccagcatggtcgccgcggcgtcggctgaaccgccgcctagtccggcacccacgggaatgcgcttggtgatggtcaacgccacatccggctcgcactcggccgcctgggccatggcgaagagggccagtaccgcatggttgcggcgcatgtcgctgcgtgaggaggccaagtcgcccaaataagcgccttcgagctccagagagaatcccgctccgggttgcttggcggttgcggtgacggtgtcgtatacgccgattgcacagtaggtggtgtccagttcgtggcgtccgccccattcgtcgtgagcaggtcccacttccaaggtgagattggttttcgccgggcaatccaccgtaatggtgatgggggagagctcatcgaactgatgtcgggcagcggctgggcgtggatgtgagattaccggactcattgtgcctcatctccatctccacacgattcgatggccttggccagagcggtgaattcggcgatggtgagcgtctctcctcgacgggtcggatcgatgccggcgatggagaatgcctcggagggcgcaatggtcttcaatgccgcgtgcagggtcttgcgacgctgaccgaacgccgcatcgatcagacgaaatacgagttcccgttgtgcgccgccgtcggccgtgctgttcgaggctcccggggcggccgggtcatcggcctgataccgggtgaatctgacgagcgcggaatccacattgggagccggccagaacacattgcggccgatggtgcccacccgttcggcggtgccataccaggcgagcttcacgctcggcgtgccgtagatcttggaaccgggcttggcggcgagtctgtcggccacctctttttgcaccatcaccaagaacgagccgaggttgtcgaaacgctccaacagcgtgagcagaatcggcgtggccacgttgtacggcagattggcgaccagcgtaaacgatgcgtcatcgctgaaatcaggcacattctccggggtgacggttaaggcatcccgattgacgacggtgagtcgtgacgtggcttcgggcatgaattcggcgactgtgcccggcagtcgttcggccaacggcggatcgatttcaactgcggtcatggtggcgccggtttccagaatcgccaatgtcaacgatcccaggccggggccgacttccatgacatgatcggcagcggtcactcccgcctctcgtacgatacgacggaccgtgccggggtcgatgacgaagttctgcccgaatttcttggtggggctgataccggcatcggccgcgatacgacggatatcggcggcacctaacaggtgaccggtggcgggaatggtgtcgttcataagcgtgtgttccttgtgggcttcgtaaccgatcagtaccaaccgatttgttcggaatgttgccatgccttggacgggctgccgtaggtttgtgcgatgtaccacagaccccaatcgatctgtacggcggcatcgtcacggtaattggcgccgaacgcagccattttgtctgctggtcgcgactgaggaatgccgtaggcaccggagctcgcgttttcggcataccacagccatctggactcgcggttccatagtttgaccaggcaatcccagtcgttgcctgtccacccgcgctgcgcggcggcaccggcggcataggcctgagcctgggctacggtggcgtgccagagtcggccggagggcgtggtggttgttcctgaatcggagccggaagagccggaattgttgttcgtaccgccgccggtgttaccggaattaccagtgttaccggagttgttgccgccggtgttgccggcattgttgttggtatcggtgttcgtgttgttgccagagctgctgttgttcttgtcgcctgtgttgttggcattgttaccggacgactcgtgctgattgttgaaaccggaatcggccttgccgttatcggcggagtcggattttttgtcggaacctttatcggtatcagacttggcggcgcctacggcgatgatctggtcgatggccatcgtggtgacggtttcggatttcagcgtctccgattcggccacgccatcgacatacgtgacgttatacacctgggttttctcgccattgacgccttgctggcggatctccgactggccttcaggaagattggagtcgatgatggtttgtgtggagtatggcactacggctgtgcgcgtttcctcgccatgcgtcacgcgccgtacgcgcaggatagtggtatcgccgtccttttcgacgctcacacggtcctctttgttcagcacgatgcctttggagtcaagaatggaggccgcgggcagtttgccgttgggggccacggaagtcttgccgtccgcaatgacggtgaccgggccatcctgattgatgaccagtccgccggtgagctggttgtacacattgtcgatgtcgacggtgattttcgcggcgttgttctggttttcctcgaaaaatcccagtagctggtcggcgctggtggccacggtccagaacggcacggcggtgccgtcgatgttgatggtggtctggtaggcggactgtacggtgaccacggcatgattggcgagctggtcgccggacgaggtggtcacgatatcgtgggtcttgatatccaccccttgttcctccagaagacgggtggccgtcatcgcatatgtggtgacttgggtggtttgcccgttgatgttcagggccacggatttacgcgcggtgaacgcgaatgatccagccagcgcgatactggtcgccgcgatacaggcgattacgcggatgcgacgcagtgtaacaaaccgctgcggggtccaacgccgtgccattgccatactcttcctgctgggtgaacgattacgccacccatcgtaacggttgttccggcccgtactgcggtttcaccggccaccgtcaccattcctgctcgtcagattgttctgagctcaaaaaaagaaaagaaaaggggggcgggagagaaggggatgttcccgcccccttgaaggcgcggagctggttgggggacgctccgccctcattccaggaagcccataattgggggaaggctcctggagtacttacccaaggtaagaattatatgcgtagaaaagtctacgtatcacataatacgccattttttctgcgcgacgagcctcttgtcgggatcgaaccgacgacctgccgcttacaaggcggccgctctggccatctgagctaaagaggcgattgttcttaacgcgtaaatcgttgcgaacaaatgactagtataccggtacttcccgagtggtcaatttaagccgagccgcaggcggtattgcatatgtcgcggcgtcaacttattcggccacgcagcatcaggaggcgaccgaaatcggctttccgctggcaccgatggatggcattttgccttccacgcctacctggtcagcatccagcccaatggacttgaggaagccgtccaccatattcgtgtccgccagcgtgagctgcttcagatcccagtattcgccgttgatggtgagtgtgggggaggagaaggcgccggagctgttgaacagttcggggcgcaggatcgtgtagttgttggaggcggtgagccagtcgaggtattcgttcttgccgctgaacgccgcggcggccacatcctcgctcacgccggccttgacggcctgcttctccagcttggcgttgtttaccggctcgtaattggacaattcgcccggctggaaatcctcagcgtagatgttggagaggtagctcatgaggtggtcgggatcgtcatcatgctcggcaatgtagatggcaccgttgaacacgcggttggagtagttgtcggagctcttattgttctggaaattgaggaagtgcaaatcgatgttgagctggcctgcgttcatcagcttgacgagcgtcgggtcgagttggcggttcaccgaggcgcagccggggcacagaggttccatgtagatggatacggtgggagccccctcggctttctggccataccctttgttggagattacgaagccggccttgtcgtcggcgttagccggctgggtactgactttcttgagcttgctataggcctcgtccacggtcatgttgctttgctggctgctgctgctggtgttggacggccgcatagccttgtttacggcgaatccagcgatggccaccagcaccacaataatggccaccacaatgcagccgatgatggtctgctgcttacgttccttagccgcctgctcggcccgtgcctgctgggcggcctcctcggccgctcggcgctcagcgcgtgtggcacgcttggcctgacgcttcggatctgacatagctatccccttgcaatcgcttcaatgtttgggccccatcataatgaccgggcctgaggaggactgcgcccagagctgatctgaggtgaattccctgtaaaagtgtgacggaacgaacgtatcggatacacaacggccatgtgtgcggatggctgatgtgtgagattccgccccgctctaggcgaacggcatccagttgatcggcatgcccagaatcggcatcgcgcacaaggccacggtgatgatggcccatatggtgaacagcacggtgccgcgcccgccgcccttgggcgccggcgccactggagcaggtggagccccacccacttcggtggatggcgcgcccgccgggcgactgtgtttgagcccgcgcagtacgccgccccccagccgaatcatcatcgactgtggggcgaacacagtgaccagccagccgatggccatgaaaccgcccagcgccagcccggaagcggagaacggcacatcattgagcaacggcaccggaataccccaatccgcggtgaaataccaggagatggtgtgaacgggcagtgccagagccgcggtggccacggcggttcccgccatatagatgatgactagcagcagtatgcggggaatggccagcagcagggctttgaccagatgccagggaaaagtcgccacgcgaatccacgaatcggagcttttgcgctcgccgccgcgtttgccctcgcgctcaagctggggttcggtgttataggccagggtgagcagtagccacaacaacgcagtggccgcgatgatggccacgagcggagcatttgccgccagtgccgccagcggcgccgccagcaggatcaatggcagggtgccgcgctgcagatattcccctcgcttcacgtccaccggattgggcatgggaggattttggaccatggtttcggtgggggccgcttgggcggtttggtcgatgatgcgctgcaatgccgggcgaatggcggggtccactgctgtgggctggttgcttgcgggatcccagctgctctgggcggtgccggacggggggaatgatgacggctgcggcgtggggagtacggtggtgcgctcggccagcggcgtggtttggtccggcatcggtgtggtcgcgccggtgagtacctgtgtgccggcgtcgtcggtgaaatcggcagcagcgtcgggcaacagttgcgtggcctgctccgcaccggccggcggacgtggcggcatatcggctaagggcagcgtggcggtagcggcgccagccggcgagaatacgacggtttcgccatcgccgttatcgcccttattgccggagaacacggccatggtgggagcctcagcggcttcctcggccgcgcgccagatggttcggggattattgcggtcaacgccgccggccgcgccaaaagggggcatcgcctccgcggcttcggcaacgatcgcagccggttgtccagccacggctcccgcggcgaacggtcccgcctgctcgccctgccaagcgttgggattcaacgcatccaaggcgatggcattcagcaattgatccggcgtgcaacgatccctgcgatccgggtccagtgcagaacggaaggcagccaatgtgccggccggtagtccggaaagattcgcgttgcccgaggcctcgcgctcaagtaccgccatcatcggcttggtgccgaacacaggcgcgccggttgcggcaaaagcgagcacggacgccaccgaccaccaatcggtggcgtcgtcggattcggcaccgtcaataatctcgggtgcgatgaatccgggtgtacccatcactaggccggtgcgggtcacgtgactttcgccctcgcccatcgcgataccgaaatcgaccaataccggtccggcggccgacaccatcacattggtgggtttgatgtcgcgatggacgatgccggccgcatgtacggctttggtggcttcgatgagcttgcgggccaagcgttccagatcgtcgcccacataccggccattggcggccacatcatccttaagattcttgccctcgatgagttcagtgacgatgaacgccaacgtatcgtcgagttccatatccacgatgccgcacacacccggatgattgaccttcttcaaggccatggcctcgcgccgcaggcgctcgcgcggcgtgacatcgggcttgaggtcggggtcgtgcagggccgtggacgcagagccggagcctgccactgactcgtcggtcagggagtcgcgcagaatcttcatggcataggtggtgccgccgtcgtcgcgcacccgccacaccgaccccatagctcctgagccgagccgggagatcagcgtatacccaccaaccacttcgccggactcaagattcaacgcgttcaaatcgctcatgccctccatcctaatgccttgctggtgcattattctggctctctcctgggaggccgagcttgatatttcttggctcccctctctgagaggggagccaagaataaatgccgtttacgtattgagaagtgccgtttacgccattaaggtcgattgccctgaccggatgtggtagcaaattatgcgctcgaaatgacaggataggtgcgtgggcaggtgcgccagtcgtgaatttgcgactctataaccatcggcatcaaggatgtgtcggcggtgacccaaaggtgagccagccgggcacattcaacagtggcacagcgatgcaagggcagtatcgtgagccgctgatcgaatcgataacgatatcagattcgaatgccgcgacttcgccggtcgtaccttcgaatacttctccgaagacggctacctgttcggcgtgatggcctcccagcaggtcgctggcgctccggtcaaggcctgaggtgtgtctccgataactgaatagctaaatagaatggacggcctgctgagtgctactcaacaggccgtccattgtgtatctgaatgcgaaaagtcattatatggaacggaatatatcgatactgtgcattgtgccgattactgattccgacgcaagtattcgcgcaggaagggcacggcaaaatcgacttcgcctcgttctgtttcgcggataacgaaggcgtcaaggaggcgtttgcggtaggtggcggcatagttaggcgttttgcccatgcgctgtgcaacattcacggtgggagagggaccatctgacgctgccatggcttcgagatactcacggtcgtttttggataagccttgcaactccgggatgcacacggcgttatcaaggtcaatacgtgcttcctcgatacctgccgtaacatcagcgtcgatgatggtatccgagtcccgcatgtctgcggcatcccagatatggtagccaaccagttgaatcatataggggtatccggctgtcacattggctgcagtgcttaattgagcgtcggtgatggacatgccggaggcgcggaatgttgtggcgaaagcatcgcgcacttcatcaagaggaatatctgtgagtatgttcgttttcgcgcgacgtaggaacgtgatgacttcgtcattgaacaaatcagaaatcatctgtgggagaccggcgaacacgatggcgatattgcgtcgttccctgatttgatgctgtatggcagtggcgatggcaatcatgtcggatcgctcagccgcttgagtctcatcaatggtgataagcaacccagcatggcgcttctcaagcgcatccaaccgtccggcaatggcacttctcaacgtttcgggcatacgcttcggggatagttcggcttctccgaggccgatgcccgctccagcaaaagtcaacgatggtcggatagtgaggtggtcaagggcccctcgcccggttcgtaaggcatcaacaaggcgttcgcatagtccggcagaggccgtttcttcgatgacatcccatctgcgcgctttggcccggtctccgaacacagtgagcatcacggtttttccggttccacgagcgccggtgacgagcataatgcgccctggggcaccgactccgttatcgagacctttctcgaaatcgcggataactttgcctcggccgatgagcaggggcggttcccctcctgccgttggcttgaatgggttttcctttgccttcatgtggaccgcctcctcgctgaatcaacctaaaataaaaattatcaaaaatatcaaaaaaataaaaattatcaaaagttgggttgagccgactgaagaaaacagccgtggcgacaatgattctgccgcaatccgcggtgacaacaactgacgcggaccttcttggcagaatcgttgtttgtcccgcttcgccaatcaacgtcgctcaagttcggtgcgcagaccggctaccgtagcggtcagctcacgcacttcctcgcgcaataggtcgatttcgggattggctgatgttgcaatagcctcttgcgcggcttccttggccacttccttctcccgagcgtcctcgcgccgatccgtctccagattgacctgatccacgatccacgaggccagcgtggccgtcacaataccgatcaacgcgatgccggtgaacatcagcaccaccgcaatgatcttgccttggaaggtgaccggcgagaagtcgccatatcccacggtggtcacggtcacgaacgcccaccacaacgccgtgccgaagtcggtgatcgtggatccggacgccccgcgctccacggaatacacggccagcgcgcccacgtacatgagcattcccaccgcgccgaccgcgtatacggtgatgcgcccgcgcaccgccatgccggaggtgcggttcagcacgtgcagcacggtcagcaaacgcaacagtcgcaagggccggagcatcggcagcgcgatggtcagcagcgtgaacaggttgtgcttgaaccaccgccagcgatcgtcggccaaccacagcgagaccacataatcgacgacgaacaccacccagatcacgttgatgacggtttcacacagcgcgatatgcgtgcgggagagaatttcccacgaatacaccaccagaaacaccacggacagcaccatcagcggccagtccgtccacttcttccacgtcttcagtcccatattccgattgtagtggcgcgcccgctgcgccactgcggagcatgactccggacgtcagtgttgtatacgttcgtatacatttcacgttgtgtacgaacgtatacaacggtatctttcatctcgcatttcccttatgactatcaccacagtgatataatcaagaatatgtaaggagagagagaaagagccggccaatggagaccgcatcgatcgaactgtggcatggctcttcgcatgtcatcaagcatcctgaatacgggctggtcaagccgaacaacgattatggccgcggattctattgcacgcgcagcgtcgagctggccaaggaatgggcgtgcgcgggaatggatgacggtttcgcgaatcggtacacgttgaccacggacgggctcctcttcctggacctgtcccagccgccctacaccatcctgaactggctggccatgctggtcgaaaaccgtcgtttccagccgaccaccgccgtcgccgcgcaaggcatcgaatatctgaaacaagtgtttctgccggatgccagtcaggctgacgtcatcgtcggatatcgtgccgacgattcgtatttctcgttcgcccgcgcttttgtcaataacgcgatttccatcgaccaactcgctgaggcgatgcggttgggcgagctcggcaagcagatcgtactcgccagtcctcaggcattcgcggcactgcggttccaaggctgcgaaatcgcccgcgcttcgacctaccacggattgcgtaacgagcgcgaccgcacagctcgcgaagcctaccgccgcaaaagtgcagaagccgatctcgacggcctgttcatgcgcgacatcatccgcgagaaagtgaccaacgatgatccccgcctatgatgagacatacttgccggacgccatggccaacttggccggcgccttcgattatgcgctgaacgattgcgggttgccggtcggcctattcatggacttcttcgccacctccgaggcggccgcgcttttcgggcgaggcacgcccaaatacgtgtgtggcatgtccggcgaggagctggtggccgaaatcatgcggcaaaccggttgggcgcgcattctcgatatgccgccagccgcactgcgcgccggctcaacacccgaatactgggccggatgggtactcgcatactgccaatgggccaggggagtgcggttctcggacattctcgatgtgctgtcgctcgacgatatcgtgcgactgcacccgactctgcacgaagccgacgaaagccgattcgtcgacgtgtacgacgagcgggccgcccataatcgcaccgagggcgactcccggctgcacacgatccgcgtgcgcgccggactcagccaatccgggctggcccgccgctccggcgttaccctgcgctccatccaaatgtacgagcagcgccgcaaagaccttggcaaagctgccgtctccaccgtgctcgctttggcccgcacgcttggctgccgcatcgaagatctgttggagccgtaaagacgcggagtagtatcgcgccgcatcgattctgataactgaacaactacttttaaggcccggccggatgctcgtttggacatccggccgggccttctggctccacacggggtgccgaggtatccgttctccgcttcgaggggctgatttggccttccgtagaggtttactcccgtttcgaggggctggtggcccgctagaacacgggtataaacggcttcgccccaccgtcattccgccattttggggatgcgcttacttgagtaccagcccctcgaaacggagatagatctccggaaagggtcaaaacagcccctcgaaactcaagatggcggttgcagggcggttgaggatcagtcgaagagcggttcaaacgcaaatgtgaacaatgccacatgtgattgggcgggtcgctgcacgccgattttcgggggtgcatgggaatggcggaatatcaacgaaaaaccctatatctaggtttgttatgtgacacgcgccactacatatagtgccttgatttcaaatcacaccgctgtaatatggccttcgcttcactgttcatcagaaccacatcaaggggagtcgccatgaccgtcaccgtgttcaccaagccgcattgcccgcagtgcgatgccaccaagcgccagctcaccaagctgggtgtgccgtttgaaaccgtggacctgacgcagaacccctccacccttgagcagctgcaggccgccggtttccagcaggctccggtggtcatcacgccggacaactcctggaccggctaccgccccgacctgattcgcgaagtcgcccagcaggtggccgccgacaaccgcgccgccgccacggtgtccgcgtgagtctgagccagcccgaattcgcggccgaaggcaagacgatcggcgcattggtctacttctcgtcggcctccgaaaacaccgcacggttcgtggccggatgccgtttgcaggacgaaggcatcaacgtctaccgcatcccgttgcgggccgccgacccggcgctaaacgtctgcgaaccgtacgtcatcatggtgcccacctatggcggcggcgtggtcaagaaagcagtgccgattcaggtcaaacgcttcctcaacgatccagccaaccgcgagtggattcgcggcgtcatcgcctcaggcaacaccaatttcggtgaggcctactgtgccgccggagacatcatcgccgccaaatgcaaggtgccctacctctaccgttacgaactcatgggcaccccggaagacactgccgccgtgcgaaacggcctcgtccgcttcttcaccgaacagtaaatcttgaccccctcgaggtattggctcccctctccgaggggagctgtcaacgaagttgactgggggagcaactgtctgagtaaacacacttctgccatattccaaggatttccaatgactgacctcaccgccaccggcctgccgctcgacaatactgccgacaccgcagcggaacagtacgacccggcgcacgattaccacgcgctcaacgcgatgctcaacctctatgacgccgacggcaagatccagttcgacaaagacaaggccgccgaacgcgaatacgtgacagggcacgtggccaccaacagcaagcggttcgcctccaccgccgagcgtctcgaatacctgatcagcaaccagtactacaaccctgcggtcttcaaccagtactccgctgaattcctcgaccgcatctacgagcacgtggaatccgccggctttgagttcggcactttccttggtgcgttcaagttctacacgtcctacgcgctcaagacgttcgatggtcgcctctatcttgaggacttcccgcagcgttgcgccgctgtggccctggagctcgccgccggcaatgagcagcaggccatcgaatacgccgacgaaatgcttgccggccgcttccagcccgccaccccgaccttcctgaacctcggcaaggcccagcgtggcgaaccggtcagctgcttcctggtgcgcatcgaagacaacatggagtcgatttcgcgcggcatcaacgcggccctccagctctccaagcgcggcggtggcgtggccctgctgctgagcaacctgcgcgagctcggcgccccgatcaagcacatcgagaaccagtccagcggcgtgattccggtcatgaagctgctggaggactccttctcctatgccaaccagctcggcgcacgtcagggcgcgggcgcggtgtacctcaacgcccaccaccctgatatcctgcgcttcctggataccaagcgagagaacgcggacgagaagatccgcatcaagtcgctggctcttggcgtggtgattccggacatcacgttcgaactggccaaacagaaggcccagatggccctgttcagcccgtacgacgtggagcgcgtgtacggcaagccgttcgccgacatctccgttaccgagcattatgacgagatggtggccgacgaccgcatcaagaagacctacatcgacgcccgtaagttcttcaccaccatcgccgaactgcagttcgaatccggctacccgtacatcgtgttcgaggacacggtcaaccgcgcgaacccgatcgaaggtcgcgtgaccatgtccaacctgtgctcggaaatcctgcaggttcaggagccgagcgcatacaacgaggacctcacgtatgcgcatgtcggccgcgacatctcctgcaatctgggttcgctcaacatcgctaaggcgatggatggcggcttgggccacacggtggagacggcgatccgcgcactcacctcggtggccgagcacaccagcatcaacgcggtgccttcgattcgccgcgccaatgaggagggccacgccatcggtctcggccagatgaacctgcacggcttcctggcccgcgaaggcatccagtacggttctgaagagggcctcgacttcaccgacatgtacttcatgaccgtggcctaccacgcctaccgtgcctcgcacgcgctcgccgtggagcatggccgcacgttcgccagcttcgctacgagcgactacgccaagccggccggccagggcaactacttcgacaagtacaccgatggtcgtcgttcgctcactccgcgcaccgaacgggtccgtgcgctgttcgaacagtacggcatcgcgattccgactgcggccgattgggaggccctgcgcgacgcgattctgaaggatggcatttacaaccagaacctgcaggccgtgccgcccaccggctcgatctcatacatcaaccattccacgagctcgattcacccgatcgcctccaagatcgagattcgcaaggaaggcaagatcgggcgcgtgtactacccggccgcctacatgaccaacgacaaccttgagtactataaggacgcctacgagattggctggaaggccatcgtcgacacgtacgccgaggccacccagcacgtggatcagggactgtcgctgacgctgttcttcccggacaccgccaccacccgcgacctcaacaaggctcagatctacgcctggcgcaagggcatcaaaaccctctactacatccgcatccgccagcaagccctggaaggcactgaggtccaaggctgcgtctcctgcatgctctgatcgttcgatggagcgtataccgcctttcttcggcactcgacgtaccttcgtacgccttcggcctcagacggcggtctccgcacacatcgaacaaccagaggccactctaaggaacccacaatgtcacgaaccatctatagagcactgctccggctgaccgcgccggaggagttcgaaaacaagcccgccgacaactcccaagacgagtaatgcaaaggaatccccatggcaccgatttccattccgcgcaaaccgctgaaactcatcgaccgcgtctccgcaatcaactggaaccgcctcgaagatgagaaagaccttgaggtctgggaccgcctgaccggcaacttctggctgcccgaaaaagtccccgtctctaacgacatccccagctggcagaagatgaccgaggacgagcacacgctcaccatgcacgtgttcaccggcctgaccctgcttgacaccatccagggtacggtcggcgccgtctccctgattccggacgcgctcaccccgcacgaggaggccgtgtacaccaacatcgccttcatggaatccgtgcacgccaaaagctactcgtccatcttctccaccctgtgctccaccgaacagatcgacgcggccttcgactggagcgagaacaacgagttcctgcagaaaaaggcggaaatcgtgctcgactactacgagggcgacaacccgtacaagcgcaaggtggcctccaccctgctcgaatcgttcctcttctactccggcttctatctgccgatgtacttctccgcgcacgccaagctgacgaacaccgccgacgtgattcgtctgattatccgcgatgaggccgtccacggctactacatcggctacaagtaccagaagggcatcgcccagctgagcgatgccgagcgcctggatctgcaggactacacgtacgacctgctcaacgagctgtacgacaacgaggtggagtacacccagtcgctgtacgatcgcgtgggcctgaccgatgacgtcgagaagttcctgcgctacaacggcaacaaggcgctgatgaacctcggttacccggctttgttcccggctgagatttgcgatgtgaaccccgcgatcctggccgccctgagcccgaacgccgacgaaaaccacgacttcttctccggctccggctcctcctacgtgatgggcaaagccgaagaaaccgatgacgacgactgggacttctaagggtttcgcggtccgcgaacccgcagcgccgccgcgttcgcacggcggcgctacgctggagatatggaacaggagccgttggtcagcatcatcatcccggtatataaggtcgagaaattccttgatgaatgcgtgaagtctgtggttgcgcagacctatcgcaacctcgagattctgctggtcgacgacggctcgcccgacaattgcccggccatgtgcgacgcctgggccgcccgcgacccgcgtatacgcgtgattcacaagcccaacggcggcctgtccgacgcccgcaacgccggtatcgctgaggctatcggcgcgtacatatacttcgccgattccgacgacaccgtggcacccacgttggtggaggactgtctgaacgccatgcgcgagtatgacgccgacctcgtgatgttccagttcgacaccatctccgagaacaacaagccgctgctgtccaactatcgccacaacgacttcaccgaggtgcaggtcctgaccccggtcgaggccatcaaaaagcaagtcaaggctgagattgacggctatttctgggccttcctggcacctgcctccacctatcagggcaccggattctccttcccggtgggtcgcaaaatcgaggatctctcccgtatctgcaacgtgatcggcgaggccacgcgcgtggtccgtctgcccaaggcgctgtaccactaccgcatgcgcgaggggtcgattaccgccagctgggatccgcagctcacccgcgactggacccgcgccgccgacgaccgcgaggaatacatcgtccaccgattccccgagctcaagggcttcatgacgctgcaacagctgaatttttttgccaacctcgattacgagaccatgcgccagtcgctgatcgccgggctcaagatcgatcccgaggacgccgacgcgcttcgtcgccgcatcgagggcctgaccaagtccgccgatgagggcgatgagcccgtaccggaaacgttgcgtgagttgctcggactgctcaagctgggcatcgccaaggtggccgatggcacgttcggtaaggccgatggcagcagtactgatggcgatgccgagaacgatgacgtaacgctggccgaccgtttccgcgacatgcgcgaggactggcgccagctgcgcatccagcgcatcgaagacgccgaggagcgcaaggccgagcgcaaagccgcccgcaacggcgtcaccttccagtctgtgtcgcattagtcggcgactgatggaatccatcagtccgggaagagcagacctgctctacgtcgggcgtgccggttcgcacgttcgagaaacaggcgtgtcatgggccgaaccacacaacacccccagaaacgcccataaagttaactacatttcagacacgccacttgccttggtccacggtccgtgtatagtagttctcggctcaacgaagagaaccttcactgaaccggaaaaaagtaaacgctgaagcttgcagtttccgaaagcaaagttgtacgtcggtggcgagggcggaagcacagtaaagaacaaatccctttacaacggatcgtgaggcacgtacctgcctctgaaaggattagtaattatggcagaagtcgttttcgaccacgtcactcgtatctacccgggcaacgataagccctccgtggatgatctgaatcttgatatcaaggatggcgagttcctcgtcctcgtcggcccttctggctgtggtaagtctacgacccttcgtatgctcgccggcctggaagaggtcaacaagggccgcatcctcatcggtggcaaggatgtcaccacgatgcagccgaaggaccgcgacatcgcaatggtgttccagaactacgctctgtacccgcacatgaccgttgccgacaacatgggcttcgccctgaagatcgccggcactccgaaggacgagattcgcaagcgcgtcgagaaggccgctgagattctcgacctgaccgagtacctcgaccgcaagccgaaggctctgtccggtggtcagcgtcagcgtgtggccatgggtcgtgcaatcgtccgtgagccgaaggtcttcctcatggatgagccgctgtccaacctcgacgccaagctccgtgtccagacccgtacccagatcgctgctctgcagcgccagctgggtgtcaccaccctgtacgtgacccacgatcagaccgaggccctgacgatgggcgatcgcatcgccgtcatcaagctcggtatcctgcagcaggtcggcgccccgaccgagctgtacgatcgcccggccaacgtcttcgtcgccggcttcatcggctccccgtcgatgaacctgaacacccacccggtggtcaacggcaaggcgaagatcggtgaggacaccgtggacctgccggctgaggccgtcaacaagctcaccgccgaagacaacggccagatcgtggtcggcttccgtcctgaggacgctggcctggccccggctgacgacccgaacgccttctccctgaaggttgtgaacgtcgaggatctgggctccgatggctacatctacggcaacatcatcaccgatggctccgccgctgaggcttcccaggtcatgtccgaccagaacaagctcaccacgattcgtgtgaatccgcgtgcgctgccgaaggttggcgcgaccgtcaagatcaagatcgacccggccaagatgcacctgttcgctccgtcgactgagctgcgtctgaactaatagatacttggcgaggtctaatcgcttcgtcaaccattaaacgaggttattctcttcctctcttatgacctcgttggaaaagccctgcatagctgcggggcttttctttttgccttctagacggtctgagggagagaccaaacggtgttttcccgtaaacataacgcgccgaagtcgtggccaaggagcgcacttcccaagcaccacgtaaaatcgaacacatggagttgaacgaattgccccagatggatccgcgtgcgctgaaggccacgtctgtcaaagccgaagacgaacacgccaattcagccgaaccgcaagcactgaaaatcaccgccgccagctcgaacccgaagatgttcacgctgccctggcacaagcccttggccacctggcctgaggacttgctggccaacctgccgcgaggcatctcccgccacgtcgtgcgattcgtgcacgtgggcgacgaggtgtacgccatgaaggagatcacgcgccaggtggccgagcgagagtacgagatcctgcgtcgactgcagaagctcgaactgccaactgtgaccccgatcgccgtggtcatcggccgtcatacccgtgaaggggagccgctggaggcgattctggtcacccggcacttgaagttctcgctgccgtaccgtgcgttgttcgcccgcaacctgcgcccggacaccgccgaacgactgattgacgccctcgccgtgctgctggtgcgcctgcacctggccggcttctactggggcgatgtgtccctgtcgaacgtcctgttcctgcgcgacgccgacgctttctccgccttcctggtggacgccgagaccggtgacctgcaagcccagctcaccgacggccagcgcgaatacgatatcgacttggcccgcaccaacatcatcggcgaacttatggatttggcgtccggcaagctactgcccggcgacgtggatgagatcgaggtgggcaaccgcctggttgatcgctaccactcgctgtggagcgccctgaccgacaccgacaagttcaacccggacgaaatgtggaagatcgagcagcgcgtcaacaagctcaacgagctgggcttcgacgtggacgagctggaaatgaagaccgccgaggacggcaagcgtgtgctggtccgcccgcgcgtggtggacgccggctatgccaaccgcaagctgctgcgcctcaccggccttgacgtgcaggagaaccaggcccgtcgtctgctcaacgaccttgacgcctaccgtgcctccacgtggcgtgagggcgaggatctggaaatcgtggccaccgactggatgcgtgaggtgttcgagccgaccgtgcgtatgattccgcgcgaatatcgctcccagatcgagcctgctcagttcttccatgaggtgcttgaccatcgctggttcctggcggagaaggctggccacgacgtgccgatgggcgaggccgtgaccagctacatcgacaacgctctgccgagctacagccttgactccaaggcactcgccgaacttaacgaagaggccgattccggcgtcattgacgacgaatccacctacagcgacccggacgacgacggctacaaccccgatgacgatccggatgcggcagtgtggagtcattaagcggacaatccggtggactgtctgtaggtgagcccatcacacaaagaagcccctcaaatagaggggcttccgtgtatgtacaacctattacggcctcaagcgacaatcactccgccgcagccttgcgccgtgcgttggacaccgcgtacaggctgatacccgccgccactgaagcgttcagcgactcaacagacgagctgatcgggatgccggcaagcgcgtcgcaggtttcgcgcaccagtcggcccaaaccgctgccttccgaaccgagcactacaacgagcggatcggattcaaagccagtctcgccgacgagcttatcgccgccaccgtcaaggccgacaacgtagtatccacgctccttcaagccctcaagtgccttagtcaggttcaccacgcgcgccaccggcatatgcgcggccgcaccggcagacaccttccaagcggcggcgttcactgaagcggaacggcgttccggcagaatcacaccattggcaccgaatgcggccgccgaacgaatcacggcacccaggttctgcggatcggtcacgccgtccaatgcgataaacagcggtcgcgcagcaatacgggcggccgccgaattcgcggcctccattgccttggccttcttctcagcacgatcggccagctcgttcagcgaggagtactggaacggatcgaccttcagaatcacgccctgatggttgccagagcgggcgatacgatccatctccagacgatcggcctccagcatgtgcaggccgttcataccagcgattttcacgatttcgcgagtacgatcgtcatgttcaatacgagacatgatgtacagcgtggaagaaggtacgcctacgcgcagtgcttccagcacggaattacggccgtacaccagatccgaagtatccgccgaagcgaacttgtccactcgacggcgggctgccagacgcgggtcggccatctgccgacgttcggccgctttcttggccttgtacgctttgtgatagacgcggtcctcggccttgggagtggggccgtagcccttcagtttgttgcgatgcttgccacccgaccccttggtcggtccttttttgatagccataggtgctattgtcccagcaccccgcgccaaaacgcggctattccgccgtcggtagccggtaaggtattgagagtgaagaagcagcgtatgatattcggactgtccctgctgtattggggattatggttggcgattctgattctgtggatgggtcgcttcgtgacctcattcttgtcgatatatttggtttccgcgctgcgcctcgatgagggtgtggtgggcacagtcgtggccatgtacggcttcggcgcaatcatcggctgcctgttcggcggtaccttgtccgacagattcggccgccaatccatgattatcatcggcgaaatcggcgcagcggctgccctgctggtcgtttccgtactcactgatcctgtgtctttaggcgcggctctgttcgtctatggtgcgttcgcctcgctgcccagcccggccatcgccgcgtatatcgcggatgtggtgcctgccgaacgtcagcaacgtgcatacgtactgcaatcgtgggcgattaattttgggtacgcgattggaccgattgtggccaaccagctggtcaagatctcgtattcgctgatgttctacgttgaagcggcggtgatgatagccgtcacgatattgctgattgcgttcttccgcgaggtgcggcatttggggattactgtatcggtgccaagtgcggtgcgccatgaagacgaatgcagtgttacccatgcggaattcgccggcattgagaggccgaatcactcggatgccgcaccggctgccagtgtcaagggcgccatgtctcgcaattggcggcgcgtgctcaccgatactccattcctcggcttctccctgctgatgttcggctacttccttgtgtacttccaaagcacctccggcctgcccattgccatgacggaccttggtctagggctgggcgagtattcggtgctgctcaccatcaatggcggtatgttgtgcctgctacagattcccgcgatgaaactgttcgcgcgcatgggcaattcacgcgtgctggtgatgggcctcgccgtaaccgtcatcggctatgcggtgcaggccgcggcccattcttggggcggattcgcgcttgccgtagtgctgtggacgctgggtgagctgggcacattccctatcgccaccactacggttgccgccatggcacccgcgtcggcgcgcggcacgtatcagggcgtctacaacgtagtgtggtcggtgtcggttgcgctggcgccgctgattggtggctggactatcagcaacttcggcggtcgaacgctgtggatcgcctgcactgttgtgttgattgccgtgaccctcggtctcaagctcaccaaaggctcgcgcgaccgcgccatggcccgcagtcttcacgattcgctgtaagcgttattcggtttggagatacgggcaagaccgcatatggcgagtggttcttatcgagaactattctctgcgcgtatgatgtatggcatgcaatacattcaacaaaccatcgttggcattgatggcagcgaggcgcgattctttggctatgtggccgacaacagcgaggagatggaaccggaccgtatacgcccggccatcctgattttgcctggcggcggctacgccatgacttctgaccgcgaagccgagccagtggccctgcaattcctggccaaaggcttcgccgtattcgtgctgcgctattcggtgcagcccagccgctatccggtggctttgctggaggctgccgaggcaatgcgcctgattcgcgccaatgcggatcagtggcatgtaaaccccgcgcaagtggccgtactcggcttttccgcaggcgggcatctggccgccaacctcgccacctcggtcggcgacgaagacatccgcgaacagggcggcatagacccggacgccgtgcgcccgaacgcgctgatgctctcgtacccagtaatcaccgccggcaagtacgcccatcgcggcagcttccaatgcctgctaggggaccaagctcacaatcaggctttgctggacaagttctccatcgaaaagcacatcgatgccaaaacgccacccgtcttcgtctggcataccatgaccgacgacgccgtgcccgtggagaacacgctaatgctcatccaggcctgccgggccgccggcgtgagcattgaggcgcacctgttccctgaaggcagccacggcctgtccttggccaatgcggaaactgccggtaacggcttctatgcgcacatcgtcgaatgcgtgcagtgttggcctgatttggctgaggcctggttgcgtcgcctgttctaggcaaaacgctattacgctgtgcgccaagcgcgccacgcggttatggaataatggcaatcgtatgcatcggcagcagttgcgccggtgtccataaccgcgcagtcctgtgcgtccagccgggagagaaaacccggcagcggccgcaaggctgactactccgcggcaataccaaggagaacattatggatgatctcaaagatcaatccgcagtgtccacgaccgcaacgaacggggtcgtggaatcggaagaggtgcgcgcacaggaagcgctattgggggatactgatccaagtctgaccagcgccgacgacgtggccaaagccctgaacgtcgacccatcccacggcctgagcgaggaagaagccaagcgtcgactggccaaattcggcccgaatgagctcgccaccgccccgcccgtaccgaaatggaagaaattcctggcccagttccaggacccgctggtctacctgctgatcgcggccaccatcatctcggtgatcgcatggttcatcgaaaaggccaatgcgcagcccggcgcggaaggcggtgaagtgctgccgttcgacgccatcgtgatcattttgattctgatcgtcaatgccgtgctcggctacatgcaggaggccaaggcggaggccgcggtcgaggcgctcgcccaaatgacggccccgcagacctcggtgctgcgcggcggcaaagtcatgcgcatcaacaccgccgacgtggtccccggcgacatcatcgtccttgcggaaggcgattcggtctccgccgatggccgactggtcaacgcggccagcctgcgcatcgccgaggcctccctgaccggcgaatccgtgccggtcggtaagaagccggacacactcaccgaagccaaggcgctgggcgaccgtgccaacatgatcttcaacggcacttccgtgacgcaaggcaccggccgcgcaatcgtgaccggcaccggtatgaacacgcaggtcggcaagatcgccgacatgctctccgccaccgaagatgagaaaaccccgctgcaaaaggagatggattacgtctccaagatcctcggcattgcggtgtgcgtcatcgctgtcgtggtgctggtggcgctcgccgtgctggaaggcttcgacgacgtccatgacgtgattgattccttgctgttggccgtctcgcttgccgtggccgccgtgccggaaggcttggccgccatcctgaccgtggtgctggcgcttggtgtgcagcgtatggccgcgcacaacgccatcgtcaagaaactgcattcggtggagaccttgggctccgcttccgtgatctgctcggataagaccggtacgctgacccgcaacgagatgaccgtggagcgcgtggtcaccccgtccggcgcagtgcagatcaccggcactggttacgcgccggaaggccgcatggttatgaccggtggcgtcagtcctgaatccgagcaggcccagattgtggccgatgaagtcgtcgccacgcttgtggccggcacgctcgcgaacgacggcgaactacgcgaggagaacggccgttgggagattgtgggcgaccccaccgaagtctcgctgatcgtggccgcacgcaaggtcaaggccgatcgcaagatcacgcgatacacgcgcgttggcgagattccgttcacctccgaacgcaagcgcatgtccatcatcgccaaggacagcaccgattcagacaagctcaccgtgttcgccaagggcgcgcccgacgtgctgttgagctactgcacgcgcatccgcgtgggtggtcaggtccgtaagctcaccgaaggcgatcgccagtcgattctcgccaccgtcgaacgtctctcctccgaggcctaccgtacgcttggcgaggcctgccgtccgctggaaaccagttctttggctgatgtgcccggtgtaagcgtcaacgccgcaggccaggtgtccgacatcgccgatcaggccgaagccatcgaaaccgatctcatctggaatggcatggtcggcattatcgatccgccgcgtactgaggtgcgcgactccgtgaccgaggcccatcgtgccggcatccgcacggtgatgatcaccggcgaccacccgctgaccgccgcccgcatcgcctccgaccttggcatcatcgccaaggacggcaaggccctgaccggcgaccagctcgaccagctgcccgatgaggccgcactcgacaaggccacgtccgaagtgtccgtgtacgcgcgcgtggcccccgagcacaagctcaagatcgtcgaatccttgcagcgtcaaggcaacatcgtggccatgaccggcgacggtgtgaacgacgccccggcagtcaagtccgcggacatcggcgtggccatgggcatcaccggcaccgaagtgaccaagcagagcgccaagatgattctggcggacgacaacttctccaccattgtggccgccgtacgcgagggtcgcgtgatcttcgacaacatccgcaagttcctgcgctacctgctgagttccaatgtgggtgaggtgttcaccgtgttcctcggtgtggtgtttgctggcttcctcggcatccgccagccggaaaccgtgggcgtcaccgtgccgctgctcgccacacagttgctgtggatcaacctgctgaccgatgccgcgccggcgttggctatgggcgtggacccgcagaccgacgatgtgatgggtcgtaaaccgcgtaaggtgacggaccgcgtgattgacgcctccatgtggggcgacatcatcttcgtcggcgtcattatggccatcgtcacgctgattggtatggacatgcacctatccggcggcttgttcaccgaccgctcggtggatgccatcggccatgaagcgcagatgaccgaggcccgtacgatgggcttcacgattctggtgtttgcccagctattcaacgcgctgtcctcccgttcgcatctgcagtccgcattcgtgggtctgttctccaacaagtggctatggggtgcgattggtttgtccgtggcgctgcagctcgtggtgatttacgtgccgttcctcaacggtccgttcggcaccgtggcattgagcccgatggcttgggtggaatgcatctgcctggccgcaatcgtgctgattgcctccgaactgcgcaagattgtgctacgcgcgatggccaagcgttaagccatcgcaatagccctgattgtgggcatatagcagtgggccgggctctggtattcagagcccggcccactgctatatccaaacggctcctcatggggcggtaactatcccatggggcggtgatttcctcatggggcggtcgctgaaaacggcattattccgcgaaaaaggaaaatgtgctaaccgccccatggggaagttaccgccccatgggaaacaggagaacgctgcagacctcagttgttgctgccgtcggtgccgtcagtagaggtggagttgtcgccgccgttattgttggactcgtcttgagacttctgctgtgcctcttggtcggccttctgctgagcctcttcctgagcttgcttggcggcatctgcctgctgcttggcctgcatcgaggcggtgacgtcggactcggccttctgcagtttagaaatcgcattgttgacgtcggattcggacggactggtcccgttcatcaccgtattggcctcggtgatggcgttttgcagcgcggtgcgggtgttttcatcggccacactgcccgcggaattatccagcgtgccctgcgcctgcgaaatagccgagctcaggttcgatttcagtgtgttggtatcggccgtcgcctttgaagtattaacggccttgatcgcgttgttgatggcatccgtcttgtcagccatgtcgctggcatcattctgcagctctttagtgtgagacttcaactcagtggcgttgaggttggaatcgcacttggcggtgtcagccggattgccggcgtcttgcaacgcctgattcagcgtggtgagcgtattggcatcggccacatcgctggtggatgtttgcgcgctggtttggccattggatatggcggtggtgagcttcttctgagcattcgtgtactgcttggccgctaccttgcactcggccaatgccacggcttggctcgccttgctgctgttggaatgccaccagagcaggccggcgacaaccagcgctatcacggcgactactgctacggcaatgctgatgatcttgcgggtgttctttttgccgctaccgccgtgacgaggctcggcgccatcggaatcgtcctcatcggagacctgatccaacggaatggagggaggcatcacagcaggctgagcctgtgccgaagcggccagggcggccggttggaacacctgtgtggctgcagcatcatcggcagacgctacttgcgttgccggcatggtaacggtctcaccggatacggtggatgatgcgccgtatgcctgtgtggccgcagctgaatcaggctggaatgcctgtgtggccgcggtttcggcattcggcatggcctgagcttcgaaaggctgtgttgccatgacctgatcaggctggaacgcttgtgttgcctcggcatctaccgcaggctgctcggcctgattgggttggaacgcctgtgtcgcggcgtttgaagctaccgaaacaggcgatgtcgccggtgccgctggtgcggctggtgctgctggcgtcactggcgctgtcggttccaccgggcggaagctttgcgtcgtctgatcccaaacgtattgctgctggccgggcgcagcggcgattggtgtttcggatactactggctgcgtggctgccgccggctgtggtgcttgtgcggcaaccgcagccgggaattgcggcgagaacggttgcgtcatggccggatcgatgggctgcgtcggctgagcggcttgtacgggcggcacagcttgcgtgggttgtgaggcatacgctacttgcgcgggctgcacaaactgtgtgggctgtgtgggctgcgcagactgcacagactgcgggaactgcagagccggtgtggcttgtgccgtgggttctgtgctatatgctgccgtctcttgcccgggaatcggaggaaccgttggcctgaccggcttttcgggctgctggaagtcgaactggaacccgccatcgctgttggtcatgacatctccttgggattaagcaaatggccggcatccgccggccgaatggtacgtcgcaacgctcagtcgtcgatgtgcgcgcggtagaaattctcgtaggaacggctcggcgtcggaccccgctggccctgataatgcgagccggtgcccttggagccataagggtgctcagcgggcgagctcagctggaagaagcacatctggccgattttcatgccaggccatagtttgaccggcaacgtcgacacattagacagctcaagcgtaatatgcccctcgaaaccggggtcaatgaagcccgcagtcgaatgggtgagaatccccaatcggcccagtgagctcttgccttccagacgggcggcaatggacgggtccaacttgacgtattcccacgtggaacccagtgcgaactcgccggggtgcaaaatccacggttcgtcgggagccacctcgaactgttcggtgagcgcgccttggttttccgccggatcgacataggtgtaggcgtggttattgaacaaacggaagtaccgatccaatcgcacgtcgatggaagcgggctgcaccatttcgggggtccacggatcaagtgagatatgacctgcggactgtgcggcgagaatgtcgcggtcggacagcagcatgtgaaaaactccttgggcaaataaatactgccttcaagtctagcgccttgggcggaaacgtgagaggctcctcacgcttccgcggtccatcaatcgcaagtattctcaggtttttctcagagaaacttagaggtagacccagaaagcagtggttatataaaagatgtcagcggaaagctgatcaggagccgcagcagttcccgacaattgaaccccctttcttcttctctctcctttctctccccggcgggcaaccgccggggttctttttgtgccctgaatcattcccccgaatgaccgccattcccaagccatagcggtacactagctgtgtaatcggcaggaaggggggcaccgatggcccgcaacgatgaggactacgatttcttcggcgatggtcagtatgacgattcgcgcagctcacgtcgtgcacagaatcgacgcccatccaggcgggatgccggccggcgattcgccgctacaaaagccagcagcccaacgtcgatattgtgccgcagacttgccgttgtcagcggactgctagccgtcgtggtatcggccacctcggcggttcatgagatcgcgccttacgccatttcctttatgacggcagtgccaggacgatacattgcgttgatggcggcggtgcttatcggcatcaccctgattctggtcatcgctgcgcgagtcaccatgcctcggtacgccactcacgggggagtgggcgcgggcggcatcatcgcactggtgtgcgccatagtttgcttggttatcggcgtggccgtgggcgtattgttcccggaaggactgattcagcagtcgaacgacaaggcacccgtcgaagataccgcacagatggagcaaggcatcgaacaagctgccggcgcgtgcaaagaaggatggcaggggcttgatacgggcggtttgccgggcatcaccaccgtacagatgtgcactgatccgagagtggccttcgtatcctttgaatcggaatcgtccgcagccatcagccgggcacctatcgaaagcaagatttccgaactgctgagccaatacgctgataatgagcaaacgaaaggtgattggcgattgctgaacggcaaacgctggatggtgttcggcgaggccagcaagatgaccgcactgcagcagcagtggggcggcgaacttgagacaatcaccgcagccgcagataccgcagacagcggtaacgcctgacagattgccggtatcccttgaaaagtcccaaggcgattcggcgcggattacccaatgtgattgaaatcatggtccatcgttttccgcacagcgcgcaagacctctatattggaatggtatgagcaaagaagcgaatgccagccagcctctgatcggccgcgaatccaccactgtgcccggacgttttggcgagccactcaccgtggagcacagcgtcacctcgcgcggcggcttcgaccagcatgccgcgcatccgctgttcctgtgcctgcacggatggggatccagcgaagaagacatggcggacatcatgcgcctcatcgctccatataacgatttcgtggcattgcgcgggccgctgacactcgcgccggcccgtgagggcagtctcgaccccggcaactacgcgtggttccacgatgccctgcctatcggcgatgatcgtgactacgacgcgtatgccgccgccacagcagtcgaccgatgggtggccgacaacattcccgccgaccgtgacgtggtgccgcttgggttttcgcaaggtgggttggtcgccgtgcatttgttgcgtatcaatcccgagcggtaccgggccgtcgtctccctgtccggcttcaacgcacccggtcaggtgcccggcacggcccccgccgactctcgcctggccgattatgatatccccgtgttctatacgtacggcaagaacgatggcgtaatcccaaaatacgaactgttcgccaccgccgcttggctggaagagcatacgtggctgaaaaccaagagctaccacggtctggatcacaatgtgagtcttgaggagttcgccgatttgcgccagtggctacttgacaacgacattacctctggcgtgctgtagtcagccgccatcactggaattggcgcggccgtcgcagcaatcggacatcgagggcgcttgtggctgactcggtcatagactgttctcccatgagcgaagtgagcactgcgagcactactgcacatactgaagagaatcatgtggacgagtccccgcgcggcatcgcggttatggttgtggtgggcgtgctggtcgggctgttgtccggactgttcggcattggcggcggcaccatcatcgtgcccgcgctggtctggctcggcctgacccagcggcatgcggccgccacttcgatgttggcgattgtgcccacctcggtgtccggcgttctggcctatgcggttgaaggcaatgtggattggattgctgcgctgctgatgttcctgggcatgttcatcggcggtcagattggttcgctgctgttgtcccggctgccggaagtcgtgctgcgctgggcgttcgtggtgtttatggcgtttatcatcgtgagccagcttatttttataccttcgcgtgattcgtcaatcgaatttaatctggttactgtcttgctgatgattgttttcggcgtgctcgccggtattttggctggcttgctgggtgtgggcggtggcgcgatttgcgtgccggctttgtcgatcctgtttggcgcgtccgatttgatcgcgcgtggtgcttcgctgttgtccatgttcccgaatgccatgaccaccaccgtggccaatgtgcgccgcaaaatggtgcatgccaaagccggtctgattatcggcattgtggcggcactgaccgcaccgctgggcacttggattgccggggccatgagcccgcgtgccggcggaatactcttcgcaacctatctgacggttctgctgattcgcagcatctgggtagccctcaaagtcacacgggaatagcaatccccaacttggctcccctcagagaagggagccagggaaactagatgccggaatcagcgtccacttgcataacgtagatgttgcgcctcagggagcgggcttgggctcggttgatgtcgccggcttcgtacatgtcctgaatcataccgagttcgataccgtagctctcgcgctttacgtcctcgacctgcgtgatggtttccgtagtgccgctcatggtcggacgtgcctgcaatgaagcctcggcacgacgataatccagcaacagtgccgaacaatgctcggtgttgtacgtatcctggcccatctcgtcaataagccggccgataacatgatgaatcgcctcgacctgcagttcgcgggtgcgcgcgaaaatctggtcctcgctcaccaatggtgtggtgtggcgaatcttggacaccgtgcgtttggcgtaattgctcatctgccgctggaacatgcgtacacgaccgcgaatctgcgataccgcgtgccccgaagtcggatcagtggaagtgtgacgcaacgtattcataatctggtcaagcatgcgctcgcaggtttcgacgttcagctcttgcgtggccgtatccgccgccggatgtgctttggtgtcggcaagccggtcgcgcacgaattccttttcccaatgcagcgcttcgatctgcaattgctcgaatccctggggatcggtatcgccgatgcgctgctgcaatcgcccgatgcgcttggtgtactggtcgattaccatcagaatcgcacgacgattctctggcgtgatgcgtccggtcaattcctccaccgtggcgcgtaacacatcgatggtcaccggaattatttccgcgctgggatccttgccacggttcggagccaatagcggtaacaggaagttggccagcagcaaggtcacgataatcacgcctgacgcaatgaaaatcagctcgtcacgcatcgggaacggcgcaccgccggcaatgtaatacgggatggtgaacatcaatgacagcgtgatggttcccttggggccgccaaaggtcatcactgcggccgagcgccagcgttcgggtgtcattttgcggcgctggccggagattgtatctcgcgcaacgcgcagcatggccgcaatccagaagaatcgaagcgcgattaccaccagagtgaccagcagaataatgccgatcagcgcgatattgctgatatacgggtcagaccagctggccatcatggcgcgcggcagctgcatgcccagaagaatgaacaccgcaccgttgagcgagaaactcagcacaccccatactgaagtggaaacgatattcgtgcgtgccacattcggccccacgccggtgcggtcgaatcggatgaacaggccagcggccaccaccgacagaatgccggacacattgaattcctccgcgcccaaatacagcaggaagggcaggaacagttccatcagaatacgtgtggtagtggtttcccagccgagggatcgcacggtctcgaatagccagttggccgctgctgctatcaccaggccaaataaggtgccgccaaagaaggagatcacgaattcgccggcggcctgccccacggcgaattctccagtgaaggcggcggccagagcgaactggaagccgacgatgccggaagcgtcattgaagagtgattcgcctttcagcacgctgcgctgacgctgcgtcagcgaggcttctttaccgagggagctgacggccaccgcatcggtcgggccgagtgccgcgccgagtgctaaggctgaggctaaggtgatggacggccagacggcatgcaaagtgaatccgaccgccgccatcgtgacgatagccagtccgatagccagcgataggctcagatccagcgttttcagcaacgccgacttatcgatttcgtgggcttccaaatacagcaatggcgcgataaacagcaccatgaacagttccgggtcgagcgttgcatccgggaaaaacggcagatacgtaaccagcacgcccagcacaatctggaccagcggcgtggagactttgggcacgaagcgactgacaaacgagctcaccaccaccgccgcaatgatgcataggatgagctcaaataccgccatgttgccgccttctcccttaaatttttctccaccaaaaagtatatgggaaccatgaagaaaacgttaagcttgcggccgattatgcacatcatgagacgatatgagaaaaggcatacactcgttggtatggaatatgacgaggcgatgcgctgcgcactggaactggccggtcaggccgcagccgctggtgacgtaccggttggtgcggtggtgctggatgcggccggccagattgtcgggcgcggatacaacacgcgtgaggctgatggcgacccgcttgcccacgccgaaatcatcgccatgcgtcaggcggcccaagccttgggcgcttggaatctcgccgattgcacgctggccgtcacacttgagccgtgcccgatgtgcgcgggtgcctgcatccagacccatatcggcaccatcgcgttcggtgcctgggatcccaagctcggtgcatgcggttcgatttgggatattccgcgcgatccgcatatcggccatagtcctgaagtgcacggcggcgtgctggaaggcgagtgtcagtccatcctgactgatttcttcgcccagcggcgatagacacggacgcattacttacctcacgcaaccaacacgcggcaccaaggcaacatattccatttcttctaccatcgaaaccagtagtgcaatgcaaatccacacacgtcgaaggagacaatatggccgagaacacctccactttcaccggcgccgccgctgacggcaccgcactcaccgccgtctacctgacccagcccgccgccaatgtggcgatcggtctggtgtttgccggcagcgacctgccgcacatcgtccactggggccgcccgctggccaagcccgacaccctgctggccgcctatgacgccctgaagccgcagcgcgtgtccggcgcgctcgacgacaccgcctggccgtccatcctgcccacccaggccgaaagctggatcggcgagcagcgcgtggtgctgcgccgcgccggcgtcgagctcttccccaagttcaccgtgaccaatatcgaggccggcggcgtgctggaagccaccctcgatgccgtgtccggcgaaagctacaccgatgtggccggccatgcccgtgccaccggtccggtccgcgtgcccggcgtcatagtcaccgcgcgcgatgaggagcagggcgtggaagtcgaatggcacctcgaactgctccccggcggcctggtccgtcagaaggccaccgtaaccaacctgttcggtgcagacgccggagccccgctcgagatcggcaagatcgagctcggcttcccgctgcccgaatccgccggcgaaatcctcaccaccaccggtcaccatctacgtgaacgcagtccgcagcgccagccgctgaccgtcggccgtttcgaaaagccgcagctcgccggccgccctgacttcgacgcatccctgctcctgaccgccggcgtgcccggtttcggcttcgagcatggcgacgcctattcggtgcacgtgggctggagcggcaactccgtactgtccgccgaacgtctgccctacacgaccggcgtaatcggcggtggcgaactcctgttcggcggcgaagtgacgctcgccggccccggcgaaggccagaactcctacgacaccccgtggctgttcggctcctatggcgatggcctcaatgagatcgccgcccgcttccactcctacgtgcgctccctgcatccgcgcctgttctcgcacggccgtccggtgatcctcaacacatgggaagccgtgtacttcgaccacaacttcgatacgctgaaggcgctcgccgacagggccgccgactccggcgtggaacgattcgtggtggacgacggctggttcggctcccgccgcgacgacacctccggcctcggtgactggcagattgcgcaggacgtctggcccgatggtccgaagtccctgaaggcgctcgccgactacgtgcacgccaagggtatggaattcggcttgtggttcgagccggaaatggtcaaccccgattccgacgtggcccgcaaccaccccgattggattctttcgcccaccaccggccgactgccgctgcagggccgcactcagcaggtgctcgatctgaccaatccggatgcgttcgactacatctacggctgcatggaccagcttgtcggcgagcttggtatcgactacatcaagtgggaccacaacaagctcgtcaccgagcccggttcccgccgctccggccgcccggccgtgcacgcgcagacccttgccgtctacaacatcttcaagggcctcaagaccgcacatccgggccttgagatcgaaagctgctcctctggtggcggccgcgtggatcttggcatcctggagcacgccgatcgtatctgggtctccgactgcgtggacccggtcgagcgcgcggacatccagcgctacacctcgctgctggtgccgccggcgatgatgggcgagcacgtgggcgccagccccgcacactccacccagcgcgccaccagccaggaactgcgcatggccatggcgttcttcggtcacatgggcatcgaatggaacctgttgaaggagccggacgaggcgctcgccaagctggccgtgtgggtggccgaattcaagaagcaccgcgactggttcgccatcgacacctgcgtgcacgccgactccaacgatccggccgtgcgtctggacggtatggtgatgccgaaccgtgacgccgccatctaccgcttcacccagctgaccaccagccagacctatccggccgcgcccgtgcatctgcccggacttgaccccgagcgcacctaccgtgtcagcccgcttgacccgagcttggatttgaccggtctgaccaacggccagagcactctcggctggtggaacgaggaaggcgtagtcctgaccggcgaagccctgcagcgctacggcattcgtcccccgtccctccacccccagcaggcagtattgctcaaggctgtggcgttaagctgacagcctagtaggctgtcagtagccacggcctgagcgaagcgacagctgagcgaaggtgggattgagccttgccgataggcaagtccgtaattgctggtcgtggcggagtaactgtggcgaagcaacgttcttggctcccctctctgaggggagccaagaacggcctacccaatatgcttcacaatcacgcgactggcggcggctttggcccagagctgccagtcgtggttcataatcgtgaacttgaccggctgggtctggctgtgacggtagaaacgaatgccgtcacgtagcgaatcggtgccgagcttggccaaaaacgcggactccccggcaatcatcacatgcccgggcatcgcgatattcgccaccgtagccaccagcgatcccaaccggaaacacgtccggttcaccaactgcgtggcctgcggcacgcgttccttggcatcgcgcgcaaagtcctcaaaactgaccgcgcgacccacaatcgcagagtactgttcggcgattgaatcgtcagtcaagcattgtgaacagccgatatgtccgctggtgcagcgcggcccctccggatcgataagcacgtggcccaccagaccatagctcttatccgggtactgcactggcttgccgttcacggccagcgaataaccaacacccacgccgatggtcaccacggcgaacatatccacgccgacacccggcccgaaccaggaggcatccaccagcagagaatcgatatcattgaacaccccgcacggcaggccggtcgcctctgtgaccatcgtccccaagtccgtggccccgtcccaatgcaggaacggcgcgaacgtcacaatcgaatcgtcgaccacatgcccacctaccgcaacgcccaccgcagtgggggagggtagtccggaagaggcgatatcggcggaacattcgcgcaccagccgcgtgatggccgacaccacatactcagccgattgatccgccccgatcggcacctcgtgccggccggacaccacctcgccatgcgcgttcaccgcagcggccacaatcgacatcccatgaaccttgacaccaatgaaggtgcgtgcgttcgaacacaacaccagcgaagtctgcgggcgtccgcgacgatccgaactttcccttggcgtgaatcgctcgggcagcttgcctgacgggccggcctcggccggaagctcctcgatcaccccggcgtagatcagatcgctggtgatgcgggacaaggccccttggctcagtcccagcatctgtgccaacgtagtgcgggctatcggcccgtattgggcaattgccgccgccacgcgatgcgtatgctcggatccggaaaaccactgtggaatcgcgttggcatcagacatgcaagccccccctcgctgtatttattgcgttaatcacaaaataccgcgctttttgttgcttgcgcaagtgggctcgctggcgctgggaatgaaatggccgaaccgttatcttagaaagtggaagaaccgccggcatcgaagccggaggaaaagaaagataaaggagtcaacaattatgctgtccgattccccacatgcaacgcctagactgaagcgtctggccgtgcgcaccgccgccgtggtgtgcgcgattgccgtcggcttcggcctggcaggctgcggctccagcaccgcaggcaccgtcacgctggatttcttccagttcaagtccgaggccgccgaccagttcaagtccatggtcgccgattttgaaaagcagaacccgaccatcaaggtcaatatcaacaattccgccaacgctcagaccgatctgcgcacccgtttcgtcaagaatcgtgtgccggacgtgatcaccttcaatggtgacatcagctttggcaacttcgccgcctccggtgtgttctacgatttcaccgacgaacccatcgtggacaccctcaaccccggcatggtcgagatcgccaagaatctggtgcagaccaccgattcctccaagaagcgcctgtacggcctgccctttgccggcaacgcctccggctacatctacaacaaggctctgttccgcaaggttggccttgacccggagaacccgccgaccacctggagcgagttcaccgatatgctcaacaccttcaaggacgccggcatcaacccgctgcagggttccgtggccgacgcctggaccacccaggcaccgctcgcctccctggccggcacgctggttcccgaatcgaagtacaccgagctcaagcaaggcaagaccacgttccaggaactgtggaagacctcagtcgagaaggaatccgagctcttcacctactccactgcggacaccggcgtcacctaccagcagggcacgcagaacttcgcccaaggcaaggccgcgatcatcccgctcggcacctacgccatcccgcagatcctgctgatcaaccccgatatcgaacttggtttcgcccagatgccggccaccgatgacgccagcgagcagatcctcaccgccggcgacgacgtgatgctcaccatcggtgcggacaccaagtaccccaaggaagcgatgaagctcgtcgaattcctcatgcagaaggatcagcttgacgcctacgccgacgcccagtccgccatcacgccgctgaaggacacctacttcggcaacgatgcgctggaaaccgtgcgcccgttcttcgaggaaaaccgactggccgacttctgcgaccactacattccttcgtccatcaacatcggcggctacctgcagaccatggtgacctccggcaacaccgaccgtttcctgaaccagatgcagaccgaatgggacaaggtccaagccaggaccttcgagtgatcggtaggagaggagaacatcatgtcacacgcaaccgcaaccaagaccgctgccaagaaacccgccaagaagaaggtctccgccttctccacccgcaaggtggaccccgcttactactggatggtggttccggcggccattatcttcgccttcttcctgtacctgccatttcttgatggcgtaaagtattccttcaccaactcgcagggctacggcgattacaagttcatcggactgaagaactacatcgccctcttccaggacaaccgcgtgggccacgcctacctgttcacgttcctcatcgccatccttatcacggtgctgatcaacgtgattgccctgttcctgtcggtgctgttgaactcgaagatcgccttcaagaatggcttccgagccatcttcttcatcccctacaccctttccgtgctggtcatcggctacgtgttcaagtacatcttcatgaaccctctgcccgagctcggcaaggcgctgggcatcaagtggctgtccacctcgctgttgaccaatgagcagcttagctggatcccgatcgtcttcctcgccgtctggcagggcatcgcctactcggtgctcatctacctcgccggcctgcagaccatcgacgacgaaatctacgaggccgccgccatcgacggcgtcaacgcctggcagaagttctggaagatcacattcccgctgattggaccgttcttcaccatcaacctcgtgctgtccatgaagaacgcgctcagcaccttcgatcaggtcgtcgccttgaccgagggcggcccgaactcctccaccgaaaccgtcacctacctcatttggaagggtggcctgaccggtggcgagtactcctaccagaccgcaaacgccgtgctcttcttcatcgtgctggcgatcatcgccttcgtgcagctgcgcatctcccgcagccaggaacagatttgatttaggggaggataagaaatgactactgcaacagttaccccgtccaagtccggcaagcccgccaagttccgcagggaccacaagatcaactggtggctgaccgccgccgtggccgtgctgagcctgaccattctgatcccgctctacttcaccatcgtcaccgcgctgaagactccggccgaggccggcaccttcgccctgcccacctcgtggcagtggcacaacttcgccgacgcctccgccaaggtcaactacccgaaggccgcgctcaactccgcgattatcacggtggccgccgtggtgctcaccttgctgaccaacaccttcgtggcctacgctgttgcccgcaacatggacaagcgcttcttccgcttcctgtactacttcttcatcgccgccatgttcgtgccgttcccggtcgtcatgctgccgattgcgaagcagatgggctccctgcatctggacaaccaggtcggcctgatcatcctgtacacggtgcttggtttgggcacgaacctgttcatcgccaccggcttcatccgctcgattccggtttcgctggaagaggcggcccgcatcgatggtgcatccacgtggcgcatcttctggaccatcatcttcccgctgatgagcccgatcaacgccactatcgccatcctgaccgcgctgtgggcctggaacgacttccttctaccgttgatcatcctgaccgaccagtcgaaccagaccatcccgctcgcccagtacgtcttcagctcgcagttcgccaccaactatccgatggccttctccagctacctgatggccatggccccgatcctcgtcgtctacatcttcgcccagaagtgggtcatcggtggtgtgatgaggggggcggtcaagtaaaacagcgcaggcgctgctttacttcaccgcgtcgagcgagacgagccgattaaggaaacagccccgtgggctgtttcccggcccgggcggccggataggtcgcgtactcgcgaggtcatgttgggtctggccgtaggccagtcctgaattgcaggactctgtgaagtaaaggtccgcttccacccaagcctcctccggctctcaccggaggaggctcttctgtcctgttgccatactggaaaccgccacaataaaggcgacggtcggttgatgtggcggtggcgcacaaaggtcatgtggttttgctcgttgtgcgaatgaaaaagtgacgaaaccgtacggcttacggtgcaattgaacgcatctgctgtgtcgccgtgccactggcttgtcccggtccacatatcaaccgtttgacgcgcgaaccgggacagaatccgctgtcccggttcgcggtttcgggcgattttcacgaaccgggacaattttcattgtcccggtatgaatgtcaatcgttttatgtgaaaaccgggacaacatgttgattccgggatcggctctattccgccgattttgtattacggagcatatgaactgcggagattggcttgtccctgtttgtaaaaaaaggacaaaaatcgcgaaccgggacagcggattctgtcccggttcagacggcaatcgattgacatacgaaccgggccaacgccgaagtccggagcggttcccgaggcggggtttgcttgaaatccggtgtgccagcgaaatccccaccagattcccgcaggcgtgtcaactaaatcatctatccccgcaccagtgggttcaagcagacaatccaagcgcgcccgaagttgctcttgcgcgtcgcaatcagaagaaccgttaatatgtgagctgccgcaggtcaggtagattatggtggcgaagtggcggcggaacaagcgggcgagctccttcataggttcgagcctcgagtgcatcatccacgagcacaggcgatatagccacacccacgcctcgaacaggagcatgaaccctctgccgggctcgaagccgatcgtgatgtgcggctcccgcccgtcgccgtcggcgtcacggaagtccgcagacccgaccctccaaggcgaccgcagccgaagcgcggcggtgaacaggtgagaggcatccatgcctccaacctacccgaccaacatcaccccacggcacagtcacccaccacaaacagcgaaagggcccatatgttgctaaatagcatgtgcagcttatgagaattgagccgtagcagtgccttccggctctttgcagtttttgtttccggcacaccaacgcagttccccaatggaaatgtaattcagcgctttttagactatgagcaacaggcaatgtagaccataaataatggaggagccaacgatgaccacttcacaacgcacagtaattccagattccatccgcaccaacggtgccaccccaaatccgtggtggtccaatgcggtcgtttaccagatttacccgcgttccttccaagacaccaacggcgacggcctcggcgatctcaagggcattacgtcacggctcgactatctggccgacctcggcgtggatgtgctgtggctatccccggtatacaagtctccgcaagacgataatggctacgatatttccgactatcaggacattgatcctctgttcggcacactcgacgacatggatgagctgctggccgaggcccacaagcgcgggctcaagatcgtgatggatcttgttgtcaatcacacttccgatgaacacgcctggtttgaagcgtccaaaaacaaggatgatgagcacgccgactggtattggtggcgtcccgcccgtcccggcaccactgccggcgagcccggtgccgagcccaaccagtggggctcctactttggcggttctgcatgggagtattgccctgagcgtggcgaatactacctgcatcagttctcgaagaagcagccggacctcaactgggaaaatccggctgtgcgccgcgcggtatacgacatgatgaactggtggcttgaccgcggcgttgacggcttccgcatggatgtgattacgctgatttccaagcgcacggacctgtctggcaagctgcccggcgagtacggttccgagctggacgatctgcccgtgggtgaggaaggctattccaacccgaatccgttctgcgcggacggccctcgccaagacgaattcctggccgaaatgcgccgtgaagtgttcgaaggccgtgagggcttcctcaccgtgggcgaggctcccggcgttaccgcacagcgcaacgaatacatcaccgaccccgccaacggcgagctggacatgctcttcctattcgagcacgttgattttgactgcgaaggcgtcaaatggaagccactgccacttgacctgccgaagctcaagagcattatggccggttatcaagcggccgtgaagaatgcaggctgggcaagcctgtttactggtaaccacgaccagcctcgcgtcgtttctcgttggggtgatgactcctcggaggaatctcgtgtgcgttcggccaaggcacttggcctgatgctgcacatgcatcgcggcaccccgtacatatatcagggcgaagagctaggcatgaccgacgcccacttcacgcgcctagaccagtaccgtgacctcgagtccctgaacgcttaccgtcaaagggttgaggaagccaaagtgcagtcgcccgaatcgatgttggcgggtatcgccgcgcgcggtcgtgataattcgcgtaccccgatgcaatgggacggctctgtctatgccggtttcactgcgccggatgccgctaaggagccatggatctccgtcaatcccaaccatgcggcgatcaacgcggccggcgaattcgacgatccggattcggtatatgccttctacaagcagctcatcgcgctgcgccacgacatgcctgtcgtggcggccggcgactggcatctgctcgatgcggatgacgcgcatgtctacgccttcacccgcaccctcggcgatgagaagctgctggtcgtggtcaacatgtccggccgaaccgttgatctaccgcgcgaaaccgccgaactggccgccgccggaatcaccgagtcgaacgtggtaatcagcacgtatgatgccccgcacgccgtggcctccctcgccaaccgtgagctcgatccttgggaggccgccgtcattcagctgtagcgattggagcgattgtagcggattgagtacctttctccgttcacagagatacttcagggctattgcgaaatgctatccgccttgaaagaggtaccgtaacgtcaaaaccccgagtataagcgttgaaaaatcaaggcttatacccggggttttcgatgctcggtacccctgtgaaaagcagatagctgtctgcaagaggccgaatgtacctctgtgaagcgagatagccggtgtctctcggcattgtggtgcttacaatggaaagctatggaacaaaaggatgttttgaaggcgctgcagcgtgatcatgcagccgaactgaagctggccgccaaacgtctcaaagggactgcccgtcatacggaaattatcccttcgccggtattgagcgagatgaccggtcatgagattctcctgaagccggaaaacctgcaggtcaccggttccttcaagattcgcggcgcgtacaacaagatcgcatcgctcaccgaagagcagatcgcccgtggcatcgtcaccgcatccgcaggcaaccatgcccagggcgtggcctatgcggcccgtgagcgtggtgcgaaggccaccatctgcatgccgcagatcaccccgccgctgaaggtcgatgccaccaaggcctacggtgccgacgtggtgctgtacggcgatgtgttcgatgaatccgccgcccacgctgctgagctcgccgacaaggaaggcatgatttacgtgccgccattcgacgattacgaagtcatctgcggccaaggcaccatcggtctggagatccttgaagacgtgccgaacgtcactgacgtggtcgtgccgctcggtggtggtggcctgggtgccggcgtggcgctcgccatcaagacattcaagcctgaagtgcgcgtaatcggtgcgattccggagggctcaccggcctggaaggactcgctggccgcgggtcgtgtgtctccggctgaccatgtggttacctccgccgaaggtgttgcggtcaagcaccccggcgacctgcccttcgctctgattaacgagttcctggacgatctggtcaccgtcaccgagcgcgacatcaacgaaatgattctgctcatgctcgagaagcataagctggtggtcgaggcggccggcgccgtttcgctggctgcgctggaacacctgaacctgcgttcgcgcaagttcgccgccgccaccggcccgcacgtggtggttccgattatgtccggcggcaatatcgacaccgtgaccatgggtgcggtgattcagaaaggtatgatcgcccgcggccgcatcatgaacttcgaggtcgagctgccggatactccgggccagctcgtcaaggtggccaccctgcttgccgagcagcgcgccaacgtcattcagcttgatcacgaccagttcaaggcatccggccactacaccaacgcggtgtctctcggcgtcacggtcgagaccaacggccccgagcacatcgaccgcatcctcgcggcactcagggaagccggattccagcccaagcgcatctactgattccaataccgctggcgggaagccgcgcagaagtgtgctccaatacctcccgctggcgggaggtggcgcaaaagcgccggtgggtggttaaccgacaatcatcagttgcttaacccacccaccggcgctttcgttatgctgagggctacttgttctccgcaatcgtctcgtccaccaacttcggcagggcaacggcgatatcctcatgaatcaagcggctcgcaagatggtcatattgcgtgtgacccatattcataatggtgatgggcacgcccgcctgcgcggccaccggcacaatgctcgccgccgggtacacctcaagggtcgatccgattacccatagttcgtcggctttggtggccagactgtacgacttctccatcgcgccgtccggcaacgcctcaccgaaatacaccacatcggttttgataatgccattgcacggcatatcgccacgatacttcagtttgcgatggcaatgtgggtcgggctcttcatccaaacgggccatgatgtccgccgtggcatattcctgatggcacttcatgcaatgcgaggtgccgatagtgccgtgcaggttcacgatgacgttgtcgctgttgccggccttctcatgcagcgcatcgaagttctgcgtggccagcagcgtcagcatgccggcttgttccagcttgaccagcgccttatgcgcagtgccgggctgcgcattccatactggcgattccttttgccagcgccaggagtactcgcggtcctctttgttgcgcaggaacagatcgatgtcgtaaacgctcatttggtcaggatgcttggtccacacaccgtccggaccgcggaaatcagggatgccggcggacgtggaaatgcccgccccggttaatacagcaatcttcttggtcataactacaggtatacccgcgattcatgaacgaaatccgatgacggagcgctgtcatgcgccgattgtgcgccggcagtgtggttgccgagagatgaacgcagggccgacaagctgaaaactctcgcgacacgccagccgaatagtggatttgatgcttttcagaaacatttgaggggttaacctagcctcatcagagcaaagtgggctctgtgcgacacgccgagggaaccgcgctgttatgccgattcctggggtttttgtgcgccttgatttgcgtgaatccggacatgcgtgtaagttattcacctgttgccgctcagcgcggcgggttccttcctctggttggtttcccgtctggctggtgtggtggtggtttgagaactcaagagcgtgtttgtactacttctttatagtcaatgattgccagttcattcctcgcctgattgcctgtcgtggtggttgggtacccgggagggtttgatgaggggtg

SEQ ID NO: 28 - DNA, 71079 bp, Bifidobacterium longum
agcaacgactccgacaactacacaccctcaaataacccggaacgttaagccgggaaaccacatgggacacggccagccaccaagaccccgaaccgttccccggcttaacaacaaacccggcttaatccgagtggatgatcggcgtctcgccgggcctgagcgtggcgcacgcggactcgagcatcccgttggccaatgcggcgttggggctcgtgccgatcgtccaggcgaccggcatgccgtcgtagcagtcgatgaccggcgacaggtacaccttgcccgccgggatcctgaactcggtgatgtccgtgacccacagctcgttcgggttcgcggcgtggaagtcccggttcacgagattggccggcgcgccgccgatctcgcctttgtaggaactgtagcgcttcgcgctctcggacacgggcacgagcccatgggccgtcatcaggcgcatgacgcgtttcgcggagacgacgatgcccgcgcttctgagctcgaggtgcacgcgcttgtacccgtagcggcgtttgctgttctcgaacgtctcgcggatctggattggctacaatgtattggactggttcatgcgggacatgacaacgaaggagttgatcatcatggccggtccgaatcgtccccgtcattgcgaggaggagttcaagaggcagatcgtgcggctgtacgagaacggcaagccgtcgtcgcagatcagggcggagtgcggcatcccgcgttccacgctgcagcgttgggtgtaggggatacgtaacagcggctccacgaaagcggccgacaaccgcactcccgaggagaacgagctgatcgaattgcggaaacgcgacaggcagctggagatggaggtcgacgtttcagaacaagcggcgccggtattcgcacgaaagtaggcgtgatacggtccgacgccggccgttgcccggtatcggcgcagtgcgggatcctgggcgttgccaagtcgacctgctactgggtgctcgaacaccccgaggccgagcgcgccgacccttacgagaaggatgtggagcgcgtgtggagggacagcggcaaggtgtacggggccaggaagatcaggcacgccctggggcacgagggcgtgacgctgtcccgccgccgcgtcaaccggatcatgaagaggaacggcatggccagctcctattccaaggccgcctataggccacgcccggccaggccggacgacgacccggctcccaacatcctcgcccgcgagttcaatggctatgcgccgcgcacccatctggcctccgacccggcctacgtgagggtcggcagttcgtgggcgtacgtctgcctgcccggcgacctggccaaccggcagatcgccggccattcggtcggcgtcgggcacgacgccgatctcgtgttggccgcgttcgccgcgctgcgcttcccgctggatgagatcgaggtgttccacacggaccgcggcggcgagttcaccggggaacgcatcgaacgcatgctcgacgtgttcggcatcagacgttccctttccagacccggcaacccatacgacaacgcggtggtcgaatccaccaaccggctcgtcaagaaggaactcatccacaggaacgtctacacgaacgtggagcaactacgctcggacgtcaaccggtacgtgtggtggtacaaccaccgacggctccactcgaccctcggatacctgagccccgtggagttcacacaacaaggaaaaaccctctagaaacagtccaacaccctgttgccaatccattcaaatatgagatcgttcagttgtacggaaatagcaaggacaccaacggcccaatagcaacccgtaccaaaaacagcaatagctccaaattaattttcccaataccagttttcaaattcttcgcgcgtacgttctaccgaagtatcaaattcttctatagaacggcgcttcttatagaactcatcggtagagcatatgacgcgggcaggagcacctcctacaacacagccttcaggaacatcctttgttacgacggatccaccagcaacaatggagttagagcctattacaacacctggcatgataaaacaccccccccccgatacaaacatcatccataatttctatggtatcgaaatgagttttcagcggaacaaagtctttgtgattgcaatatcgaggattgacgttaagaaagttcgagaaaatatcatgattaatgaaggttacaccacaggcaatagatactcgatcatgtattgacacaagccacgagtccgacggaagagatgtaggttcaaaatggcattgctttcccatgtgatgaaaaatatgatgtctgcgaatataatctgcacgccatacgccatcctttcgacgaaaaaacgtcttcagcaaaagtgaatgaagagaaaccattctccgttcctttgaaaacgttctacttttacccataattcctccgactgttaatactattttctacgactaatatattctttagccgtgctgactaggtagttaaagttttcgtttttgcagatgacgttgaccagaacgtaaacaaatccaccgacaataagctgaagcaatagcaaaagtattttgttgatctgcagatagccaatgccaaacaccgcagcgcccatgaccaatgcctgaagtacattggaagcaaaatcccaatataaatccttcagcttgtaaccaatcgtcttattgcaacctatgctgtagagtatcaccccaaggatgcctaccagaacctcggaaaatgcgatataaattgttccaaagcgaactgtgacaatcagggaggcaagaccaaaaatcctgattgggatatccattttaagcacgaggtcacttcttccaattgctttaatcgcttgcagagatgcagtttgagcaggacggaaaagcaaattgatgcaaataatttgcaagaaaggcacaatgggcaaccacttatctgtaagtaatacggatacaaaagtagtgccacaggcagcaaagccaacgagcagtgggctcatgatgtacgaagacatcttgatggcgcgtctagtaatcgctctaacacgctcaacgctggcttgctcgtgagacatagccgggaaaagcgcgctactcattgcggcgtctacattaacgacaatcagattcggatagtagctgccacggtcgtaataggcgagatccttagcggaatagaccttgccaattaccaggcttctcaggttgccataaatagtcaccataagactctgaatgaggagtttccacccgaaacggaagagacctctaagtctttcaaaagaaaattcaagctttggacgccattcgatgatagttcgaagggtgaaggtattaataatggtattggacagatattgagctaccaaagcccacacgcccataccaaaatacgccattcctatacctatgatcgccgagatcaaggttcctatagtcgtagagtagaagaacttcttaaagatcatattcctagacacataggcctgctgcaccgaattaacggcagcaacgggaagctgcaacgccagcacacgtagcacaggaacaagaattggcatcttatagaaggatgcaaccaaaggtgcgataccaaagaaaatcacaagataaaggaacgttgaaaaagctatgccgaaataaaagaccgaagagaaatcaagtccatcagcatctttcttttgaatcagcgcaaccccaaaaccatcattaacaaaaacattagcaatggtgataaaaatagttaccagagtaacagttccataatcggatggcatgagcaaacgagctagaataattgtaacgataacagaaactagctgcgaactcattcgctcggcaaatttccaaaacaaaccactgataacagagtatttcatctgtttattagagtcattcattcctgtaccaacacttttctatgcgaatcacttctatcggaaataggcgtcagattacggacgaaataagaccgagagacttctcacgctccgcattaatatagctattgatgaaggtatagtcccattcataattcagcatgtcgcgagcgtcacgtgtattgtccgataggagttcatacattccaagtcgcttcaagaagttatccgccttcgccaagatgaaatcagaagcacagaaagccatcttcttattaaaaattagcgagaatgtcaagccgtggaatgtgctcgtcgcgatagcagaggagtaacggaagaggccaatccattcaaaaggtgtcaaatcggattgatggatgaggacatcacaccaatcatattggtcatcattgcaatcaaggcaaatgatttgaagactgttatctttagcatatgaacaaatctgctgaataaactcatcagagaaatcctgaccataaacaatcagataatcctcatactgcggtttaactatattctcgtcagtagtgaaatcccataaccaagttggatccaagacaacctctggacgagttccggtaatgtcttcgacgatatcggcggagtttttatcacgaaccgtgatgaagtcaagggaacgcactccgtcgaccacatactgaggatattcagaaccgcgtttaatggtgccaaaagtagcagcataagcgactttcttgtcggcctgaatccccacaccaaacagtttggggtcatggttgaaaatttcgaacgaatagtcccagactatatcgctgccaaacacgacggtattaaatgtcgtacttgcaaaatcggcggagctcattctctcggtatgaggaatggagagatagtatccagggaacgtttgcttgcgatgattgtagtttgaattcgggttaagaacatctactaaatttttgtagaaaacgggtttgaagaaattatgtccgatctccttcttgtagtagctgttgtaatgcttctcatcaagatatgcaatctgtttaatgtctcgaccagcacaacgcttatcgagaacacgttgcagtgcatatgcttgggcaaaagtaccgtagtttggcacatcccagaaggtcaaaatacccatatcataagtggacataattcactcctttaccgtttgatcagaaagaacgtaataagacaaaggaaaaataaggaacatcacagggaatgtgaaaacttccgttgtacacataatcaaataagccgatacggcatacaccgcgatctgcgctacctttttcggccaatattccagcgactttttgattatgagagcgatgataacaagcaacagtgcaagtgccactaatccaccttggaaagccacctgaagaatttgatcgtgacaatgcgttgcaccgacccacactccactcgacgatgaacccaaatagccaaccattgcatcattggtgagcacaccgtaccccaatatgggattagcggttatcacacgtagggcattgtcccaaatgttgagtcgtccggtaaatgtcatgtctttgcccaaagtcgacaccaaaggagcaaaaatgctatctgccctgaaaacaacaatcaaaagccatacgatgacggagataacgacacttcggattggagtaaatactagtttgacctttggaataatcatcagcagagagaacagaacgatacccacaatgccagttgccgagccgtgaataaattcagttacaacaactgcagccgttaatacgtatcctctagttttgctccgagtaagagcaatatacgcccaagcaacaaccagggcgggaaacagccactgcacaaaataattgtctacgcctaggaaccattcttgggaaactgcataaccggaaaccgatctgctgtatagtccgttaggcgcaactaatacagacagaagattcacatagacgcaaatctcacaatgcaatattaggacgcgaaccagcgtatatacatcgtttcgatataggtcgaagataaggcacactatcatgattcgcagcaatgacaaaattgcattatccatcaagccatgagagattgccgttgccaagaggatccacgcatacatgcatgccgaaataacggttacaattgaaagagctttgcgtgaaaaaacaagacgacaaagaagatatgcgtctacgacataagttagtaacctgttcaaatgaagcgacgtcgtaaagtaatctaccgatatcggcatgaataccggaatcagcaataagaataggatgactttcctttttgtgatatgcaccgacattgcgttcaccctagagagcaggacgtaattgtttgattactttcgcgggaataccagccgcgaccgcataggccggcacatcatgagtgaccaccgcatttgcgcctatgattgcgccatccccgatgttcacaccggaaaggatacacacattacggccaatccagacgttcttaccaatacacaccggacccttactcactatttctcgatcattgggtgcaatatccaattcggctgcaatatttgcaccatgagagttatcagtaataaaggcgttaattcctagtagacagccatcacctatggaaacatgatgagcgcaggaaacgtaggaataatccgccatcacgacattagacccgatcagcaatgcaggatccgaataccgttccgttggccatacttgcagcgatatggacttaccagcggagaaattcttaccaatatggataaatccttcaccgtgaattgagaagtcaggtccaacatgactgttagtccccaaatcagcgattcgagaagaagataagagccagcgcatcctgctaaatagtctatgaagcttcggcatttcaattccccaaacatttctcgtctataagattcattaattcaagagattccggaatagctacttttctacagaacaacgcattactgtgaacgatgtcttggtattctgaagcttccagagtcaatggcaattgttttgcagggcgtttgggataccattcaacaaaacgcagtgaattcctggtttctatgttcagctgttcacgcacaggcctgaggactgtagaataaacaatctcatccgtgcagaaggtatatttaaacctatcgagataatccttatgagactgaagataatccaataagtaattaattgatttacgactaagagagaaccagttccaccctccatatatcctatccataaacttcaatggacgatgaatcggccataacagcagcttgagaataccgggaacatgtagtttacgcgcgataggaccgttgaatacgtccatgaaataccagtgctcaagtctctcaatataaggcccgacccttctttccaaggcttcagactccgtatcgcaaagcatatagcttttgtcgccgttctcaaacacactgtcaaattcaccgtttgagacacacggataatcctgaccggaaatagagtggaaataagcgaaattcaactcgtcctgataagaatccctcaactgggaaaccgtgcagtcaatttgagaaaagccaccgtgaattatatttcggtgtgtaacttgacgaataccgcttatttcgcttattgcgcttttaaactcatcctgattcttggccttgctgtcaatattgatgtaaaagaaatgattgctactctctagcctttttagtattcttctcagtaattccggatacctatgagcttgaataaggaatacatggttcttcatctaattaccttcgacgatcatacggtaggttgaatcagcacatgactcattactttggtagccccaatacagcttctgaggaactgccggctttcgtcttaagtattcttcatgtcccttgagattcagcagacttactaattcgaacatatttcccggaacattttgtattttggaaatagcggaattatctattccttctaacttgcagagcataaataaggcatcaataaagaagtagatggggtaaccgccgtatttcaagtaataggattggaacacgtaatccattgcttgggttagtacgctattctttcgcgacgaaataaagaaaccggaccaattgcagtactcgcctttatattgcaaaaacttgttggaggtcgaaaaggccaatgattcgaatggcttttgtgcaagattgctcaacaaatttgatggttcggcgaaaaacagtgtcgcatcaacccatgctccaccattattcttcaatacattaaaacgaagaatatcggagaacgtttgcatgcttatcttttcgttactaagtccgtcaataatcctctcatctatatccgtaaagtcgcggaaattattctttgtcagttcgatgattttcacgtttggaaaaccagtttgaagtgactttcggcagcttttcactatttctggggcattctcgaatccatcccaccataatacaaacaccttttgcggaatagtttccgacacaatattggttgtctgacctctatatttttggagcattggatgaatttggtgctcaagtttaggcaattgctgatttaaatcagtaaaagcattattccgagtttttcgaaaccactgcctttttttagctctagcaagacctgacgagcgacaatccttaaagaattgcagaatatctttacacgagcgagcacacgaacgcaattgctgctttccgccgccatagatatatcgatataatttgcctctcaatgaatatcgttcgacccctatccgcaacctatctttagaggtcgaactcaatttattcatcagggacaatgcttgaacatagtctctatcttttctgacctttttatacgctgaatagaatgtcttcgcctcatcatcgcaaagtcgaattagcaaagattgaatctctctatacaacaaagcatatgcggatgattccggcatgccatcctctctcaggaagtcccgcaaacgcacaaaagctttttttgcttgagcaacatgagagtctgcagaggaattactcatcatcgaatgatgagcattccccactgtgtagtaataagaattcacaaggtcaaggcaacgtacggattttgccgcggaaagacacaagtaagtgaatatggaatcttccccaagagtaatatcggtacatcttctaaatcggggaagtatacgctctacacattccttgcggtacaacttattccaacgagggatggcacataaatcagacatccccgcactatcaggagaaataatatagtatttgcgcaaaaagtctagcttctcgtcttgataggttgtttgatttctcagggggaaagcggtcaaaacctgtccttcagagtaaaaatatccagcggatactacatctactccattatccattgctgcaatcagcgtggaaagatagtcgtatccaactgtatcgtcagggtccacaaaggcgataaagtccccacacgcactctcaatcccagtgattgtcgctgaaacgagtcccccgtttcccttatgcacaacagtaactcttggatcaagatcactatatttttccaatatctctggtgaatcatcggttgacccatcatctactgcaactatttggatatcttccaattcctgattcaacaaggcagggatggaacgatccaaatattgttcctgattgtaaacaggaaccacaaccgatactaaaggtttctcgtctggcatttttggcttcacctactcagcgatattttccggataggtcgggaactcatcattttcgataagtgccttacggattgcttccagattcccatagccaaagcgctcatctggctcgaggtacccgccttccgcccattcgttccacgcgtacataaaaataaagtccttgtggtaaacgtcttttgctcgcttgatctgtgctgagagatactttttaaatttctccggcgtatcacctacgaacgcttgccctttctctccctttcgtggggtgttatcccaagtgacaaatgctcctggaatgttcttttccgtttccggcttacgttccagtactttcttccatacttcgtcgtaatcgacttgcacacctttattgaagaatccagcaccataacgcattagatcgaatccgaatctgcgctcgacaataccggcaagcttacggcgcattgctttgagatgcgggtgagtgttcttcgtcatgtcatgttgcgcatacaacggctggaactcgatatcgtaatcaaaacgcgagtcgtccttgtctgtctgaaggtcgaaatcgatgttctggtatgcaacggtcagaccggggaaaccattttctttagcaagctcctgccaataatcaagcatctcattcaggcagccaatgacttctggacggtagatgaccaccagcggtttgctgtcttcagtaatgtaacgagaatccttaaagaacggcaataagtagttaaaatggtcggcccattcctttttctcaccgtaatgttgaggaatcaataccttagtctcacccacccaagccttggtccacggttcgtttgcccagcagatgcagaatggcatatcaacatccggattgtggagcatgttctccattggcttttctagcagcatcttaccatcaaaccagtagtggtaataacagaagccatacacgccatattctcgagctatctttgcctgccatacttgagtttccggagacaacaggttgtagtagtttttgcccaaaggcacacgaggctgttcatgccccttaaacagcggcttagccttttttacattcacccattcggtaaatcctttgccccaccactcatcattctcgggaatctcatggaattggggaagataaaaagcaataatcttcatttaataagctccttgaattttgatttcacgacgactaatgaacattccactattaatgacgaacgctatttatattcgattaatttcctcatattgcgctatgatccctattcataactgtggtatagatatcaatcatcttttttgtataaaattggcctaggcatctctttgagatgtattcggcacaagcattctgcattatcttgtatgcatctttatccgtagcagctgcttgacgtagtatgtgccccaatccaaccgaatctgtacttccgaattggaagcccgtcttcccctccaccacaagttcggggattcctccgatattggcgccaatcactggagtttgagcggctaaagactccaatccagaatagggcatgttctcacgccattcggagcacaatacgctgaacctagcgttgccgacttcgcgttggagttcttctccggtcttataacctaacattttgatgcggttttctgcctctgcaccggaccgagcgatgagctgttctatggtctcgcgttcaggaccgtcacctacaatatgcaacgtccagtcatgcgataattcaggcaaagtttgaaggaacgccctcaccaatgtaaggatgcccttttctttggagagtcgtccaaagaaaaggaaatacggttcgaccgtatcgaacttgttcgtgttgacaaccttgcgggccatatccgtctggctatcggtcaagaagttctgcattgcaatagtacggccggcataaccaccagcatcgagtttgctcttcatgaattcgctcggcgcaatgattttgtcgattttgtcgtacgaatgatgatatttcaggaattccgcttccaagaacgccaaaccgctcttagctttcgatcctttaacacaagtcttctttaccgcgtggaagaaccgacggtcaaggcagtcatcacagactttgccgtaaccatccaccatcgtgtatgccgggcacaacaggatgtaatcgtgcgcagtataaaccactggcacatggtgattttttaaataaggagcgtccaaaatcgacaacgtaagctgtcgatgcacattattcatatgaatgacatccggcttgaaatcttcaagcaatgcttcgaatttgcgcttcgcctcgaaggagtacacaagggtggcggcttcctttaccttttgaaatgccgaaatcttgcccacatagtctttttctgaaacgaagtatttactccaatagctcggttcgttgttcggatgctgcatggaaaagaaggcaacctcatgtccaagcgcgcgcaatccctccgcaagcgcgaagaaatatgtttcagcaccgcctttgcggtagaaatatttgttgaccagtaaaatcctcatttatctgctcctcggtagagcttgagggtcgcttgaacaaccttgtcccagctatagcggccagtgatatagccggccgcgccggtcttgatttttcgtaccttacccacgtctacgagcaactcaccgagtttgtcggtcaaatcgttcacatcgccatgtcggaacgtgactccatgcatcattccggactcatcacacagcacatcagcgcattcagcaatattggaggtcaggcagcagcagccgtaagccaatgcctccaataggctcattggcataccttccaaatcactgggcaatacatatatgtatgcgttgctatacagttcttcgagttcacgtccttcaataaacccggtcagaataatgcgctgatctccggtagcggcctgcttaatcgactcgtagtattcggcggaatccgatgcgccgcccgcgatcacaagcttcttgtcagtgtctaatcgcttgaacgcttcgatgaggtaatgcacgcccttttccggtacgatgcgtcccaagaacagaatgtaggaatccttctccagactccacttgtcagcaatcacgtcaggagaaacggattctaccggcgcaatgccattgggaacgaaacgcgtctcccgcccgtatgtgtctttgaaatactgctgcacaccacggctcagcacgattacctcgtccgcacatttcgcggcagtgcgttcaccaagcttcagatacatggaggcgaacctgccccacttcgcacgctgccaatccagaccgtgaatcgtggcgaccgtacggatgccggcccaatgcgccagacgcaacggcacacatggtccctccgcgtggtaatgaatcacatccggacgggccttgatcgccttcaacgtggcgaagaaagaggacgtgagggcggccagtcccttggcgtcgatggtcgtgacgggaatgaccttcactccctggtacatatacggcttgtcactggtgctcgactggttgtcgaactcctcaccggccacattgtggcctttgcggttataaaccacgacctgctccccgcgtgcagccatacgtgtagccagttcgtccacaacaatctcgatgccaccttcgcgagacggaatgcgtttgtggccgatgaacgcgattctcatggcctcagtccttcttcgttttttcgctctttttgtgctggatttggcgcttcctgccgttgtcgtcagactcgtcgccgtaatagtaatagccacccttctggggcttctccgtctcgccgtaattcatggccaagcccacgggatcgatgctcagtgtgctcagttcgcgcccggtctgcttcagcagtttcttttccgtcactcccaagccggccaccagcagcagttctggcccttccttggcgaatacggcggcatcattggccacctgcatgggggcggtatcgataatcacatagtcataggctccggaaacctgctcaaccagtgccttcatagcgcgggaattcagcagaatgctggggttcatggtttgttttccagcaggaagcacgtggaagttcggcttccagtagcgttgaatcgcatcatgcgatgatacacggttggtaatcagatgggtcaagcccactgcgccctcaatgccgagagccttgctcaccgaggggttgcgcacatcggcgtcgatcagcagtaccttgctgccgttttcggcgaatgcagtcgccaggttcacgctcagcgtggtcttgccttcggacggtccggtggaagtcaccacaatcacattggacatcggctcatcgggcagcacgaacatcacattggtgcgcaggcgtcgaatctcttctgcctcgcgggaggccgggcgggagataatcaccggcgacgtaccggcataagcctcattgcggctcagcgaccccagtacgggagcgtcgataacagtagtaacatccgaatcgcggcgaacacgggtgtccagcaaatccttgataaaggcaaccacgatgccgagaatgacaccgatcccaagacctgccgccagattgagcttgacgttgggtgagctgggggaagtcggagcgtacgcctgctgcaccacagttagattgacgggagagatgatcttatcgccctcatcgctgtaaatcgtggaagtaacctgttttctcaggttttcggcaaccgaattggcaatgctggacgcctgcttcgggtctggatcattaaccgaaatatccaccagcatggtgccatccgggttggaagcggtaacgctcgcagccaatccctttactgtggtgtcaagacccagatcgtcaataaccggctgcaatacagactcggtttttatcaattgcggatacgtttgaatctggctattgatgtaattggcgccagagctcagctcgactgcattgctggatgcgcccgacgcagccgctgaactgcgataagtggccaagagttcggaagtcgcggtgtattgcggagtgcgggtaaaggtgtacgcgcagattgccaccatcacaataaccagcgtgaccactgcggtaatcacatgctttcttaccgcattgaataaatcgagaatggtgactccattaccatcctgcatctgttcagcttcatccacagctatgctccgttcttccttattcacggttccaccttaatgtataggggttgcccctttaatcaaccaagggggtctgtctcaaaatcatttcattttcattggccgcgggactggccagcacatgcaccatggtctcgaaactttcccccggccgcaatgtcacggttttcacacccaccgtcagtccatcgtgcacagcgaactgatcgaaatcctgggtccaatccacaatgcgcccttcatcgggggcgtagacgtacagcaccgtttcgatctcccctgtacgggggttgccgttatggtcatagccgcgcaacagatccggagcggcattcacctcggcggcatcggccgtattcgtcagtttgatgtgaacggtgtattgcttggcgccactgggataggttttgtcatatgtactggtcacttcacgcttcaggtaccagtccatcttgcccatggtggcatcgttgaagtacacacccgtaaccgaatgagccggtttcgactgcaattcgccggcgatggtcgtacccgagatacgccgctgctcatcctcatgaacactccatacatacagatggccgtcggatacggactcctggaacgtttgcaccagctgctgattcttgccgtccacattcttgagcacatgcgtgaagatctcactggccgccatcgtgaagaagtcggtttgctccgcctgcgtatcggtatcaatataaatctggttcagaatccgctgctcggcattgtcgccgctcatcaccgtgccgtcggagagcgtcacggggccggcaaccttcaataaccgctgcaggaacaccgggtccacgctgatgacgccatccacaccgtcatgaccggctcgatgccagatctgacgcgcgatatcagcaacgcgcgggaaatcgggagtgaaattgatgtccggatagtctgtggccatcttggtggagaagagattgcgttcttccgccgtcagtacgctcgcggcttcatcctggctgaacagaccattccgaggcggatcgccgaacgtactcatgctgattttgcctgcatcgatggtgagcgtggcccacgcagttggaatgcctcccgtggcacgcagctcagcattgttctgtgccagcactaggtaggttcgcgggccactgctactgccctcgctgctatccaagtcgaacatcttgggcagcacatccgccagccgactggccgtatccgtcaggctggcaagctccttgaacttgctacgcccctgctgcaccgcctcggtaatctgcggaatatgtgtatcgccaatcttgcccatgtctacgctggcatccgccactactccattggcggcggaaagatcctgtgccacgctggccatatcccccagctgaatcgtgccgtctttgataccgatgctgttgaaatccaaggcctgtgccgccttggcaagcttcggcaatgcgttgttcgacacgtcttccaaaatgtgcaccatgtctcgcgcggccttcacgtcagaaccgtaatagggcaccaatgtggccagtttccataccggctgcttggtctgcgcatacgtggcgtcgatatgctgggagaatgcttcaatgctggcttgcgctttgtcggtgtcgccggcttgaacttgtgattggatgcggcttgcggcctgaatcgctgcttccacttcatttttcgctttgagcgcggaaaggccgagccacgccgcgagcgctgcaataatcaacagcagtgcgccgattacaatcagcaccatccgaatgcgctttttgcgcttgatccgcctgatatgttcatggctcatacgccggcggtgcttacgccgttctgccgctcggacgtcttcagcaagtacctcggggtcaacatacggctgtatcacttggcgatcatccgcgtttttcgaccgctcggagggtgccggcggctgaggtatttctggtatgttcgaatcagtcatagatatatcgacttatctttctgtaatcacgttcaagggcggtgcggcaagggcgcggcaaaactgtgacagcgaaacgggaaggaatcagtacgctcccttatggctcagcactgcacccaccgtgcggaacagcagcacgatgtctcccataatcgaccagttctgcacgtaagccacatcaagggcctcgctctcttcggcagacaaatcggagcgaccggacacttgccacggaccggtgatgccgggcttgaccagcatgcgggtagcgtacagacggttgtaacgggcatattcctcaggcagcggcgggcgcggccccactacggacatatcccccatccatacgttgaggaactggggcaactcgtcaatggagaagcggcgaatgaaatgccccactttggtgatgcgtgggtcgttcttcatcttgaagatgaagcggtcggtctggccggtttcttttgcgagctccttcttgagcgcgtcggcgttcactaccatcgagcggaacttgtacatctggaacggcttgccgcgcaggcccatacgggtctgcttgtagaacaccggtccaccgtccgtgcctttgatggcgatcgccaccgggatggtgataatcagcgaacagatgatcgccagtgaagaaatcaccaaatcaaacaagcgtttggtcaaacggcgggctggcgtgtattgcgcaagacgttgcgtgataatcgtggtgccttggatagatcgaacctgaatctcatggttagaagtgtcagcggcggaagccagcatggcaatctccagaccgaacgattccatgcgcacggagaagatatcgtaattatccgaatagcgacgcagctcgtcagccaccataacggtctgcgcgttcatgtcaataatctgttcagcaagattatgatcgctgtactcgagtacgggcagctggcagcccccgttcttttgcatctcctcacggagtgtctcatggtcggtgctctgttcaatcaatccggtatcgggattgagatgaatcgggcatactgccaccgggcggtagttgagttgccgacgctgaccgaggaattgtagcgtacgaccaatgccgtgcggggaaccgatgatcaccgtgccataagcgtaggcgcccttgcgacgactacgcgtaatgaatgcacggctgacaatgcgttccaccatggtgagcaaccatccggcaatcaccaccaagcagagcgacgtgagggtcagacccagattgaagaagtagttgaacgcgcactgcaccacccagcacacgaccatgcctttgaccagcatcacattgagctggtaaccgtcacccataacatggcggtgataaatgccggcaacatagagcgaccacacccagaagcaggccacaataataaggtaaacggtggagtcaatcgtgaaattgaatctgctcgaatagagcggcgttgcctcatggcgcagattgagcaccgtagctccggcgatgatgtacatggcggcgtcgataagcatgagggcgagattgacgaagaatcgccagtacagcacgtggctgagctgcttttggcggatatctctgagctgagcggtggttcggtcaccgctattggcctgtctgctgcgtgtagacggctgaccgttactgctcagagatgacatctcaaacaccaattcttccttttcaaccgtatacctcaggtctcgcggctctcacttctctggattcccctgtgtacgggtgtatacggggttaccccttcaacatggtacagacatcacacccctaaccgctagggggggggtgttggaaaaccaacatagcgaacgtgatcggatagtaactacgttcattttgacgtctcgaataacgggactaatttgctctgcaaccgggcggccagtcatctcggcattgcatctcgacggactacccctgggtgtagcgtgttggggttgctttgagagactgcctgatgcgttgttgcggtcgatcagcgagagtggagtatgcacgtgagtggaatgaacggagctcagggaatcaaaaatcgtcgcggcgaactgcagcgggtgctgagccgcgaggaatcatatgtagacggcaaactcagccgggcggcgttcatctccatcgcgatattgacctttattaccttcgtgggcaacttcacgcagttgcagctgagttccgcgctgccgattatcgtttccgaattccacatctccgtaaccaccgggcagtggctcacctccgtgttccagctggtcatgggcgtgatggtgccgctgaccgcgtttctgacccgacgcttctccacccgccagatcgtcatctgctcgatggcggtgttcacaatcggctccgtgctggcatggttggggccaaacttcgtatgggtgttggtcgggcgcgtgctcgaagctgccggcacaggcgtgatgtggccggtgctgcaaatcaccgtgttctccatctacccgctgtctcgccgcgggtttgccatgggcacggtgggcatggccatgagcgtggcgccagccatcggccccaccttgggcggctggcagaccgatgccaacggctggcgctcgatcttcctgaccatgaccatcattggcgtaatctcgctgctggcggccatgttcggactgcataatttcggttcacacgacccttcggcccgcgcggacttcttctcggcatgcctgtcggtgatcggctttggcgggctgatgttcggcttcaccaattcggagacctatggattcgcggcaccggtcacgtgggggccgatggttgtgggactggtcggcattgtctggttcgtgctgcgtaacctgcgcgccggcaagcgctatcgcgaggccgtagccaaggacgagtcggcactcccccagccgccgctgctggatcttgaagtactgaagaatcgttcgttcaccgtcggcaccatcacggcatctctggcgttctttgcattcagttcgattctggtcatcatgccgctctacatccagaccgaccgtgggtattctgccacgatgagtggtctgatcatgttgccgggcgctatcggccagtgcgtctcccagttcttcggcggccgcgcgatggatcggttcggcgcacgacccgtggctttgttcggttcgattgtgttgacccttggcaccttgggcatgtcgctggtggcgatggatacgtggatctggtgggtatcgatctgccagttcatccgtcagatcggcatgggtttcctgctgatgccgattaccacgtggtccctgaattgcctgaacgggccgagcgaagtgtccgccggatcatcggtgacgaataccgcgcgtcagattgcgggcgctgtgggcgcacccgtgttggtgattctgatggaaacgtttgccgctttgcataagcagggcggcgcctccgccgtcgccgcttcgattttcggcattcaatgggcgctgcgcatctccgcaatgatctgcctggcaatggtgttgatggtgttcttcggcgtcaagggcgacggtgccggtcgcacgcgagacattatttccctgcgttcgctgcgcgaacggcgtgcgcggcgtatggctgcgaactgacggcagatccaaccattctcaacataataagaaaccccggtttccaacaccggggcttcttattatgttgtgctatcgcaggatttcagctggagtctattacgccctgcccatcagcgtcaggacaatcagcagcacgttgagcgccacaatcagtgccaccacaatcataaaaatcacgtgcttgacggttccatcagcccacttgcccatgagttccttgtcatgcgtgtatcgcatcagcggaatcacggcgaacgggatgccgatggaaagcaccatctggccgatgaccagcgcctgagtcgggtccttggcgaaccacagcacaatcagtgccggcaccagcgtgaccacgcggcaggcccacatcggagcgttaacgtgcagcagaccgtgcatgatttccgagccggcatacgtgccgaccgatgtggagctcagcgacgaagccagcaggccgatggagaagatcgtgccgatcaccgggccaagcacctgcgcgatcgcccgctgtgcgccgtcgatggaatccgtgccagacatgccgtgcagcgagttggcggcgagcaccagcatcgccagattcacggtgccggccagcaacagcgcccagaccacatcgattttcgagcctttcagctgcgttttgatcgacggcttttcgccgcctgcgtaatggtcgttcaccagcgtggagtgcaggtagatggcgtgcggcatcacggtggcgcccagaatcgaggcggccatcagcaccgagtcggtgccctggaagcgtggaatcatgcccttgaccacttcgccggggctcggcgggtccacgaacaggcctgcgatgaagccgaatgtgataatcagcagcatcacgatgatgatgcgctcgaacgtggtttgcgtcttgccaccttggaaccacagcatcaccgtggagattgcgccgatcaccagaccgccgatgaacagcggcaatccgaacagcaggttcagggcgatggcaccgccgatcacctcggccagatcggtggcgatggcgatgacctcggcctgcataaagaacatgaagcggccggcatcgctcatacgttcacccagcagttccggcagggatttgttggtcacgatgccgagttttgcggactgatactggatgagcacgctcatggcgttggcgagcaccagcacccacaccaacaggtagccgtatcgcgcgccggaggtgatgttggccgccacgttgccaggatcgacgtaggccacggccgccacgaacgcggggccgaggatgctggccagcgcatggtcatgcggctttttcttgccgtttgccacggttccagctccggctccgactccggcaagctggcgttccttctcgatttccggtgtttcctgttcgatgtctgccacggcgttcgtcatagtggttgccgcaatggcatctgctgcggtgtgtgttactgccatatcgtctgttcctattcccttctcccttcataccgggctcagttatagcgcgggcatgtttcccgcgtcaacagacggacaatctgcggacgattgatggatgactggcggactggcagctggcattccccgccatctcgctcatgaaatgtgacaaaccgccgaaaactcgctcatgaaatgaggaaattactagaaaactcgctcatgaaatgtgccagacggtagaaaactcgctcatgaaagtgtaaaatcattgatatagcagtaattcggaaaggggctcctcatgtatctcaaacgcaaagccgatgcctatctcaatgcatggaaatccgacccgaatcgctccccgctaatcatcaagggccctcgtcaagtaggcaagacagagactatcgattactttgccgcacacaactaccgttcggtagtggaaatcaacttcgttgaggaaccgaaatatcgtgcaatcactgcggacggttatggcgcggataccatcgtccgcaatatttccctgatcgacccagctaaaaagttcattccgggcgatacgctcatctttttcgacgaaatccaggcccatcctgatatcgccactgcactgaagttctttaaaatcgacggcaaatatgatgtgatttgcagcggttcaatgctgggcatcagctataagcaaatcgaaagcaatagcgtgggatataagaccgactacgaaatgcgatcgttggacttcgaggaatttctgtgggctcgcggatacgatgaggccgtcatcgaaagcatgttcacccacctgtgtgacgctacgccattctctgaagtggaaatgaacgtcttctccacggcatttatggattactgcgtgcttggcggcatgcctgcggttgtcgcctcccatatacgcactggcacgttcgagggaacactgcaattgcagcgccagcttattttggactaccaggaggatatccgcaaatacgcgcaaggactcgatcaggcacgaattctcaacgtgttcaaccatattcccgtgcaactcgccaaggaaaacaagaagttccaaatcagcaaagtcgccagcggagcgcgtttcaaagactatcgaggatgcgtggaatggcttgagacctcgggaatggtgaatatctgccgatgtatgtcctatcctgaactgccgttgaaaggcaattatgacgaaaacaagttcaagatatatttcggcgataccggtctgttcgtagcgatgcttgacgacgaggccagtgatgatctgcgggccaatcgtaatcttggtgtctataagggggctatgtacgagagcatcgtctctgaagcgctacggaaatccggctatgacctgtactactacaaaaaagaggattccacactggaacaggatttcttcgtccgcacgcgcgaatggctggtgccggtggaggtgaaatcgaaaaaaggcaccgccaaatccatgcggacgctaatcgcttcggattcttatccggaaattcagttcggcgtgaaactatccgccggcaatatcggtagtagcgaacacgtgttcaccgcaccatacttcaccacatttttgctccgacggctcctgcgcgcttatgacgaggggcaggcacctatgctcaacaatcctgagcggtagcccctattcgtctgcgggcacggcctggcccgggcaggtgtggaggacggcgagcatggcgtccttttcttgggaggtgacggtgagctggtacttgtctttgacgccaatctggcgggccacgtagtcgcaacggtagtcggcgttggtgggtagccagtaggcggcggaagccgaacccttctcctgattggccgggccgtcgacggccagcaggttgtaggggtcattgccgaattcatggcgtttggcagtggaccagtcgtgcgcaccggattgccaagcgttttcaagggccaccacatggtcgatctgcactttggcgctggtggcgcggccacgtacaaaatggatgatctgagcggtgtacggatcggccagtgtgccggactcgaccacacaggaaccggcgtatttgtaggtgatgtccgtgagatcacgggcgagcacgtcgtcgcgtacgtcgcagccattgccgtcgacgtcggtggtgcggaaaccgaaggaatcgcggtcgtagccggaggagctttggttgtcgtctacggcgagcgcgttcaaagtgtcggcggctgaaccggtggcagtgtagccacctgtgattttggccgcgtcggagctgacctgcggcagtagcaggccgatggtcacgccgattgctgcggcgagaacgatgagaatcagcacgcgctccagcggaccagaagcgttgaaacgacggcggaagtgggcgttacgacgtgccatcaatcacgcataggtgaaggtgagggggtcgtggccggcgcgggtggggccgtcgagggcgtcgatggcagcgtgttcatcggcggtcagggcgaagccgaacaggttgagattctccttctggcggtcagcatgcacggacttggggatgataattgtgccgttttcgatgtgccaacgcagaatcacctgggccgggctgacctcatgggcggcggcgatcttctcgatggtgccgtcgccggcgttgaggtcggcgccacgcgccatcggcgagtaggcctccacggcgatgccgtgctccttgcagaacgccaccacttcgcgctgctgccacgtggggtgcagctcaatctgattgacggccggccatgtgccggtctcctcgtgcagacgcttcagatcggcgggcatgaagttgcatacgccgagcgtgcgggccatgccttcgtcgcgcagcttgacgaacgccttccaggtgtcggtgctgcgccagtcgaacggcgtgggccaatggatcatgtacatgtccacgtaatcgagctggaggagtttcagggagttgtcgaatgccttgagcgcggagtcgtagccctgctcggagtcgcgcagcttggtggtgacccacagggtctcgcgcttggcaccggtgttgtatccggaggcggcgagcgcgcggcccacgccggcctcgttgttgtagccggccgcaccgtcgatatggcggtagccggcttccaacgcggattcgacgacggggaccacgccctcgtcgtcgatacgtagcacgccgagaccgacttgcggaatggaatgaccgtctttcaaggcgatgtccggcacgttggcggggttgatgtgtccgttggtcatgatgtgcgatgctcctttattgctgcgactacacgccactgtacacggttatgtgggtgatgtgcggccggtgtgcagggagcgtgcgggtaaacggcatgattatgaccggccttccatgtgggaaagccggtcataatcatgacaacatcacgctctactcctgcgaccggggcctcgtcccattgttcccggacgcgaatttgcctccaaccacaatgatgcccagcgccattgcggagcccctcttcccctcctctgggcacgaatttgtcccggtgaaaacgtcaatcgattgacgtttctaccgggacagaaatcgttgtcccggtacgcaatttcggcccatttttgagaaccgggacaaaccaattttcaaagtccacataccccgacaagcagaatcggcggaataccgccaatcccgagatcgacatgttgtcccggttcgcacataaaacgattgacgctcgtatcggggcaacgagaattgtcccggtacgcgaaaaaacgcccgttttttcaaaccgggacaatgatttctgtcccggtattaacatcaatcgattgatgcgcgaaccgggacagaatcgcatcgctacgccgagacagccgcatctggcagacgacagccgacagccagcaactggcaaccgcatcacaatgccgcatcagtctctatcaggagcgcttacgacgcaaagcaaacaaggccccgccggctgcaccgagaacgacgaccgcaagacccacggcagtcaccgcgctaccggtattgctcagcacgccagtggccttgttgccattcgcaccgttggtcttatcgccatcgccatcattgtcgccgatattgttcacggcctcggcgaccgtgcgaatctcatcggcctggccttgcgggctgatgtcgtatttcttgaggttatcggcggttactttactgggcactgtgttggaatcgtcgtcgccatcatccaaggtgtatgccacgacgtttccgccatggaacaccggcaacaacgtgctcgcgtggcatggcgtgtactggcgacagtcaccacggcgaccccgccatggaacgtggcacaaccatgcgggggacgctctatgtgcattcagtcatgctgccgatgctctttaacttgcatatccacgagggcggcacgaggcaattcgtccgcctttacccgtacatccatggggcggcgaaaatcccatggggcggtaacttgcccatggggcggtcggtaaaattttaccttccgcagaataaagccattttcagccaccgccccatgaggaattcaccgccccatgggccaatcaccaccccatgaaacagctcattcgcacagcaacactatttgccgagcaacacccgcttggcgagttcgggaccgtattccgccaatgcggagtcttccgacgcgatgctggcgtggccaccattatgctcaccattgtcaccaacaccaacaccaacaccaacaccatcgtcgttaccaccaccatcgccagccgtcgcaagattctcagtgagcttggcgaccagacgcgcatgggccttttcgtcgatcttcacgaaaatcgcgaacacaatcaggccaagcacaatgcacaccagcggaatcatgaaggcgaaggtcttgaagatggtgatgtccttggccgtcatgtcggcggcggtggcggaaccgatcatgccggcggccacggccacgaagccgacgaagccgttggagaatgcgccggcgatcttgtcgagcatcggacgcacggacagcgtcacggcttcgttgcgtttgcctgttttcagctggccgtattcaatggagtcctcaaggcacacgatcacggtcatctgaatctgggtctgcggcaggtagaacagcactagtgccaccagcagcagcggtatattcgtggaggcgacaatcagcagcaggtaggccacgaccatcacggacatgccgatgaggaacagataacggcggggcacccacctagtgatgaccgggaacagtaccgacataatcagaccgcacacaatagggatgacgccggtgaccgggaaaaggtccatgcgaccaatcacgtatttgaacaggtagaccatcacgccaccggtggccacgttggcgacggcgtagaacacataagacaaagcggtccacatgagctggtcgttgtgaatcagggcgcggaacgcttcaatcgggttaccgttctcctgggccttggtgcgcagcgtgctctgtttttccttgacaccgaacactacactcagagccgtgagagcgccgagcagggccacgatgatgatgaacgcggtccaaccattctggttctgctgaccggcatcgaagctgaagaaggtgacgatgggcatcacggcgatagtcagaccgttgtacccgagcgatccggtgaaggtgccggctgcggtgtagatgccgcgctgatgggagtcggaagagatggaggggatcattccccagtaggagatatcgcgcagggagtagaacacatcgagtaccacgaacaccaccacgaacaggacgatgaacagcgtggtgttgacgttgaccaagccgaacaggccagtgtagaccatgacgatcagcacggcggacaccagaccgccgatgagctgccaagggcggaatcgcccgagtttggtggtggtgttatccaccaggttgcccagcagcgggtccacgaagatttccgcgatacgaatgatcacgatcagcgaggtgatgatgccgatgagcttgcccgccacggccttgtccactccggagaacagcgagttggtcacatagaccacgaagtaggtgcttagcgcgttgtagaacgccgactggccgaagttgccgagcgcgtaggccacaagtcgcgcgggagcaatggcctctttctcatcatgatgggattgcgtagacgattcagttgatgccgtcatcagatacattcctccagattccatgtacgcatatcagcgatgttgcggcaattcacacatcgtgcgtgcgatacaccggtaaaccaaaaataatgtacaccagaccgtagagaaaacacacataaagttgctacttaagcacagaaattaacaaaaagtcactaaacgattgaacggcgtctcttatcgtggggggggagatgcacgaactcggagcggagtgaacggctacctccgatgacacatggggccactcaaacgagtgacaattacgagttacgacgggagatgacaatgttccgcaaggctcccctcagtcaccttcggtgacagctcccctcagggaggggagccagattagcgtcagcgcgtggaggcgcgggcgatgacctgggattcggtggtgagcagttcgggcttggtgatgctgccgtcgatgcgtccgaggatgcgattcactgccgtgggagccgtccagtcaaggcgggaatccatggtggtcagcggaatctgcaggtagggggcctcctcgttgttgtcgaagccgatgacctgcacctgcgcgggcacctcataaccagcggtgcgcagagcggtcaatgcgccgatggccaactgatcgttcagggcgatcacaccgtcgaatggcacgccggaatcaatgagccgctggatcacacgggcaccggctccgatggtccaatcctgaccggtgttgccaatcagctgcggatccagctcaagcccacggcggcgcgtttcttcaatgacaccacgcaaacgcagttgtgcgttgccttccacagcctgcaacaaagcggccgcgtcatagtcgtctcgtgcgcccactacagcgaggcgagaagaacctcgatcgtataggtagcctgccgctgttgctgcggcggcaacatcgtccggagtcacgtggtcggcaacaccccatgtggttcgggcaccgacaataaccagcgggaaatcgaccttcaggtcttcgggcgaaatatcctccacctcgctcatggagagaatcatgccgtctgacacggtggagttgaagttcttgagcaggtcgcgcgctcctttggccgagccctctgcatacgtggtgacgtatacggagtagtcgcgctgacgggcggcgtcaatggtgcgattggccaactcggccagatatggcggaatcagcgaaggcacggcaagggtgatgaaaccggtgtgatcgcggttgaggttgcgggcggccacgttgactcggtagtcgaggtccttaatgaccgactcgaccttggcacgggtctcatcggtcatacgcccagagccattgatcacgttcgacgcagttttgagcgatacaccggcggcctgagcgacatcgcgtaacgtcactcgacgcttggctgttttctcgtcgctcatgccgcactcctctatctggacaacattgccattctagcgcggtctagcaggacgctttagcaataagaatggcattgcgattcagcgtatagccggtggtgtcggcctcgcaacggtaggcgatgattggttctccctcaatgccgttgacggcaacgggctggtttgagcggttgaggtagaaatcgaagcgagtggagccatctgcggatcggcggatggtgtgcaggatgcggggatctgtggtgggataggttggagtttgaccaccctcagtcggctgcgccgacagctcccgccagcaggagccgaactccttaagcaggcgggcaatgtcgtggcggccaaggtcgcaccccacgtagatggcggtaccgttgccataggtgcggctggtgatggcggggacgccgtcgagctcccaatcagcagcggctgtacccacgtacgtggcaagcacgcaagtgtctggagcgaccgaggtcacgtcattctgccacagacgggtcgtgagtccattcgacaaaccgatttcggccggttcgtcttcggcttcttctccgaggatgttgaattcttcggagcggatgccgagcatgtcgcgcagaagtccgttgccggcgccggggtatccgccgaaaccgatgtggaagtgttcgtcgatcaggccggtggcatagccgacgatgaccgtaccgccgttttcggcgaagtccgcgatgcgacgggtatcctcgtcggacagggcgatcacggtgggcagcacgatagtctggtagccgctccaatcgtaggcgagcgggaccacgtccgcgcgcgctccggcatcgagatatccgcgataccagtcgcgtacgtcatgccagtgattgagtttcatgctgggcagggtctcggagcgagtggcccattcggattccgcactgaacagaatcgccgtgtccgcgcgcttcagttccgtgtcttgcacacccgcgtcggacagcgtcttcagcgcggcgccgagttcgcacacacctcgaaacagtttcgtatcggagcccgcgtggggcaccatcgcggagtggaacgcctcggcacccgatgcggattgcctccattggaagaagttgatggcgtcggcacccatggccacgtgggccaaggagtcgcgcatgagctcgccggcgcgcttgcgcgtgttaaggggcttccactgcacggctgaggtggagtgctccatcacgtaccacggcttgccgagcgcgagcgagtccatgagcgcgtccgagcaggcgagttcgtccagatgggattcgccttcatggaagtagtgatcgttggacacgaagtccacttcgtttgcccattgcgcgtagtccatggtgcattggtcggtggagaccatgaagttcgtggtgaacggcttgccggggcagatttcttcgattgcgtcgcgttcggccttgtagaagtcgagcagcatgtcgttgccgaaccgctcgtaatccaactgctggggcgggttgaccatgctgtcgccgcccatgtggcgaggcagcaacacctcgtcgaagctgttcacgtgctgggaccagaaggccgtgccccacgcttcgttcaacgcgtcgacggtcccgtatttggcctcgcaccacgtgcggaacgcggccaaggcgttgtcggagtagtcgtagcggttgttccagccgtattcgttgcccatgtgccaggccgtcacgtatggattgtccttgtagtgttcggcaagtttgcggcacaggcgcagcgcgtattccttgagcaccgggcttgtgggctgccacgactggcgtgagcccgcattgaccacatggccgtaccgatcgattggcagcacctcaggatgacgctcgtacagccacaacggggccgtggcagtggccgatgccaggtccacggcgatgcccgccgcgccgagcttgtcgatcacgtggtcaagccactcgaacgtgaactcgccctcgcgcggttcgatcttgtcccagctgaagatcgcaagggccacggtgttcacgcccgcccgggtcatcagacggatgtcctcgtccagtgtctcctccggccactgatccggattataatcgcctccgaacgcgatgccacggccggattcagtcagcagggacggccacctgaacgttctatgagtagtcatatcaatcaagtcctttattgtatcggctcgtggccgatgctgtgttgctggcggctgccgttgccgcgatgaccttcttggtgttgcgcatgttatctcctcctgggccgttgggattggtcgtggcttcgggactttggcttactgccttgggcctgggttcctcgcctgcgatgtgctccgctgactgtctttctttgaggtgttttctttggtacatccgtgtaccaatatctatgatgatatacccgtgtaccaatttgtcaaaatcaagcgacacgcctgatttccagcgccagacggagccagttcggctagtatgaacaggcacccccatagctgtattgagaggaagagcacatggcgggactgtttcggactgcttccaagcagcccaatcctttagggacagccatacacacccgcggatcaggaaaatatacattcggactggctttgagtgcgggtcttgccggattactgtacggctacgacaccgtctccatctccggtgccatcgaattcctgcgcgccagatacgggctcagtactctcatggagggcctcgtcatctcctccatcatgctcggtgccgtcatcggagcggccaccgccggattcctttccgaccgattcggcagaaaacgtatccttattatcggcggcgcgttcttcctcgttgcggctgtatggagtgcgctgacgataggtcccatagcgcttatcgtggcgcgcgtggccggcggctacggcatcggcctgaccgccgcgctggccgtcacatacatcaccgaatcggctccggccaacatccgtggtctgctcgccttctcttatcagctgcttgcggtttgcggtatcttcctgaccaacgtcatcaactacatcatcgcctcctacggatcaaacgactggaatatcgccattggatggcgctggatgctgggattgggcgcgattccggccgccgccttcctgctggctatgcggagggcaccggaaagcccgcgattcctcattcaggtaggcagaaccgatgaaggtttcgcggtgctcgagcacatcctcggcaccgaacgcgcacgcctgcgcaccgatgacatccaagcctcggtcaaactggaaaccgagatgtcgcacgaattccatgatttgttccgtccaggcctgcgacgggcactcgtcatcggcatctttctcgccgtgttcaaccagttcatcggcatgaacgccatttcctactatgggccggtgatgttctcggatctcgggttcgccggggacactcagttcctcgcggccgccagcgtaggcggcgtggagctggtggccaccgtggtaggcatgtacctgatcgacacgttcggccgtaaacgtcttatggaaataggcaccggcatgatgtgcgtgttcgcgctatgcatttcgggctcgtatttcatgggcaattcgctgctgacgcttatattcgtcatggcgttcaccatatcgttcgccttttcgatgggaccgattccctggattgtgattcccgagctcttccccacgtatctgcgcggtcgcgccaccggattatgtgtgatgtgtctgctgttcgccaactggatcatcgcacaattcacgccgatgatgatcgatggattgggcgacggcatatcgttcgcgattttcgcggttctggatctgatttgcctgttcggcatcgtggcgttggtgccggagacaatgggacgcacgctggaggaaatcgagcatctatggcagccgaaaaccgatttggcctacgcaaaatacgcgctgagcacggctgatgcgaatatccgccacgcggaagccacgctgcgtcgtattgaaaacgaacgtcagcaggcattgggcattatggatgcggctgagcgggctcgcgctgcggcacagcagaagattttcgctatagagaccgccaaaagggccgaggcagaacggctggcggcgcagcgcgctgccgaggaagccgccaaggcagcggcgaatatggctgcagaagaagacacggcagcgaccgtctcggaagttacgacggatgagaacgtgccgtcgcttatgcggcgtacgaggggcgctgttctggttggtaagtcatccagtagacggcacgacggtgagtatacggacggctctgcgaacggccctgcggatggctctgtggatggctccgtgactgactctgcggatggtgcgatgctggacggcgcggcggccgaggcagcggccagcgcagcagtcgcggccttggccgattcactgcccgacgatccattcacgctggcgaatcggccgactacgcgcagtggtgcggatgatacagatagcgttgatgccgcagatgccgttgattccgcgaatgacgcgaatcgaaaccgcaagcagacaaatgccgtgcagccggcacatatggcctctattgagcacgcgcacagtgccgatacgcctcgcggagtgttgttgcccagtgccgacgaggattcctacagcgagcattccttcgccgagacggatgacgaccgcgaggctcaggccatcgacgcggccctcgactctctgaatgcccttatcagaggctgatatataaggaaatcctgtattgcagagtattgcggcctgtgactgtgcgactttacagattcagcaccgcatcggcaacgcgcatggcggattcacggtgagagaccagcaccacagccacgtcttgccccttatccgcgttctgctcgctcttggacagctcatgaatggaacgcagaatgatggcttcattcaaggcatccagacgactggtcggctcgtcgaagagaaccaagtcggcattgcgcaggaatacacgggccaagccgatgcgctggcgttcgccttcagacagtcggtcgcccagctcgcccacctgggtgtcgagcccatccggcagggaatcgatcaggtcgagcacggatgccttggcgagggcttcgcggagtcgggcgtcaagaacaccggccgctcccccattgcgaatctccgattcaggcaaggcgataagcagattctctcgaatcgtgccgtcgaacaggtgggtctcctgactcatcatggcctgaatacggcggcgggcatgcacatcgatttgcggtagcggcgtgccggacagcgtcacttggccgcgctgcggatcccaatagcgcatcagcagcttcagcatagtggacttgccccggccggacgggccttggataccgaggatgccgtgctgcggcacatcgagcgagaagtcggcgagaatcgcctcgctctcctcccccgggtacgcgaagatgacgcggtcaaggcgcatgccctcataatccgagttcgcagtgccagtttccaccacggccggcgcttcgtccatcagaccgaacagacgacgggcggaggcgaaggtctgggtgaggttcgcgggcagggcggcgagcgccagcgtcggcccgaacgagctggcgagcagcgcgaaggcggcgaccagcgccgggatatcgtagaggttcacgccggcaagattgatggcgatgccggcagccgccgaggtaagcaatgcaaccagcaatccgccgacaccggcgaaccggccgttgacacggctgagtttggcatggtcacgccatagcgcgcacgtgcggtcttcgatggcctgcgcacgatcttcaccccgaccgaatcggatgatctcgtcgagaccgcgcatgtcgtcgagcatcacgttgtcgagttcgccggccgcgccacggatggcggggcccagattgcgcacgccggtggcgaagaagcgcggcacaatgatgccgatgatcagatgggagacgatcagcgccaacgccatccaggggctcagcgtggccgccacgatgacgtagacgatggtggtggtcacggctatggccacggggctgatggtatgcgcgaagaagatttcgagcagttccacgtcggtggtgagcatggcgatgaggtcgcccttgcccttgccggcgagcttggccggagcgaggcggcgaagggcggcgaaagccttggagcggaagagcgcgagcaggtggaaggccacgttgtggttcagatattgctcaacgtagcgcgtcaggccgcgcaacaccgcgcaaacaatcatggcggtgattgcaccggccgcactcatgccccacacggggttgccggcgagcgcgaatccggcgatgatgccgaacaccggtaggaaggttgcggcaaggtgaccgatggtgccggccgtggaagccgcgaccataagcccggccagtggcttggcctccccgagtagtcgcttgatgacctggaacgtgctcatctcggccggagctgcagccggagctgcgcccacagccgccccgctcccgctggcggaagctgtcagcgaagctggctgagggtggtcagccccaaagttctcgatatccgcctgagtagtgaacaacttggcgtacacgccgccggccgccatgagttcggcatgcgtgccggtttccaccgacttgccgtgttcgagcaccaccacttggtcggcgtgctcggcgttggccatgcgatgggtgatcatgatcaccgtcttgctgcgggattgcaccagttcgcggatggtcgcgagaatcagttcctcggattccacatccacactgctggtggcctcgtcgaatacgaataccggcgaatcatgcagaagcgcacgggcgatggcgatacgctggcgctggccaccggacaggttggcggcgtcgggctcaatcgtcatgtcaaggccgtccggctgcgaacgcacgaagtcggcgatacgggcctgttcgagcgcgtcccagagacgggaatccacggcgtcggacgcggcttcaccgttctggccgtcatcgggcaaagccatcagaaggttctcacgcagagtaccggcaaacagatggctactggcaccgatcagggtgatggttcgggcgagcgtctctccggacaggtcggataccttgacgccgttcagcgtaagcgagccttggtatccggtcagcgtaccggcaagcagcgcggcagccgtggatttgccggaaccggagatgccgacgatggcggtgagttgaccggggtaggcagtgaaggtgaggtcggtgagcgcaggtgccggcgcggaattcgtttgttgaacggcggcaccggaatcggcgctgtcataggaatagccgacgtggtcgaagctgacggtgattccgccatcggccttggtaccggccttggtaccggcatcagtcccggcatcggtaccagcggtggccggcagcgtggcagtgccgtgggcgggctcgggggtgtccagcagggcgaagatgcgcttggtggaggtcatgccgttcatcgccacgtggaagtaggagccgagctggcgcatggggatgaagaattcagcggacagcagcacgatcagcaacagtccggcgagggtgagcgggaagcccgcaccgaacggcatcaggtattgcaggccgtaggccaggtaggcgaacgcaccgggcaggtgggcggcgagcataatcggagaccagccggcggcgctggctcctgcggcggccgcggcggtatgcgcatactgccatagagccacaccaatgccggccgccgcaccgccgtaggccacgatatccatggcggtcagcgagcgcagctggatctgcagcacgcgcatggtcatgacgcggaagccttcggccttcttgtccatttcggcggcggcacggtcgtcggcgtcgaagttcttcagggtttcgaggccttgcaggttgtcgaggaatgcggcacccatgtcggtgtatcggccccagtattttttgaaggcgcgggcggcggtcatggatacgatgccggtgacaataataatgagcggcgcgcagacgagcatggtcacggcggccggcatgttgatcggcgcaatcacggcgaacagggtgatcggcgcaagaatcgcatagaagagctgcggcaggaacagttcgaagaagctttgaatctgctcgacgccttcgccggcggactggaccacatccgaggtcttgacgcgcgacctgtaggacgggccgagggccaccattttgcggtacagcttggaacgcaaagcgagcttgacctgttcggcggcttcggtgccgaggcgtgtggcgtgtgtggtggccaggtagcgaaccagcatgcagacgatcgccaaggccacgtaaaccatgaggtcgccggccatcggggcgacggtggtgcccggaacgccgaacagattggcggggcactcggaggccgaggcggcgttacaggagaaagtgtgtgggtcggctgcggcgagcagtccttgcagcagcatgaccagcgaaagcatgaagccgatattggcaagcagcccaacccacatcagagccactttgccggctatgagcttgccgagacctggtgccaattggaacagtcgtttgtcgaacatggttcgcttccccttgccgtgttgttgcggtgttggttgccgtggtactgcagtaggtctcgtcatgcatcagtcgcgggtgccaccaatcgcatacctgcacataccgatggcgtgcactgcgcaatcctatttaccttaggcgaaagcgcacatacacgccagaccttcagctgagacgactgtcacgctgagcttcgttcccaaataagaagccacagactccccaatgccgacgccgccgatgatgctggagctgatgaccggaccctgcagggccgggctcagcacgtacttgtcctgcaggaagtcgatggctcccgaaatggacacggtcataaccgtagagcaaaccggttagacacggcgttgtatacaatccacaaaaccagacagacaacttctccattgcccacaacgcgcgcaaccttacgccagcgtaacctaacttgtcagaatggctcgattttgtcaacagccatcacgcaacgcacgtaaggacacggcccgcttatgcttgaccactacaccacgcctggcgaatccatcgaaatccgcgacaaccagaccatctactccctacttaccgatcgccttgcccgcaccggcgcggacacggtaatcgccgccaagaaaatcggccccggccgctggcagaacgtcaccaccggcgaattccacgagcgcgtggtctcggccgccaagggcctgatcgcgctcggcatcgccaagggcgacgcggtgaccatcttttcctccacccgtctcgaatggggcattctcgatttcgcactggccgcagtgggcgcggtaagcgtgccgatctacgacaccgactccgccccgcaagcccagcgcatcatgaacgattcggcggtcaagctggcctttgccgacaaccgcgagcgcttcgaccggctcgactcggtcaaggaccactgtcctgccttgaagcagattctcatgatcgagggcaacgcgctgggcgcgctcgaaggtctgggcgtggctgtttcggacgaggaactgaacgagcgcgtggccaccgtgcgcgccgacgatctggccaccatcgtctacacttcgggctccaccggcaacccgaagggtgccgaactgacccacaagaacttcgtgtccatcaccatctccgcctcgcaggcgttgcatgaagtggtgcttgacgaccatccgcgcctgctgctcttcctgccgctggcccactgcttcgcgcgattcatccagtacgcctccatcgcctccgatgacggcgtggtcggttatctgccggacaccaaaaccctgctgccggacctgcgttcgtttgaaccgacctacctgctgggcgtgccgcgcgtgttcgagaaggtatacaacgccgcctcgcacaaggccggtgccggctggaagggccgcctgtttgtcaaggccgccgaggccgcgcgcgtctggagccgcaaggagcaggccggcgagcagcacacgtttgccgaaatcgccgagcgcgccaagtacgaaacgctcgtctaccgcacggtgcgcggtgctctgggcccgaagatcaagtacgtggcctgcggcggcgcaccactgtcgctcgatctggcgcatttctacaacggcatcggactgccgatgattcagggttatggcatgaccgaaaccgccgccccgttcgccgccacgcgcgtgaccgacaatgtgatcggcaccgtaggccagcccgcgcccggctcctcgattcgcatttccgacgaaggcgaactgcaggtcaagggcccgaacgtgttccgcggctaccacaatctgccggagaagacggccgaggcattcaccgccgacggctggctcaggaccggcgacttggccgagatcgatgatgagggccgcatcatcatcaccggtcgaatcaaggacattattattaccgccggcggcaagaacgtctcccccattccgctggaggaagagatcgccaagtgcccgatcgtggagcactgcgtggtggtgggcgaccagcgcccgttcatcggcgcgctggtgacgctcgatccggagtcgctggcattgtggctgcccgcgcatggactgtccacggagacgccggtggaccggctcgccacgaacgcggcggtgcgcgaggagattcagcagtacgtggacaaggcgaatgcgacggtctcgcgcgccgaatccgtacgcaagttcgccgtgctggacacgcagttcacgcaggagaacaagtgcctgacaccgtcgctgaaagtggtgcgcccggccgtcaatcgcgtgttcgccgatgtgatcgacaacgagatctacaacggcaagcggtgagacgcgcggttcgtaatccgacacaaaaaagggccttttgaaccgcaccccgattgttggactggagtaatccagattcgatgatcggaggtgcggtttctcatgtccagggatcgcaggcgtcattatgacgatgattccatgcgggtcgtcgccggggtgccgcccggcccaggtgggtcatgcccgggtcagtttcttgctcctgagacgcagcacgacatcggcggagttggcgacgcgcttggaatgcgtcaccacgatcacgcatttgccgagctgatgggcggcgtgctgcagcagatgaatcacctcgtcggtcatctccgggtcgaggctgcccgtcggctcgtccgcgaggatcgcgcggcccggggcgaccagcgcgcggccgaccgccacccgttgacgctggccgcccgacaggtgcatgatgttgcgcttggattcctcacggctcaaacccagttcctcgaggatcttcatatcggccttggcgctgaccagccgcaggttctcttcgggggtgaggtagtcgatcaggttatggtcctggaacaccagggacacgtgctcccggcggtgcttcgcatagcccgatgcggcgatgtcctccccttcgaagcggaccactccccgggagggggcgtccaggccggccagcagcgacagcagcgtgctcttgccggcgccggacgggccggtgatcgcatacatcttcccggattcgaaatccgcgctgacatccgaaagaacacggatcttcgccgcgccgtaggcgtaatcgacatggtccagttgcagacagttagacatgattggtgactcctaacgcatagaggaaagaatggatttcggggatttggacagcacggcggcgcatgacacggcaagagccacggcgatgaccgcgcatccgagcagcaggatgagcatcgtctgctcaggcggcaaggcctccacgtgcaacgattccaacggcgcgacgcccgaatcgcgcaacagtcgggaagacacgtatcccgacagcatggcgccggtgcccagcgaacacagggcggcgaccgccgccatgagtccggtttcgatggcgagttgtgcgacgatccgcatcttgtcgatgccgagggccagaagcgtgcctatctcatggatgcgtgagcgaatccagaagaccagcgccatcgccagcaccagtacgtccgcgaggcagacggacagcagcaccatgcgcaccagattacgcaccgtctgcacggattgcaggacgccggagagccgggccgaatcgtcggtgacgtcgtacttgccgccggccatggtcttggcccgtccaatagccgcggacaggtcctgcggattatccgacaggcatcggatcatgtcgatccggtcgtttccggtcagagcggaagctactcgcctacccgaatagatgaggttctcggaagtgtccgagggcagggggctttgggcctgcacgttgccggagaagatcccggccacacgcaccgtggcgttgcgcccctcctgccggagacggaatgtcgagccgaccgataggccgttctgcatcgcgaagtcgcggtggaccagcacattgtcgccgtcgcccgagatatggcggccctgctccaggcggtacaggccgctctggaattcctcggacaatgaggaatcggtggtgcccagcacgctgacctgcatggccagatcggagtccaatcgggggccctgccggggcatgaccgggcgcgcgccatccacctgcgccaaggtcttcgtcgcataggcggtcttcgtcacaccggggatacgcgagaaccggctcgcctcctcggcgctaatgggattctcgccggcgctgacggtaaaccctatgcccatgcccgcgccgatgccgtcggacatggtacgcagggccgtcgagactccgacctgcgccaccaggctcgtgaagaccatcagcatcagcagaccgatgatgccgctacgtaccggcttgcgtacgatcgccaacgtggcacgcttccacacattcatgctcatcatcgaatctccgacaggtctcgcggcgatttgcgcagcatcggcatgcacgccaccgcgacgcacaccagcatcaccgccaacaatccgagcgccacgtacagcatggcggtcccgtcgaccgacaccgtgagcgaatccagggtgcgcaccgacatgctggattcaagatcgccgccgacctgccccatgctgctcagctccttcgccgcggaggcgttcacggaatggagcgccgtggcgccgagccattgggccattccctgcgcgcacagccagccgagggcgagggacggcagaccgatcagcaccatctcggtgaggtattgggcgaccagggagggcttgccgacgccaagggacaccagtatgcccatctcttgacggcggtcgttcatccacagcagcagcatgagactgagcacgagcacggccgagacggtcacgccgatcagggcgccgcgcatcatggagcgcacgccgcgggcggcatgcagcatgctcgatgaatactggtcgttgcgcgtgatctgatagttgttccaatccaccgggagtttcttcgcggcatccatggtcttctccacgtcaacgcccttggacagcacgaaggtggcgtcctggtatatttccttgccgtccttgtactggtacaggtcgcgtgtggtatccagatcggtgtagatggtgttggcggtgagttccgctcggctggatacctttctggcgctgtcgcccttgaatatgcccacgatggtggtcttgacggtcgccgtcgaatgtgattcgttgtcggcgtcataggcgttggccttgagcgtgagcgtgtctccgactttgagcccgttggctttggcgagatcctcatggatcatcgacgtgtacttgtcggaggccttcagatgtcgtccttcggccatgccgagcgtgcgcgacgtgaacacgttgagtttcgacgaatcattcgtgcccatgacgttggcggcgttgccaaactgctgctcctgggtcgcatcgtaatcatcgccgccggggaccttcgccacattcgcccccacgagatcggcggtggcgttctgacggaccatatacgaatcgaccccgggcagttgggcgatcctgcgcacgtcggcggggcgcaccatgccgcctccgcgaggcgtgagcatgctgccctgcatgttgctggacagcacgaatccaccgaccgcttccttctcgattcgtccggcggcctgttgagctgcccgagaaaccgcgatcgtggatagcatgctcgccgttatgatggtcagtattataaggagcactatggttcgcactcgttttctgagcacatagcgcaccgaccgtgcaacgaacgtcatcaatacctcctgtgggacttgggcttttcgcccaaaatgcgaaacatgccgcgtttcgccgattagttagccgcgacgatacatgatgcacctcaagatacgggagatatacgccttgagcgaaaaacggaacagcggcgaatgtcggttattctggattttggtccatctcgggccgcgtcgatgcgtcggcccgcgagaaatcaggctcgcgcctcaccttcgaggcggcgaacacaagaagcggcagagcggcgaacgcatagttctcgcattggatgtacaggtatgcgaccaggacgagccagcagatgacggtcttgtgccagacgccggattcgcccgaacccgcgccggcaacgccaccaccactattacccccggcaacatcagcaacgtcggcaacgtcggcgacacaaacaccgtgcgccagctcgtcggacgatgcgccatccgcaccgccacggcataccgtcctcccgcgcgtcatgcagaccatcgaggctccgaccagcatggccagcccgatcagcccgtattcggcgatgacgctggtatacgcgcacatcgtccacaccgtgtccgcgttcacgccggccgcgaatcccgtggccgcgccgccgttcataccaagaccgtccagcagccgtccggctttggccgcgccggcccacaccgcattgatgatgttgcccgcgccataaccggtgagcagcgtccacggatgggtgagcaatccgcatatcggatcgaggctttggtagatccgcgcgaagaacgatccgtctccctcggccccgttctccgcgatggcggagagtctggaatccgccagcacacccagcaggcccagtgcgcatgcgccgagaatctgcagcataccccggacgcggcgtgcgccgtcatgccaatcggtgcacgccacaagggcgatcagcaacgccacgacggaatcgatgacgattctggtgccggcttgcatgagcaccgcgccgacggcatacgtgacgatgaggtcacgcagccgtttggcgtagatgcggtcgcgcccgcgcatgagccacatgagcggaagcagtatgccgaacaggtgcatgccgatatagctgggctcggcgaacaggaactgcggacggccgccgccccacaccgagttgtcgctgatgtattgccggtacatgaggtgcgagaaatagtcggtcaacggtttggcgtgcagacggatggacagccattgcacgacgcccactccgaaggaaacccagtatgatgcgatgagaatccgcaatggcgtacgccacggaatgcgtttgatgtcgaacgcaagggcgatcgcacccaaagtggcgagcacgcccagcaatccggtgatgctcatgaacgcggcgttgaggtggatgccgaacttcagccatcccgggatggacaggattatacagaccaccggtaggaggaacattggcaggtaccggttggctgcgatgcgcagttgccgccaattgcataggcagtacacggcgaacagcgccggactgattggcgaccagaacggcgcgtacaggccaagcgtggtgccgtccaccggaagaaaagcaatggccagcaacagccaaatgacgttgcgttcctgcgatgtcagaaatcgcaggaacgaccggtattgcggtcggccatgatggttgcccgcgtcgatggtgtcgttgcgtacgcatgcctggttcatgtgattctccctccccgtcaaccttactcgttcatcatgatgcgcggacggggcatgctttccccgctgaaagtgcaatggcccgaacattgacaaggtcacaccgaatgcccccatcattggcacattgtgcgatctcgtcgcggctggctaacgaaataatgttggccgaccggttacattggttcggtacagtggcggcattatcggccactgaatcaagcgattcgcggcagaacgacgaaaacaacacctgggcgaaaagaggcaggcatgactacgaatcgaccgctcattgcggtgactccgctgatggattacgggcgcgatagtctgtggatgctgcccggatatatggaggcgataatgcgggccggcggtacgcccgtcatgttgccgctgaccgatgacaccgacattcttgcgcaatgcgccgaacggtttgacgcgtttctgtttacgggcgggccggatgtgggaccgatggttggtgcagcggcctccgccaccggccgtagcgaggtgctctctcctgagcgcgaccgaatggaatcgattctgctgccagctgtaatggcttgggacaagccgattctgggcatctgccgtggcattcagttcatcaacgcagcgctgcgcggcacgttgtggcaggatctgccaagccagcatccgagcgatatcgaacaccatatgaatccgccgtacgatgcgttcggacataacgtttccttggtgcccggcactcccctggcttcattgttcgcagggcagactgagattgcggtgaatagctatcaccatcaggcggttcgtgagcctgctgctggactcgaagtcatggccgttgcgcccgacggcgtgatcgaggccctgtaccggccggcaagccacttcctgtgggccgtgcagtggcatcccgagtttctctacaaggtagatccacgctcgcaagcaatttttgatgcgtttgtggggagttgccgataacagcaaaaggggctgctccggtttcccggaacagccccttttcagcggtagcagtcagcagactgatttagtcatcagtgctggcttgccagcgctgattggcgcgtgcggagaccgccgtccgaaggcgaaggcgtacgaaggtacgtcgaacctgaggaaaggcggtatacgctccgccaatcagtgctggttgttgagacggtggtacatctcggacagctccagttccttctcgaactggcgagcggtggtgttctcgtcgatgacggcgagctcaacaccggcgatgcgggcgaagtcttcccaagcctcacgaccaacggaggtggtcatgcaggtgtggtgagaaccaccggcggtgatccagcactcaacagcggtcttcaggctcggcttcggctcccagacggcgcgggcgcacggaagctccttgagggagccctgcggctcaacgacgtcgacgacgtccatgagcaggcggaagcgttcgcgaacgtcggacatggagaccacgacggcgtccttggcgggcttgccggagaagaccaggcggaccgggtcggccttgccgccgatgcccagcgggtggatctccagcttcggcttggcgatggtgccgatggacggggaaacctcgagcatgtgggagcccatgtcgagctcgtcaccctcggtgaagttgtaggagtagtcctccatgagggaggcgccaccctcaaggccgtagcccatgacggcaccgatgcgcacgaggacggcggtcttccagtcgccttcagcggagaagccccagccgtactcggacgggaagcgctgcgggccaacgcccggcagctgcggcagagcgccgaggtcctcgaagttgtcgacgccggcggtgcagccgttggcgcgcatcatgttgaccatcgcggcctcttccttggcggcgatgaacagggagtcgtacttggcgtccagcagagccgggtcgacgtcgtacttggccttgtagtcctcgatgatctccttgacctggtcgtccttgacggcgtcgtacgcagcgacgagctcgttgacggcccaagtgttgatggaggcgccgaacacgcgctcggcctcggtcttgtcgccctcggtgacggcgacgttacgcatgttgtcgccccagcgcatgaccttcatgttgttggaggcatcccagccggcgcaggcgcgggcccaggtaccgaccttctcgacgacctcaggatcggtgtagtggccgacgacaaccttgcgcttgatgccgaggcgggagacgatgtaaccgaactcacggtcgccgtgggcggcctggttcaggttcatgaagtccatgtcgatggtctcccacgggatttccttgtggtgctgggtggccagctgcagcagcggcttggtcagcacttcgaggccgcgaatccacatcttggccggggagaaggtgtggcaccaggtgatgacgccgatgacgttcgggttggcggaagcctcgaccatgaattccttgacaccgtcggaggacttcagggtgggcttgaggacgatcttggccggaatcttgccggtgttgttcaggtagtcgaccatttcagcggagtgaatggcgacctggcgcagggcttcttcgccgtacaggtcctgcgaaccaacgccgaaccagatttccttgccctcgaaggggttttccataaccatagggttacttcctttacttctttgtttatgggggtttgtttaagtttcattcgccgaccgaggctcccctcagtcagctatcgctgacagctcccctcagagaggggagccaagacaccaccgtgctggcggagtcagcgctgatttgatgtgtgtgtccgcaaggcgcggaaggcgaaggcgtacgaaggtacgtcgggccttccgtaacgcggcggacactccatcaaatcagtgctgaccgtagacgttctggtagcggtcgttgagcttatcgatgtcggcctggtcgatctcgatgatgtcaccgagctgacgggcggcccacatggtgtgagcgacttcctcggtcatggcagcggccttgacggcgccttcagcatccttgccgatggtgaaggggccatggttctgcatgaggacggccggggacttcgggtacttcttgagggtctcgacgacacccttgccgatcgcctcggagccgatcagacggaacgggccgaccggcaccgggccgccgaactcgtcacccatcatcgtcaggccgcacgggatgttctgaccagtggcagcccaagcggtggcgtaggtggagtgggtgtgcacgacaccgtagacgtcgggcatgttgcggtagatgtaggcgtgggaagcggtgtccgaggacggggcttcggtgccgtcgaccacgttgccgtcaaggtcgcacacgaccatggaggacggggtcaggtactcgtagcgcaggccggagggcttgatgacgaacaggtcggcggtgtgcagacgctgggaaacgttgcccgcggtccacacgaccaggttccacttgatcagctgctggtgcaggttggagacgacctcacgaacctgcttgacctcggcgcgaacctcggggccgtaatcagccaaagttgccattattggttttcctttccactgtgatggatggacgttttttcaaaatctcaaggacctccctcaatagagggaggtcagaaaggcttacttatcttcgaggttgatggtttcgatggcggcgtgctcgatgggcaggcccttggtgaagcgggcgaagaagtcctcgaaaccaaccacatcggaagccaccggcttctcagtggtggactgggcgtccttgaacacgcaaccgtcaaggaagtcagcgaggttgctgtgatcctcgttggtgttccacaggtagttggcgagcacggccatgccccaggcgccaccttcggcggcggtggacatgaccttgatcggggtgttgaaggcagcagcgagaatcttctgagccaccttcggagtggcgaagatgccgccgtggcccacgagagagtcgacctgcacgcgctcctgcttggtcatcacgtccatgccgatcttgaccggggagaacgcggagaacagctgggcgcgcatgaagttgccgagggtcatgttggcttcggggctgcgggcgaacagcgggcgaccttcaggcagaccggccaggaattcgccggaacggaacgggtagttcagcaggccgccgcagttggcgtccacgtcgtcggcgatggccgcgcggaacagggtgcggtacagcataccggcgtcaaccggctggccgatagccttggcgaactggccgaacaggccgacccaagcgttgaggtcggaggtgaagttgttggcgtggctcataccggccagatcgccggccggggtggtgaccaagtcaacctcagggtggagggccttgagcttgtgctccagaaccaccatggcgaagatggaggtgccggcggagacgttaccagtgcgtacgcgcacggagttggtggctaccatgccagtaccggcgtcgccctcaggcggggcgagcacgatgccgggcttcagggcaccggacggatcgagcagcttggcgccttcctcggtcagctcgccagccggagtgccggccacgagcggctcaggaagcaggttctccagcttccacggctgggctgcgacctcaggcagagcgtcgaacttctcaatgaatgcggtttcgtaagtgtgagtggtcgggtcaatcgggaacatgccggaggcatcgcccacgccgaggaccttcttaccggtgagcttccagtgcacgtaaccggcgagtgtggtgaagtaagccaccttggagacgtgctcttccttgttgagcacggcctggtacaggtgagcgatggaccaacgctcggggatgttgtactggaacagctcggagagcttcttgtgagcttcggaggtgttggtgttctgccaggtgcggaacggcaccagcagttcgccggcctcgtcgaatgcgaggtaaccgtgcatcatggcggagaagccgatgtggccgacgtgcgtgagcttctcgccataggcggtctcgacgtcgttggccatggaggcgtaagcggactgcaaaccgccccagatctcctcggtggtgtagctccacagaccatcctccaagtgggaggcccagctgtagtcgccggaggcgatggtctggaagttgtcgtcgatgaggacggccttgatgcgggtggagccgaattcgatgcccagcgtggtcttgccagcgcgaatcttctcggcgatgtgggcggcctgctcggccgcgttgtcggttgctgccatatctttcctttgccttggagcgccggcgttgttatccccttccttggggagggtgttagcgctcacaatttccaaaaaacattgtaccgacaacccgcattcgacacaacttatgccgtgtcacgcatcataacggtttgataacagcgccaatttaccgccgaggagccggccccaaggaccgccgggcacgcacctcggcgggaatcagccccatgccgtgctgggtggtcaggaaggtcggctcgccgccctcccccagcaagcgcagcgtctctcgcatggcggccacgccgagcccctcgaaatcgggatgcacggtggtcagcggtgggtacatgttatccacgccagacatgtcgtcgaatccgaccacgctgatgtcttgcggaatccgaagcccatgctcatgcaacgcgcgcatgatgccaacggcctgattgtcgttcgcggcgacgaccgcggtgggcaacgccgcgcctcgacgcccatactcatcaatgagatgattcatgtgcgcatatgcctcagaggcatcccacgtatggcagcgcacgatctgtgaatcgatggatcgggaggcggcgagcttgcgccacgcatccagtcgggtgtgggcgtcgcgccattcgttgggaccggcaaaatacagagccgatttgtgcccgtattcgcccagcaaggccaccactttggccattgcaccccactggtcgataccgaccagcgcagtgcgacgcttgttttcggtggagataaggcccaatccctcacgcacggtcatttggccgtgggtggcggtgacgatgacgcgcggctgagtgactcgtgcacggcaggcggcggcgaacatcacgtcggtcggggtcaggaagatgaaggcgtcgacgttctgctcgttgaaggtgtcgcacaggttgtcgaagtcggcctgcgcgcacaaggcctcgtggaccatcatcacgctcatgaacagaccgtgctcgcgggccatggattcgatggaggagatggaggaaatcgggccgaagaatttgaggcctccggcgatcagccctatggtgcgcgaacggcgggaagccagtgcgcgcgcggagttggaggggcggtagccgagttggtcaatggcggtctggactcgcgcacgggtggcgtcggaaacgtccggcgagtcattgatcacacgggagacggtttggtggctgactccggcgagcttggccacttcgaacatggacggacgtttgcttggcttgcggctggtcaccatattgcctaacctccccgctggcggccggcatccatgcacggccagtcttgtaccttaatcaatactgactttagcgcgtccacaacagttttgcgttagcgctcacactgtcgtgtcgcacgcggctcaggtcaggtgccatgagacacgatggagcggagtcggcccgtgctcggcgatggcggtacggtgtgcggcggaaccatagcccttgttatgagcccattcgtaggcggcgtaacgtggtttgctttgcgcgaggtcgaccatcagccggtctcgggtcactttggcgatgaccgccgcggtggcgacggtggcgcaatgctggtcgcctttgactttggtcgttatgtcggctggaatcggcacgtccggcgcgtcgaacgtgttgagcgccttggtgatgtaatcgctcggcccgtcgagaattccggcgactttgggcagagcgcgaacgcttccctcgcaatttccaatggattctcctacggagcctcccggacgaccttccacaatcttccccgcagactcccccgaagccttttttatcgtcgattcccctccaagtcgtaagccaagttcgcgttcgacttggctgagcgcgcgcagggcggccacgccaagcgcgtaggtgatgccccattcgtcgatctcggtgttgctggcctggcctacggcgtaggccgcgcaccagtcgcgcagttcgtcgaaaatcgcctcgcgcctatgttcggtgagcattttggagtcggccacgccgtccggtacgccgaggtaggtccgcccggacagttcggcggaatcatcgccgtcaagcggcgccaaatcacaggcccagatggcggcgcacccgaccatcaccggaccggcgagcgcgccgcggccgacttcatcgaatccagtaataaggtcatagccctgggccgcaaggctgcgttccaagtcaagtgtcggggtaatcatgcgcggctcccatcgtctcacaatggttaggattcatatggttcaggattcagacggcccggaactcaatcagttcaaagactcacacggttcaaaaaaactcaggaattcgagccggaagcgtcagacacgtccttgaagacttcgtggtggtcatcaatcgcaccaagccggtcaagcggccagtatttcgcgattccgactccgaccacatcggagatgggaaccaagccgcgatcgccgtcatcctgatgatagcgggagtcggcggaattggcgcgattgtcgcccatgacgaacacgtggccctcggtcacggtcaccgagaacgggaaagcgctcgggtccacgccggggcgaatgtaggaggtctcattgatggccacgccgttgatggtcaccggctggcccgcgcccttgcattcgaccacgtcaccgggcaggccgatcagtcgcttgatgaggtacccgccaccgggagcgctgctctgctcctcgttcaaccagttgttgggatctttgaataccacgacgtcgccgcgctgcagatcgaagatcttgggggtgagcttgctggtcaccacgcgatcgccgggcaccatggtgtccatcatcgagcgcgaaggaatctcgtaaaagccgacggcgaaaatgcgaatcagcagcacgataagcacgggaacgccgcaccacaggaaaaagtcgcgtagggtgaagtggtcatcatccatcgatgatgctgccgcggcattcgcgccagcggaagaagcggcgtacgccgggcgcgccggtgccgggggaaccggggacggggcgatgccgtggtcggcgacttggaacgtacgggaatcgcgggcatcggcctcgtcatcatacgaggtctgattgctctccggattgtcggaaatcgggaattcgccgttatcctgatcgtcctgcataccatctcctcgcgattcatgctgccggatatgaggggtgccggcgcccgtccatcatacgtggaaaatacgaaaacagcccgaaaccgaaacggttccgggctgaatttcacggtttattcgcgcacctgcatcatcaggctcacgattgcacccgcgaatcgactcacttagcggagttgtcgcggcgctcggcaatacgagcggccttaccgcgcagagcgcgcaggtagtacagcttggcgcggcgcacacggcccttacgcacgagcttgatggagtcgatggacggggagtgcaccgggaagcgacgctccacaccagtgccgaagctgatcttgcggaccacgaaggtctcacgcacgccagcgcccttacgagcgatcaccacgccggtgaaggtctggatacgggagttgttgccttcctggatcttcacgttcacgtcgacggtgtcgccgggacggaaggccgggatttcctcagccggcttcatgtgcttggcgtcaaaagcctcaacagcgttaaccattgttttccttcagtgctgccgcatatcagccacagatctggggccatccacgcgattgcgcatcacgtgcgttggcctgttctcgttatccctcgggtttgcccttgggaagcctgccgatccgccgaaagtcaggccttgcggccgttcggactggacccacggagacgcgggcttatgcggcggcccacttctcgacacagcaatcgattattgtacggattcttgcggacagaatggctgtcggatggcattccaacaccaaggcactgcgacgtagttgacagacctgcaggcgggctttatcttgggagcgtcggtaggcgaggctaccgcagggatatgggttgctgccgctaacagtggagacactgcacgcaggtcagcagttcttgtcggatcaaggcatgaactaacgcaattccaccgccctgcgatgctgaagcttgaacgatggcacgaatcggcggattcgaatactttccgcccctcctgctggtcgcatggataccgacgatggtattgatctggcgtttcagcgcacggcttgaaggaggtgagagtccgatggacggtgattattccagtagttccgccgccggcaacagtcatagttgcggtggtgatgaccatgttttcttatattccgttatccggaagtcgggctctcgcctgtagtgttccttggctccccggataacccttgcataattcgtctttcctatgcatagggaggtcttttcatgaccatgttttcattcaatcgcgtcggcgcgcgtccaaatgcgtcggcccgcaacccttccaccgccgcgtccgaccgccaaccattcgccgtgcgcctggcctccgacgtactggtcgcggccggtattctggcgctgttcggtctgatcgcttggattctgccggcgatcggcgaaccgatcggcccgaaaggagtgccgtcacaagtcagtacgaatctcgccgacctgccgtattacgcgctgcgctcggtgttccgtatgttcgtggcactgttcttctcactggtgttcacgttcatctacggcacggcggccgcgcgctgccgccgcctgagccgcgtgctgattcctctgttggatattctgcagtcggtaccgattctgggctttctttcggccaccatcaccatctggatggtgctgttccccggctcgatgctgggcgtggaggccgcgtcgattttcgcaatcttcaccagtcaggcctggaacatggcgttctcgttcacccggtccctgaccagcgaaccaactgaactcgacgaggcggcccgctcactacagctcacacgctggcaacgattctggacactggacgtgccgaacgcgatgattccgctgctgtggaactgcatgatgagcgtaggcggcggatggttcttcctgaccgcctccgagatgatctcggtgaacaatcgcacctatgcgttgcccggcatcggcagcttcgtggcacaggcggcggccgaggagaatctcgcggccatctgctgggccatcgtgacgatggtgctggtggtgctgcttatcgacgtactgctgtggaagccgctgaccgcgtgggcggagaagttccgcattacgcaaagcgagtcggcggtgcgcaagaccagtgtggtgctgaccatcattcgtcagtcacatatcgatgagatggtggcctggctgttcaggcctgtcgacgacctgttcgacacgctgacccgcccgttgggtcggaccggtggacgttgggcggcggacgtgaagtccgcacgcagccgcgcgcttgacgtggtattcacagtactggtgttggcagcgtgtgcgttcggactggtgcagcttatgctggtgattcatcgcgatgcgggattcggcgagctcgggcaggcgttcgtgttgggcatggtgacgttcctgcgcgtggcgctgctcacgctcgcctgctcggtgatttgggtgccgattggcgcgatgattggcatgaatccgcgcgtttcgcggtttatgcagccgattgtgcaggtgctggccagctccccctcgaacttcacgttcccgttcgtcacgctgtggttcgtggcgtgcagtgtggatatcaactggggcagtattctgctgatggcgttgggcacacagtggtacatcctgttcaatgtgatcgccggggccagccagattcccgacgatctgcgtgagatgacgcgcagcttccagctggggcgctggcagcggtggcgcgatttgattttgccggcggtattcggctcgtgggtcacgggcggcattacggcggccggtggggcgtggaatgcctcgattgtctcggaaatcgtaagttatggacggcatacgctgaccgcctccggcttgggcgcgtatatcgccgaggccaccgaaagcggcaacaccgtgaggaccatcatcggcgtgaccgtgatgagcgtgttcgtggtggccgtcaaccgcctgttctggaacccgctgcagcgcatggccgagcgccgtttcgcactgaactaaagacttaaggagaataatatgactgttgcaatggaaaccattcgttcgctgcgggcggtgaccccgcagaacaccatcatcgaagcccagcacgtcggccagcgcttcacggccgacaacggcaccgaactcaccgtgttcgacaacatctcgttcaacctgtacgagggcgagatcgtggccattctgggccgttcgggtgccggcaagtccacattcctgcgtgcgctggccggactggtcaagccgaccagcggcacggtcaagtatcgcggcaaggccctgaccggcccgaatcccggcatcgcactcgtgttccagaccttcgcgctgatgccgtggctcaccgtgcaagacaatgtggaactcggtctgaaggcgcgcggcgtaccacgtgcggaacgcaccaaactggctctggacgccatcgacatgatcggcctggacggcttcgaatcggcgtatccgaaggaactgtctggcggcatgaggcagcgcgtgggcattgcacgcgccttggtgctgcggccggacgcgctgttcatggatgagccgttctccgccctggacgtgctgaccgccgaaaacctgcgtcaggaagtgctcaagctgtggtcgagcgaacagcgcagcatcaagtcggtgcttatggtcacacataacatcgaggaagccgtggagatggccgaccgagtggtggtgttgggctcgcacccggggcatctgattgccgatgtgcgggttaatctgcagcgcccgcgcgaccgtcacagtgtcgaattcgaggcgatggtggaccgactgtacgcgattttgaccggacaggcctcgcagcctacgcaacaagccgaggctctatcgccatcggcatcgctcacgaacgcatctgtcacggacgcatctgtcacggacgcatcagaccttcagcccgccaagaccatcgagaaaatcaaggagcatccgctgcccaacgccacgccgggcgggcttgccggtctgctggatgtggttgccgagcatcctcacggcatcgacttggcagatttggcctcggctctttcgttcgaggtggacgacctgttcccgctggtggatgccggtacgatgctgcgcgtcatcgtggtacgcgacggccatgtgcaaatcaccgaggcgggcgactcctggcataaggcggacattctgcgcgccaagcaggtgttcgcctcactggcgatggaacacgcgccgctggtgcacaacattgagcatgcactgcggaagtctgcggaaggcaagctccgcggcgagctcatgctggacctgctgcgcgcccgttacgccaacgacgaggcgcatcagcagttcgccatcgccgtggagtggggccgttacggcgaactcttcgattacgatgccgatgacgatctgctgagcctggatgaggcgaataagggcgaataagcgaatcagccacgtgagttggctagatagtgcctttatgcctgcaaacagatgccgaagcggaatatgaccatgttcgactcatctgactgacagcaatccgtatatgcaaagtgcccggcatccgaagatgtcgggcactagtcgtgagagagactccctcagtcagctacactgacagctcctctcacccgagggggcaccagaggaacgaatcagaactcgcgacgtgggcagtcgccagactgcccaccagacagcacagccgcggtcgcgcgaatcacgaattctgaccgagcaaagcgaatcagaactcgcgccgtgggcagtcgccaggctgcccaccagacagcacagccgcggtcgcgcgaatcacgaattctgaccgagcaaagcgaatcagaactcgcggttcttgcggtagaacttgatcaggctctgggtggaggcgtcctgggcggcgagggcgtcgtcgtcctgggagatggccggggtgatctgcttggcaagctgcttgccgagctcgacgccccactgatcgtaggagtcgaggccccagacggtgccttcgacgaaggtgatgtgctcgtacagggcgatgagctcgccgactgcgaacggggtcagggccacgccgaagatggaggtggtcggacggttgccggtgaacacgcgggccgggacgatctcctccggggtgccttcggcgcgcacttcgtcggcggtcttaccgaacgccagggccttggtctgggcgaagtagttgcccaggaacagctcgtgcacgtcctggtcgccgtccttggtcgggttcggggtgttgacgaacgcgatgaagtcggccgggatgagctgggtgccctggtggatcagctggtagaaggcgtgctggccgttggtgcccggctcgccccagaagatctcgccggtctcggaggtgacgggggtgccgtcccaacgcacggacttgccgttggattccatggtcagctgctgcaggtaggccgggaagcggtgcaggtactggtcgtacggcagcacggcgtgggaggcgaccttgaagaagttgcggtaccagacgttcagcataccgagcagcaccacgacgttcttctcgaacggggtgttggcgaagtattcgtcgatctcgtggaagccgtgcaggaactcctcgaagcgggccgggccgaagacgacggccagagaggtgccgacggcggagtcgacggagtaacggccgccgacccagttccagaagccgaacgcgttgttcgggtcgatgccgaattcggcgaccttctccaggttggtggagacggcgacgaagtgcttcttgatggcttcggcgttcttctcgtcggagccgtcgatggcgcccttggccttgagctcttcgagcagccaggtgcgggcttcgcgagcgttggtcagggtctccagggtggtgaaggtcttggagacgatgatgaacagggtggtctccgggtcgaggcccttggtcttctcggccaggtcgttcgggtcgatgttggagatgtagcgggcggagatgccagcgtcagcgtacggcttcagagcttcgtacaccatgacggggcccaggtcggagccgccgatgccgatgttgaccacggtctcgatcttgcggccggtcacaccggtccacttgccggaacgcacgtcgtcagcgaaagcgtagatcttgtcgagtgtctcgcgcacgtccttgacggtgtcctgaccgtcaacgatgtacttgccctcgtcttcgaccgggcggcgcagcgcggtgtgcagcacggcgcggtcttcggtgttgttgatgtgcacgccggtgtacatagccttggtgcgctcatcgagcttgacggccttggcaaggttggcgaacagctggagggtttccggcttgatcaggttcttggacagatcgaagtgcaggtcgccggcgtcgaaggacagcttctcgacgcgctcggcgtcctcggcgaaccacttcttgaggctcacgccttcgacctgaagctcgtcatagtgcttctgcagggcagcccactcaggggtctgggtggcgtcaacgggcggattgatggccataggattccattcctttcatcagtgactggagcgcccttgcacacggctcggatgcgctccgtatcaccaaacagaatactcacaaattcggacatgaacagaacaaaatgagtcagcgatgtcggattgccatcgtttgcattatcgaacagttcgtggcgcggcgcaaccgtcatcttcgactgagcggtcgcgacacaaccgccaatccgccgattggacttttcgctgggatgtcttatacttaatttcttgtgcgcggctggcgaaatgccttccgcgaaccaagccactttagctcagtcggtagagcggctcactcgtaatgagcaggtcgtcagttcgattctgacaagtggctcggatgccctaggctggtcggtctgtaatggctgtccggcctagggttttgcatatctcccacacctgtggaaacgcggatatgcacgcgcgagtggcggaattggtagacgcgcaggatttaggttcctgtgtctttgacgtgtgggttcaagtcccatctcgcgcaccggcttgagcctcttggaagcattggattgccaacgcttccgggaggcttttcgtatatgcgcgcggcagctgcaagcccttgcggacacctctacatatggcaatgccaaggcggcaaatataatgggccacagcattgcgggtctgagcctgtgcgccatgagcctgtgtgagtcaaggagagaagtgtatgtccgccattcttacgccggttggtctgttgctgatcatcctcgccggctatctgttcaagcggttcggcctgttcgggcagaaggattatcgcgtgctgcaaaccgcggaattcaacatcgtgctgcccggtgccatcgtatactcgttcgccaccaatccgcatgacatctcgctgctgcttatttcggtattcgcattcctgtttgcttttatcccggtcgtgttcatctttctggccacccgcaagcgcaatgtgaccgaccgcgccttcctgatgctcaacggtgccggcttcaatctcggctgtttttctttcccggtcgtccagtcattctggggtgcgggcgcggtggtgccggctgcgatgttcgatatcggcaactgcgtgatggtggccgccggcaccaatgtgctcacccagcaactgctgcatattcagcccggcaaaacacttgccgaacaacacgccggttcggctcccaccctaccgtacgaaaagcccaaggatcgcgacgccaaacggcttgcccgccgcgcattgctgcgcaccatcggcaagagcttcttcggctcggtgccgttcgacacgtatctgctcatgatcgtgttgaccgtcgccaacgtgaagattcccgattggatcgcctctataacccagccattgagcggcgccaacgcgctggtgtcgatgctgatggtgggcatgctcatggacctgccccaatccaagcatgacgtgaaggaagtcatggccgtcatcgcttggcgtataccgttcagcgtcgccttcgcgttgatcgcgtggttcctgctgccgttctcggcttcgattcgcgccgtgatggtgatctgcgcgttggctccgatcgccattttctccacgctgttcaccgacaaagtactcggcaacgccaaactggccggcttctcgctggcaatcaccgcgatgatttcactggtgatgatggctgtggctcacgcgctgatgggcgtgtgagcaaatgcgcaagtaggcgcacggcgggcgcacggtcaggcgagacgcagcccacataggttcgtcccccggccgccagctgctaccggtgcagcagcttgtgcgccagattgctcacgccgaagcggaacttgtccaccggcaacgtgaatttgcctaccatctgctcgacgtagccgttgaagccctgcttgaattccagcacgccgcggccctcgtcgttcggatcgtcgaacacgccggaaatgccgtagaagttgtaacggctcacaccctgttccacacacaggtgcagcatcgcttcgtactgaatcagcgccgaggcgtagaacggcttgtactcctccaacgaaccggaatactgatagaccacctcattggggtgactgacgaacattgaagccgctgccggcagcacatcgcccttcttggcatatccctccacctcagccagacgcttgtcggcggccgcgagattgcgcgattcctcccccagctgacgttcgatgcgcgtggtcggacgttcatcgtatttcgtctgcagctgtgcgaccttggtctgcaaggcctcgcgcttggcggtcatatccgccacatattcggcgatgtggatttccgcgagcatgaaatgcgcatccgcgccatacgcctgcttgaactggcggaaatagtccgcgccacgcgtcgcgaacccacggcgttcaccggtccgccgttcgatatcggcgaacacgtcgaactcgtcggggccgatttcgcgaacgtgcacacccatcgactgcgcccgcttgacactccactgagcacgtttgccgaatgatgccagcagttccttgccgttggtgatgccggtgagatccttgacgtacatccactggcagaccacgtcataaccggtatggaatccgccatgcatccagccggcatcggtgaatccggtcagcagtgcatcgttcggctcgccgtcgggctgcccgtccgaggaatacagacggtaggcgacgttaggccagcatgccacggaaacagcatggtggcgacgggccgattcacgaatcgcctcggttatggcccgcagcagagccggatcatcgctaatgccgatggggccgaaatatacggagccatctgcaccgaaacgaccattgaggtacagaatcacgcagccggttaccagattgccggatgcgtcgcacacgccaacgcattcggcttcatgcccacgaatcttggcaagacggacctgcccggaccattgctggaagctgccctggcttgtggcttcggaaagccggtcgagctcttcgggcgtaatcacgccaaacgtatacgtcgtatctgttcgattcgcagtcgcgctcatctcgtcgtcacctgtgccttatttctgtgtccgtgctcgccactgtttgtcagcgatgcagcagcttgtgcgctgcttcggatacaccgaagcgcagtccgtccaccggcagcgtgaacttgcccggaagctcttccacgaatccgccgaagcgagtcttgaactgccagacgccgtaggaaggatcgttggcgtcgaaaataccggaaatgccgtagaagttgaagcgctccacgccacgggcgatgcagtcaagcatcgcctcgaagtggattagggaagacgggtagtaatccatgaaacgatcgtcctcgccgctggacaggcagacgacctcgttcggatgccagaagtagacaccggcttccaccggaatgaccgggccgtccgaagcgatgatgccattgacttcgccgatggtcttttccagcgccgtgatcttcttgtctgcggtggcgatgcgcttttccagcgttgccgggtcggaagcacccttcttggccgtgccttccggccgctgttgcgcgcgctggagcaggcgttcgaggttgcgcttgtctttggaggccgcattcagcttggattgcagggtgtccagatattcgtcgaaatgggtttcgaccaccttgaactcgatcaggtcgccgaaggtatcgaacagacgctcatagtaggccagatcgcggctcttgaagccttgacgtgcggcgctcatatcgcacagcttgacgaaagtgctcagttcgccgcgttccagccggcgcacgcgcagaccggaatcctgggcgatgcggatgttcttacggcggtacttggagaacgaggccagcagttccttctcattatgaatgccgtcaagccccttgacgaagttccagcggttcaccacggattcgtagcccacggtgaaaccgccatgtttccaaccgaagcgggccatgttgtccatcatcgtggtgtccgggtcgctggtcggcttgccgtccagatcatgcagacggtagactgcggccggccagcaggatacgctgatggcgtgatgggccttggccgaacgacgcagggcttcggtcatcgcctcaaccacctgtggattgtcataatcgcacagcggtccgcaccagaccgagccttccaaaccgaaacgggaccgcgtgtacaccacgtagcaggcggcaatcagcttgtcaccgcgcttgacacccacatagtccaccggaccgttgaacgcacccatggcggccatctgcgaggtctgctggaaactaccttgcacttgagctgcggagaacgcatccagctcggcaggagtgatcttggtaggggtgagtgaggcgacgcctgcatcggattgcgtcataatcgaaccttcttacttgtcgttactctgatcgttactctgggctctggaacggcctgtgtgctgcgtccgtttaccgcgacagcagcttgtgcgcaaattgcttcatggcataggcgaccggtttgaccggcagtacgaactcgcccggaagttcctcgacatatccgttgaagccctgcttgaactccagtacaccacgcccctcgtcatcgggatcatcaaagacgccgtcgatgccgtagaagttgtagcgagacagcccgtgttccacgcagaaatgcagcatcgcgtcatgctgaatcagcgcggaggcgtagaagggcttgtactgctcgacgctaccggagaacaggtagatgacctcgcgcggatgctccacgaatagtgatgccgcagccggcagcacatccccgtctttggcgaactcggccgcctcgttcaggcgcttttcggctgccgccagattgcgggtctcctcccccagctgacgttcggttttggtggtggggtgttcggcgtttttggcggtcaatgccgccaccttggccgaaagcgcttcacgcttggacgtcatgtctgctacgtattcgtcgatgtggatctcggcaaccataaaatgcgctttgctgccgaacgcttccttgaaacggtggaaatatgcttcgccacggtattcgaagctacggcgttcagcggtttgctgctcgattcgtgcgaatacccccagctcgtcgtccgacagctcacgcacgtgcacacccatcgattgggcacgcttcacgctccactgggtgcgcttgtcataggacttcagcagacttttctcatcggtaatgccggtcagatccttgaggtagcgccaacgcggaaccgccgtgtagcccacggtgaaaccgccatgagtgaagccgatcgcctcgagctgttctatcagcttattgtcgggagcgccattctggtcatccggcaaagaagctccattggtgtcgcgaagccgatacggggattcaggggtgatttccagctgtgaagcaccctttgccttggcatggcgtttcagcgcatccatgaagaaggtcaatgcttcggtgtcgtgatagtcgcacatcgggccatcatggatgaccgcaaatgtagagaatcgagagcggtgagtttcgaacagtgccgccgcgacgatcttctcgccctccttgagggccaaatattcgacgtcgatcccctgcgcggcgcgaaggcgtcccatcgccgaggtttgttggaaattgccttgtggatgcctggcggagaaatcatcgaactcctcgtctgtcaacttcaccagcacaaaatcacgcatgcttccctttgcctccgagtcaatcaggctcaccatgctagcatagcgcgcacacgacgaatggcggccgagcagatgaggtgtgcacatcgttcgcactattgccgccacgatggtccaaagaacaaatggcccaaagatgatgaatgtccggcttgcagtgaatcaaacgcagtgctatattctctacttggctcttgaagccacgccaccttagctcagtggtagagcatccccctcgttcgtgggaaggtcggtagttcgattctatcgggtggctcttgttcatcaagaaggccgacgcactaagcgccggccttctttcgtatcgcccttgctaggtcataggcgcttgctagacactcgcccgattcgggggctgagtgctgagccgcgactcaactgtggcttagtcgcggctcagtgcagctagacagcctagacgacttagtgcagcagggcctcgatggcggggaccaaggctttcagcgccttgcctcggtgggaaatcgcattcttctcggccggagtcatctcggcgctggtcagcggctcgccttcatggtcaggctcagtgctgacgcgaccggcaggctgatcgtccgggacgaacagcggatcgtaaccgaaaccgtgttcgccacgagcctcgcggatgatgcgacccggcatgtcgccgagctccactgtctccgacttgatggcgtatcgagcatgcaccggggcagggctcccagcggcagccgtggtgtgaacggtgatgccgtcggcagccactccaccggtcacgtcggcaccggtctcggtgtccgggaccaccagcgcggcggcgcaacggaagcgcgcggtacgcttgtcatccggaatatcttcgatttgggcgagcagcagcgcattattggccttgtcgtggccgtgagcacccgcccagcgagcagacagaatgcccggagcgttacccatcacatcgacgatgagacctgaatcatccgcgacagcgggcagaccggtacggatggccacagcgcgggccttgagtagcgcgttctcctggaaggtgacgccggtttccaccggatccggcaggtgaaggctgccagcggacaccagttcgatgttttcggcatccgcgccaagatcctcttcgagaatgcggcggatttccacaagcttgccttcgttatgggttgcgacgacgatttgcatgggttctcctttaagaaggctccccttgtcaggggagctggacattgcagaccgtacggcttccagccgacaacctcccctaaaggaaggggagctggcttagtctagggacaaagcggcacgctgggcggcttgcagttccttgttgcccttttcggccaagtcaagcagggtgccgagttcggcacggttgaacggacggtgttccgcggtgccctgaatctcgatgaaggtgccggaaccggtcatggccacgttcatgtcggtcatggcctgactgtcttcaatgtatggcaggtcaagcataggagtgccgttgatcacacccaccgatacggcggacacatagtccttaagcacgcggctggcggacttgatatggcggtgcttctccgcccaattgactgcgtcgaccaaagccacgtacgcaccggttacggaagccgtgcgagtgccgccatcggcctgaagcacatcgcagtcaagttgaatctgattttcgccgagtgccttcatatcgatgacgccacgcaggcagcggccaatcagtcggctgatttcgtgggtacggccaccgattttgccacgtacggattcacggtcggtgcgttcggcggtggcacgcggcagcatcgagtattcggcggtgacccagccgaggccggagtccttgcgccaacgcggcacaccgggggtaaaagtggcggtgcacatcacgcgcgtgttaccgcattcgatgagcacggagccttcgggggcgtcggtgaagtggcgggtgatgcgcacggggcgcagctcgtcgaccttgcggccgtcggcacgaattatttggtgattgccaagcatgtctttgatttcaaccatgcgccccagcatacgccatccgctctatgcctggatagcaactcgtcaaccatcatcaaaccccagcgcaatgtcattccctgcttacatatccattccatgacacttggctgcacgccactattttcttatgcaccactcgcttacagagtcaatgcctgcgtacctgatgaggattgggaaagatcgtccgctggaataagaatgccatattccatgaaatcttggttgaattgcttgcgctgcatagcgttgagttcgtaatcgattaacggcaaatatgtatagtccatgtcatgcaacggctcttcatatcgatgaagcacgtgcataattgccgcgctcggcagtggggaccaccatccatccaagccataccggtacggaggaaccaatgtcaagcgtctgttccttgggttgatatcccaacgcagaaaacggtataaaccagcgagaaacgcaatccagcacgcatcgttcacccgtgcaaccgctcggacgaacgatatacgttgatgttgaacattccgagcatgaatcagattgacgcagagcatcttcaacgtagaccaggtcgctccgctttctattgcatcgaaatcaggaggcctacgcagttgcgccaacaacatgtgcaattcgtcttccggaatcgtttgcgagggggccacggcttctaggtgaagaccaaaaccagcccgctcaagcccctcggccaaaacatcaaacaacatacctctttgcccacgcaatacgcgaccaattgcagaccgatccaaaccagtacgctgtgcaagctcataggcattccaaccagtctgcgacatcacttcattcagcacagccgcacacgaattaacagggcaaccagataccacaccgtgatgcacgacatcgcactgttctaacgctcgatgctctacagcgcgccgctctgatacgtcatcgttgcccgccgcgttctcatcattgagagtttcactcatcgaagtcaccttgcctcggccgatttcccggtcatttcatcaaaccgcaatcatcatatcccacaatcccatgacgatacgattcgtcatatcccacaattcagagacggtatgattcgtatcgcatcagttcacacgattcttcaacgattgctccgcaaacgattgctctgcacgcatcacggcattctatcggcacactattcctcccaatcagcccaacgcaacatcacacgcaacacccctcacgcaacacccctcacgcaacactgcgccatctctgtaacatcaccgacaacacggcaatcccacaacgtctcggtgcaatatcctctgaaatggtttggtttttcactccacctcgtcggcatcctgaccaggataggaatatgtgtcgttccgcaccatgtacaaaacgttgtcaactgacaacgctcttcaaatcaattggataagacaaatggccatttcccgccaattcatctgaatcaagacgttgtcaactgacaacaaaatgtacattgcaacagcatgcacatatacatatttccccggtgaacagtacccccccccaaaaaaaaaacaagggggggcgggttctagtgatcgttgcaacacctgacctaccgcaaggagggtcaggtgaccagaagccaccgaaacgaagaccgtggcggggaacaccgttggacgttcaacggcgtcgaatatccgacgaggaagctgatgtgcgaggcgagacgcgccgagtacgtgcgcctgctggacgaggaaggcatgaacttcacccaggccgcgcacgcggtcggcgtctcgaaacgcaccggcaaggcgtggcgcaacggcaggacgcgcgccacgggaaggaacgagaaacccctggtggactggtatcgttccaccatggacaaacccaagaccctccatccgcgctacctgagccaggaggagcgcatccagatcgcggaccgtctgcgtctgggcgattcgatccgcgccatcgcccgtctgctgggccgcgaccccggcacggtcagccgcgaggtcgagcgcaacaggaatcccgagtccggcggttacgagccttaccgcgcccagcagaaggccgcggaccggctcaaacgccccaaaccgcgcaaggcggccgagggcacgcgactgtgggacgagatcgccgccgggttgcgcaggcattggagcccggagcagatagcccgcgatgtctatttagaagtgcaacacccttgttggtcctgtaattctaacagttcgtcggcgaacgcctcggcgggcgtgcggtagccgagcacgcgcatggggcggttgttgatctcgtcgacgatc

SEQ ID NO: 29 - DNA, 59553 bp, Bifidobacterium longum
gctcttgagttctcaaaccaccaccacaccagccagacgggaaaccaaccagaggaaggaacccgccgcgctgagcggcaacaggtgaataacttacacgcatgtccggattcacgcaaatcaaggcacgcaaaaacccaaggaatcgttgcaatcacacggttccctcggcgtgtcgcaaacagcctatttgcgctgttctgatatcagaataatccgttttgcattgccgatgcgtaacaaattcatgtgttcaccggcgtgttgcaagaattcgattgcgtgaccatccaggttcaccttctcgcaaccggtcatcgcatatgcaaaaagggacttccctttacgggaagtccctttcagtagctattgaagctcgctagcctcaggccagggtgttcgggtcaaccggaacgcccgggttcatcgtggaggtgatggttgccttggtcaggtaacggcccttcacggtggacggcttcagacgcttgacttcgtcggccacagccttgaagttctcgtccagagcggactcatcgaagctcatcttgccgatgaggaagctcaggttgccgttcttgtcgacacggaactcgatcttgccgcccttgatgtccttgacagccttggtgacatccatggtcacggtgccggtcttggggttcggcatcaggccacgcggaccgagcacacggcccagacggccgaccttgcccatcatgtccggagtagcaaccacggcgtcgaagtcgaggaagccgccctgaacctttgcgatcaggtcgtcatcaccgacgatgtcggcgccagcctcggtagcctcggtggccttcgggccacgggcgaacacgaggaccttggcggtcttaccagtgccgtgaggcaggttgacggtgccacgcacgagctggtcggccttacgcgggtcaacgctcagacggaacacagcctcgacggtctggtcgaagttgtaggagggcatgctcttgagcagagcgatggcctcgttggcggtgtagaggttgttgcgatcgacgcgctcagcggcttcgcggtacttcttggaacgctttaccatctgtccttctccttatcagtccgtaaccgtgatgcccatcgagcgagcggtgccctcgatgatcttcatgccggcctcgatatcgcgagcagacagatcttccatcttgatctcggcgatttcgcgaacctgcgccttggtgacagagccgaccttgtgggtcagcgggttctcggtgcccttctcaacgccagcggccttcttcagcagagctgcagccggcggggtcttgagcacgaaggtgaaggaacgatcttcgtaaacggtgatctcgacagggatgacctgacccatcttgtcctgcgtctgggcattgtatgccttgcagaagtccatgatgttcacgccatgcgaacccagagccgggcccagcggcggggccgggttggccttgccagcctggatctggagcttgatcagcgccgagactttcttcttgggagccatattatggttcttctttctataacgcggttcgaatggtcgccgtcctcaggttcggctgtctgccatcatgctcggtcttgactcgttatttatccgtgcatgctgcaggcaatcggcctgtggtcggtctcctcccgcaacttatattgctgtgctgtgctagcgagtctcctctccagacacaagctttcctattatgcaaatccacccggacaacacaaaaagcccgaccacgatggtcgggctctgcaaagtttgggagttaatctagcttctgaacctggtggaagccaagctccaccggcgtatcacggccgaagatggacacgagcacggtgagcttctgagtggtgggctccacgtcggaaacaacggcggccatggtggcgaaaggcccatcggtgacggtgacctgatcgccaacggcgtaggagacttcgaccttgcgcttcttggcggcggcgggcttgtcgccggcggccttgagtgcctcggaagcaatcatcggagccatcatcgccacgacttccttgcgggagagcggcgccggatccttggtcgggccaacgaagccggtcacgccttcggtctcacgaacgatacggcgggcgttctcatccggccacatacgaatcagcacgtagccaggaacacgcacgcgggtgatgaccttcttgcccttctcggtgtgcttctcgacttcttccatcggcacctcgacctggaagatctggtcttccatgccgaaggaggcgacgcgggactcgatgttggtcttcacgcgcttctcgtagccggagtaggtgtgcagcacgtaccacttgccatcaagggaacgcagggacttggagaattcgtcaacggcctgctgaccggcatcggtctcctcggcctgctcggattcgttgacttcttcctcgtcctcatccagagaaacggtctcggtctgagtggaagcaacgggagcggattcagtcgccgccggagcgtcggactcaacatctgcattgtcgacggatgcgtcagattctgcggaaaggtcagcgaccggttcgaccggggcagctgcctcatcggcagcagcttcggaagcctcgacaacaggctcctcagccgggacggcgtcgaggttctcgagattcagttcatcactcatgcgttgttattcaccttaggttgtgcggatcagccgaacacccacagcgtggccttgcctagaccgaagtccatgccagtcacgagggccatcagcagcagcacgaagatgaatacggccagagaccagaagaacagttccttggcggtaggggtcacgaccttgcgaagctcgtcgatgatctgcttgatgaacagaccgatacgcatgaagacattcggcttgactgccttttcactcttgctcgtcttagccattccgtacctcgcgtcagctgcttgattattagaaacttggcagggaaggcgggactcgaacccacaacctacggttttggagaccgttgcgctaccaattgcgccacttccctaggtgaaaatccacctcggcgtgcgttccgtagagaacgcttcgccacggcgaaaccgccaagtcgttatagtaacggctccggtggattatcgcaaatcgcgtgtcgcgcgcgtagcacgcgactcttctcagttagcccattccttgaatcgacgcatgccttcggctaggtcttcgtcggccagtgcgtaggagaaacgcaggtaaccgggagcaccaaaggcctcgccggggacggcggccacgtgggcctcatccaacagtgcagcggcaaagtcagcggacgtatcggacactgtgcccttgggacccagcggcttgccaagcaaagcggtgatgtccgcaaaagcgtagaacgcgccggtcggagtcgggcagttgacgccctcgatatcgttcaaggcggtcacaatcgcacggcggcgcgcgtcgaaggccttacgcatctcgtgcacctcatccagcgggccggccacagcagccaaagcagcacgctgggagatgttggccacattggaggtcatatgaccctgcagcttggcggcggccttggccacctcaagcggagcgaccatccagccgacacgccagcccggcatcgcataggtcttggccacgccgttcagcaccagcaactgcccgcggcattccggcacggcggcaccgatgtaggtggtgtgcgcatcgtcatagttcaggtgctcgtagatctcgtcggagataacccaaatgtggtgctcgacggcccaacgaccgatcgcttccacggtttccggcttccagacggctccggtcgggttgttcggggagttgacgatgattgccttcgtatgctcggtacgggccgcttccagcgcctcaagcgagggctcgaagttcacgtcggcaccggcgaatacttcgaccggcacaccaccggcaagcttcacagcctcggggtagctggtccagtacggagcgggaatgatgacctcatcgccatcgttgagcaagatctggaaggattcatacacggcctgcttgccgccgttggtcaccacgacctgatcggcattgacctcatagccggaatcgcgcagcatcttagccgcaatcgcttcgcgcagctcgggcaggcccggcgtaggcgtgtacttgtaattcttcgggtcaaggcaggcatctgccgcagccttgaccacgtttgcgggggtcgggaaattcggttcacctgcgccgaagccgataacgtcaagtccggcggccttcatggccttggccttggaatcgacggcgagcgtagcgctcggtgccacagtgttgatacggtcggaaagagtctgccattgcgccatagtcatggctcccatgctaaacctacagcacgaaaaatcgccagagccgcactatggtgatggaatctgtcgtgtgacagattccatcagtcacacgagcacgagattgtcgcgatgaaccagtgggtgggcgtactgggggccgaggaaacgcttgagttgggcggtgttacgcccgagcatctgcggaatttcttcggaatcgaagccggcgaggcctcgggccaggtgttcaccgctttcggcatcgatccagaccggatcgccggcggaaaaatcgccatgtacttcgagcgcgccggccgccagcagcgaggcacgcccgccgcgaatcgcctggccggcacccgcatcgaccacaatcatgccgcgcgggtcggcggcgaagccgatccacagacggcgtgaggagccgcgggccttaaccggtgcgaacacggtgcccaccggatcgcccatcatcgcagggcccgcgttcgaggcgcaggtgagtaccgtggggatgcccgagacggccgccacgcgcgcggcctcgagtttggtgaccatgccgccggtgccgaccttggagccggagccggagacttggatgtcgcccagcgcatcaatcacgttgggcacatattccacacggcgggagccgggctgcgagggcggcgcagtgtacagcgcgtccacgtcggtcagtagcaccaaggcttcggcccgcaccaggttggccaccaacgcggagagtcgatcgttgtcgccgaagcgaatctcgttcgaggccaacgaatcgttttcgttgatgatcggcaccacgccgaggtcaagcagacggtccagcgtgcgttccacattgcggtactgggtggcacgaatcgtatcttcggcagtgatcagaatctggccgacgcgaataccgaatcgaccgaacgcagtctcgtagcgggccatcagtagcccttggccgacggctgcggtggcctgctgagtggccacgtccaccggccgcgagtcaaagcccagaggcccgaaaccggcggcgatagcaccggacgagaccagcaccacacgtccgcccatcaatcggacctgagccaaggccgcggccaacgcgtcgagcttgtccgggtcgaggtgaccgctcggctgggtcagcgagctggagccgactttcacgacaatggttccggctgcggcgatcatgcgccgcacctcggcctgactcggagtgctcatttattcctcggtttcaccatcttcgctggactcaccgtggccgaacaggctggtttcgtcatggcgatcgtcgtcaacggtcgggtcggcccagtggccggccttgcgttcggccatcatcgcgtcgcgcacggcggcacgggcgtccatcatctcgtggtattgggcacgacgttcggcgttggagcggcggtgcgtgcgcgggtccagctcttcgagacgcagatccttgcctcgggcaccgaggttggagccgtcgagcatttcggcaccagcggagatggtcggatcccaatcgaattcgaccatacgggcaccacgaccgatgcgcacttcgtcgccggggtgagcacccttgcggcgcagctcgtcctccacgcccagcttggccaagcggtcagccaggtagcccacggcctcgtcgttgtcgaagttggtctgcatgacccagcgctccggcttgacgccacgcacctcgaagaacacttcgccattgccgagttcgcggcgctcgaccgtgaactcaagcgcactgccgccctcgtcagcacgacgcggacggcggcccttggtctccaatggcttgatgaccacgcgagcctcctcttcggcctgctcgcggttggccacttcctcacgcatctcgtgcaccagcgcagacaacgcgaagttgagctcctttagaccctcgtgcgaggcagtggagatctcaaagaccttcagcccgagtttctcgaactccggacgcacgaactcagccaattccttggcctcgggcacatcgatcttgttcagaatcacgatgcgcgggcgttcgggaatcgggatggcacccaacggcagctcgagcttgtcggcgtagagcgccaactcgttttccagcgcgtggtagtcggacatcgggtcgcggtccggttcaagcgtggcgcaatcgatcacatgggcgatgatttcggtacgttcgatgtggcgcaggaactccagtcccaggcccttgccttcggaggcgcccggaatcaggcccggcacgtcggcgatggtgtatcgagagtcgccggcgataacgacgccgagattcggcaccagcgtggtgaacgggtagtcggcgatcttcggcttggcggaactcatcgccgcaatcagggacgactttccggccgaggggaaaccgaccaacgccacgtcggcgatggacttcaattccaaaatcacgtcgcgctcttcaccgagttcgccgagcagggcgaagccgggggcgcggcgggtcttgttagccagggcgatgttgccgaggccgccggcaccgccttgggcgacgacgcagcggtcgccctcgtggcgcaggtcggcgagctgtgcgccgggatgcttggctttgccctgttcgccgcgcgcctcaaagacgacggtgccgcagggcacgggcagaatcaggtcctcgcccttggagccgtccttattgtcgcccaaacccatggtgccgctgccggcgacacgatgcggcatgaaacgatagtcgagcaggctggtggcgttacggtcggccacgaacaccacggaaccaccgtcgccgccattgccgccgttcgggccggccaacggcttgtatttctcacgacggatgccggccgaaccgttgcccccatcgccgcccttgacatggacggttactcgatccacaaaatcactcatattgattaccttacaaaaaagccgcgtccttacgggcgcggcttgaaaaaagcttgacgctatatcgctcaggcgatgacgtcgacaaccttgcggtcgcgacgcacaccgaacttcacggaaccatcggtgagggcgaacagcgtgtgatccttgcccatgccgacgttgtggcccgggtggaagttggtgccacgctggcgaacgatgatgttgccggccacgacggcttcgccgccgaacttcttcacgccgaggtattgcgggttagaatcgcgaccgttgcgagagctggacgcacccttcttatgtgccatgattcatggtcctttctataactcaggcaatcgccgtgatcttgacgatagtcagcttctggcgatgacccttacggcgagcaacaccagtcttgttcttgtacttctggatgctaatcttcgggcccttggcttcgtcgttcacaacctcagccttgacggacaccttggccagatcggcggcggcaagggtgaccttgtcaccatcgacaacgagggagaccgggaattccacggtatcgcccttcttagcgtcgagacggttcacgaggatgacgtcgccaacctcgaccttttcctgatggccaccggccttcacaatcgcgtacattatcgttccttttatgttttggaaagctaccttgcctaacacgcaccgagcttgcggtcagacaccgaatttcgaatctacaccaccatgcggactaaatcaaatgatttttgcccgcgtgtcaagcacgacacacctgttactcttccgcttactcttccgccgtgttgttggcagcgacggcagcggcggcaatctgagccagtttggctttgacgtcggcgctggaaccagccggttcgggagcgggagcggtgccgcgaccgtgcttgttggttttgacgaacgggtcgccaccgcgaagcgcgtagggatcgtcgtagtcggccgaaacggtcggctgatcatgcaggatgaaaccacggcccttgcaggtcgggcattcctcggagaacgcctcgaccagaccctggccgatgcgcttgcgggtcatctgcaccaaaccaagcgaggtgacttcggccacctgatgcttggtgcggtcgcgtgccaagcattcgaccaagcggcgcagcaccagatcgcggttggcgggcatgaccatatccacatagtcgatcatcaccatgccaccgatatcgcgcaggcgcagctggcgggcgatctcttcagacgcctccaggttgcaacgcgtcaccgtctcttccaaggacttgcccttgccgataaagcggccggtgttcacgtcaatggtggtcatggcttcggtgcgatcgatgacaatcgagccgccggacggcaggtagacctgacgctccatgcccttacgcagctgggagtcgatggaccacttgtcgaacacgtccttgccttcatgctcggccgggtcccacttctccagcttgtccttcaagtcgggggccatggtgtcaaggtattcctcgatacggtcgtagaccttgtcaccttccacgatgagcttgctgaagtcgtcgttgaagatgtcgcgcaccacgcggatggccacgtcgggctcgccctgcaggagcttcgggcgcttgccgtgccagaattcctcgcgcttggcgttgatgcgctcccactggcggaccagtgattcgagatccttgacgatggcgtcttcggatgcgccctcggctgcggtacggataatcacgcccatgtctttcggggcgatcttggagacgatgttcttcagacggctgcgttcgcgctccgaaagcttgcggctcacgccggtcatgccgccggatggcacgagcaccaggaagcggccggcgagcgtgacctgagaggtcaggcgggcacccttgtggccgatcgggtccttagtgacctgcacgagcaccgggtcgccggacttgaacgccagctcgatgcggcgcggctggccttcgagacgagcggcatcccagttgacctcgccggcgtagagcacgccgttgcgggcctggccgatgtccacgaatgcggcctccatgctgggcagcacgttctgcacgcggccaaggtagatgttgccgacggtctgtacttcctggatgtcggagacgtaatgctcgaccagaacattgtcttccaccacggaaatctgggtgtgatgttccttctcacgcaccaccatcaggcggtccacgttctcgcggcgtgcgaggaagtcctgttccatgagctggctctggcggctgcgctcacggcggttgtcacggcggcgctgcttcttggcctcgagacgagtggagccctccacatcagtgatctcgtcgatgtactgctgcttgcgggagcggcggaccagcggctgttcgctgttctgactctggtcgtcggtgccctcgccgttcttgccgccacgacggcgacggcgacggcgagtaacggtctgctcctcatcgtcctcatcgcgatcacggtcatgatcatcgcgatcgtcacgacggcgggaacgcgtatcttcggcatcgttctcggcggtatcgtgctcgccgttggcaccggtttcgccgcgtgagccgcgacggcggcgacggcgcgaacgggtgcgggtggcgtcggattcttcgtcgccctcctcttcggcaatcggcgagtaggcgatatcgtccagctcgaggtcttcctcaatctgctcgacttcggcggctgcacggcgctcctgggcgttcaggcggcgggagcgacgggaacggcgagagtcggaagcgtcatcggaatcgaaatcatcatggtccgtgttggcgctggcattggcgtcaccggcggcagcgttgcgggaagcgtcacgagacgcatcacggtcggcggcattgcggccacgatcgtcacggtcgtcacggcggcggctgcgcggctgcgcgtcgtcatcatcgtggctgcgcgagcggcgggagcgacgcgacggacgttcgtcgtcgtcaacatcgtcatcacgagtgtcagcggtatcgtgcgcatccacagcggcgggcagtaccggttcctggaagagcagggacgtcatcggcttgccgcgacgcacggcctcgtggccagagggcagggattcgaccgcgtcgaacaggcgctcatccggggtgtcctcgtgcgtatccgcaactgcacggcgagaacgacggcgaaccggacggtcctcgtcatcatcatccatatccatagacgcacggcgagagcgggagcgaaccggccgatcctcgtagtcatcatcgtcggactggcgggagcgagagcggcggcgaaccgggcggtcctcgtcgtaatcgtcatcgtccacaaccgaacggcggcgggaacgtggggcgtcatcgtcatcgaaatcatcggcactgacagtgcggcgcgaacgacgaggacgatcatcctcgctatccgagtcggccactgcggaagcggcgcggcgcgaacggcggcgggttggacgttcggcggaatcctgggaatcgctggattcatcggaatcgctggaatcggctgacttggaatcggccgcagtgccggcatcgggaagcgcgggggcttcgaacagcggggcgcgttcctgcacttgcagttccagagaagcgccggcagcaccggtgccgcggaccacgcggcggccgccacgacgacggcgaacaggttcggcgggctgggaggcggcggcaggcgcagcgttcacggctgcagccgaatcggcattggatacggttgaattatcggttccgtcgttgacgaaaccttcacggttgtcagtgggcacaatgctcctcgcggcgcgctgcatcacgacgcctatttccaggcctatacgcttgtctcacaccacgctctcaccgtggccgcacgaaaacgcgccgcgtaaaggcaacttcgtctcaagtctgtcctgcgggtggcggacaccggcgcttgcgttgtctcattctcaagagccgcaaggggatcgacgccatctcgcacgctgatggttatgcagaaccaccatcctttagtatgccacatattttgtgcgggcgtggcccggcgaggctgacgttctctcggctcccctcccccgcggtgacagcgcccctcagggaggggagctagagaggtgtcagaccagccagtcggtaaggattgcggccatggcggtcaggtcggattcaggcacctgctcgtcgtgcttgtgagccagcagcggatcgccggcaccgaggttgacggccgggataccgagctgagagaagcgtgccacgtcggtccagccgagcttggccagcgggtcgcggccagtgcgctccttaaccagtcggaccagatcctgggcgagcggggcgttcaggcccgggcgcgcggaggggctttcgtccttcatttcgatgccgtagccctcgaacacgccgccggtagccacatgctcgccattgccgagttcggcaccggcgtccgcgcccatcatcagagccttggcctcggccaacgacttgtccggggcgaagcggtagttgacgtgtacgcggcattcatccggaatgacgttcgtgcctttgccgccggagatcagcgtggcgttgaggccctcgcgatagtcgagcccgtccacgttcacggtggccggctcgtaggcgttgagtcggttcagaatgtcggccgccttgtggatggcgttctcccccatccacgcgcgggcggagtgcgcggccacgccgtgggttacgacgtcgaagcgaatcgtaccgttgcaaccgccctcgatgccgctgttggtgggctcgccgatgatggcgaaatcgccggtgatccaatcgggatgggcctcgacgactttgcgtaggccgttcttttcggcgacgacttcctcatggtcgtagaagacgtaggtgaggtcgactttcggggtggtttccggcgtgcggccgtcgagcgtggcggcgaggtagagcatcaccgcgtcggaggccttcatatcggtggcaccgcggccccacagcacgcggtcttcgggatgagcgtgggcgatttcttcgcgaatcagcgaatcgccgggctccagccactttggtgggaaattgtcgatgaccggcacagtatcgaggtgcccggccaagatcacacggctcggcttgccgaagtcggtgctggccaccactgtgtcgccgtgacggcggacggtcaggtgctcttgctcgttaaggaaggcctcgacctcgtcggtgagggggccctcgtggtcggacacggagaagttctccatgatctgggtgagcaggctgttcagctgctcggcagtggatgcggtgcggttcaattcaagcgtcatgtgaacagcgtaccgcgtgggcggcgggcccagcacactcactacatgagattttgcggccgaatacatttttatgtgccacactggggtggcgaaagggaggattatgtcaggtctaatcagcgccatgcaaggcttctgcgttatcggcatcgtaatcgcggtgggatatgttgccgcacgaatgcgaatcggcgggccgtccgctcagatggtgctcaaccggttctccttcttcgtatcgagcccgtgcctgatgttcgcgattctctccaaggagccgattttcgacatcttccacccctcgattatcgtggcgttcttctccgccgtgctggtgggcgtggtgtttttggtgctcaaccgtatgttcttccacctgaatgccccggacgccaccatcggtgccctgaattcgctgtacctcaattccaataacatcggcctgccaatcgccacctacattctgggcaatccggctcttgtggcaccgattctggtcatgcagcaggccatcttcacaccggtgggcctgacagtgctggacgtgaccaccaagggcaaggtctccatcaaggaaatcgccaagcagccgctgcatcagccgctgcttatcggctcgctgctgggcattgtggtctctgcgatttccgctaaaagcggctggttcccagtgccgaaattcattttcgacccgatcgacatgatcggcgattcagcggtgccaatgatcctgatggcgttcggcatgtccctgcacggcaccaagccgctgcagcagaagggcgatcgaccggccatcttcacggtcgcggtcctcaagaacatcatcatgccgatcatcgcgttcctgctcgcctacttcgtgatgggcttccgcggctccgagctgtatgcctgcgtggtgctcgccgctctgcccaccggccagaacgtctacaactacgcggcccgctacaacgtgggcctcaccttcgcgcgcgacggcattctgatgagcaccatgaccagcccggtgtttatcgcgatcatcgcggcgctgctgtcgtgatgggtgcgcagagaagcgttctcaatagtatccgtgcgcgcaaatgcacagatatcgcacaaacgaacatttgctcatccacatatttacggtgatttcagcgttgctacgttcgatttgcgtatacgaaagtacgcacagttgttattgagaacgattcgctgcgcagctcggctcagtcatcagcccgataatcagtcagattcaagctggcggccacccgattggacgcgaacgcgccgatggaaaccagcgcatagcacagcacaagcccgccgaagaagctggccagcgtggccggttcggtcatcgaagcggcgaacagaggggccataagcagcatggaacagccgccggccacgatcaccacgatgttgagcggggtgagtacctcgatgaatcgcgcacggttcaaggtcttgacatcagtgccctccaacaccagcatgcgatattcgccggcctgatcgtacacgctgccggcctgcatcacaccggagctgaccgcggcaagcacagcggcgaacactagcgtcaggatgccgccggtgccgatgtcgcgaatgaacacggtggacgggtcgttggcgtcaccgaccacggcggccgagccaaagaatccgcagatcgaggtgatgccggcgatgaacacggccagtgcaatgccggacacattgcgccaggcgcgcttcggattgtcgagaatacggcgcatggcaatcatcgtggccgcatccttggggcgcttggccttggccttggcgcgagcggtgaccacccacgtgccgataagattcaccagtgcgaagcacagcagcatgaaaccgatgatcacggcgtccatcaccgcctggccggcctgaggcagcatggccgggttcttgaagacgatcacagccgccaccatgaccaccacgaacagcaccatacgggtgcccgagggcagtgcggtggcggtgcgcgaggtgacgcccaatggggtgatcgccacacgacgcaacgtgaccagcgacgaaatcagcgccaagatggccacgccggccaaggtgatcaccagagccaacggtcccacccacagctgttcgaaggtgaaccgctgctcctggaagggaatcagcatgactgccggcatcagggcgcaatagccggcaatgccgataagcgcgccgatcagcgcctgtccggcggcgtcaagcgcggtgagacgcaccacctgaccggtggtcgcgccggccaggcgcagggcggcgagacgggcgtcgcggcgggatgcggccagtcgtgcggcggaaccggcgagcgccacgaacggcacgacgagcagcatgcaggcgaataccgccaacgccacataggcggtggagaattgggccaggctcgtcgggtcgctgatctgccgtttccacgcggccaccgtatcgggccggcaggcaccgaagtcgaacgcgcaggcgacggtatgatcggccgaagcccgccagatgaaaccgtgtacgccgccgagcacggtgaggaagatggtggtggctgcggcgaaggcgatgattgccagcatcgaggtgtggccggcgctgccgcgcaagccggggcggtgaaacagccgccagagggcgaacgtgctcatcgcgcgcctcctgcggtggtttcgctcccgccggctggagctgccgagcgtagcgaggctgagggtggttcagcgccctcgggccacccccagtcagcctgcggctgacagcccccgccagcgggggcggagttggggttggcgtctgtctggtgcagacggccgtcctgcatcattacggtacggccgcagaacgaagcgacgttggggtcgtgggtgacgacgaccacggcggaaccgttgtcccgcgcggcggccatgagaatgcccatgacctcgcggccggtggcttggtcgagcgcgccggtcggctcgtcggcgaagaccacggcaggtttgacggcgagggcgcgggcgatggcgatgcgctgcatctgtccgccgctcatctcccccggccggtgcgtggcgagcgcgcgcaatcccatgcgttccagccacaggatcgccgtgtccgtggcggtgcggtagggcatgccgtcaagcatcatcggcagggcgatgttttcgaccgccggcagttcgggcagcagctggccggactggaagacgaagccgaaggcgttgcggcgcagtttggtgcgctcggcgtcgctcatgcggctcaggtcggcaccacggaagatgacggtgccggcggtcggcttaatgatgccggcgagcgcgtgcagcaaagtggatttgccggagccggacgggcccatcacggctaccgtctcgccctcccggagcgtgaagttcacgtggttcagagcgagcgtgtgcatggtcagcatggcgaagccgggctgggctggctgggatggctggccggcctgaatggcacccggtccggccgcagcggaattcgccgacgcataaccggctcccgtgccggctggcatcacaccggtgacgccgtgcccggcctgtgcgcgggccatgctggcggtgtagtccatgaccaggtcgtgggcctcgatgaccggagcccactgctgggtgtgcgatgccggttgctggaactgttggggttgctgagactgctgaggctgagccgccggtcccggcgccggctgaggctgctgcaattgcgatgctgctgtattcatactcccgagcgtacggagcgaacgcccagccgaccatcgggctgcggtatgaacctttctggattaccggcccgctcctcatccgcaaggattagagatacgcaaatgattaatgaccggcaaccactattcggtgccggtcattatgagcattgcattcaggcgctacgcgcattattgcgcggtagccaactcgtccaggcgggcggcgaagcggggccagtcggtcttcatagcggtgaggagcttgcggttgggcacgtcgtcaatcgggacccagcagatttccatgctttcgtcgtcgtttgccttgggctcgacggtgtggccgggcttttcaaaggcaaacacggtggtgtaggcccacgggccatggtcctcgcggtaggagccgaccacctcgatgtcttcgggggtgatgttggcttcctcgtagctttcgcgcagcgcgccttcgatggacgattcgccgtccgcagtggcaccgccggggataccccacgtgccaccttcggcgctccacgcggcacggtgctgcatgaccacgtgggtcaccttgccactcaccgggtcgcgacgagccagcagaatgccggacgcaccgttggtgccccaatgcttgcggccgcaggcgcagtccacccagccatcgccgggctgatgcacgttttcgaccggcggcagaatgccagcgtgctggttgcccgaggccttgctttccggctccagttcgccacggccgacattccacaggtcggtccacgtgatgcccagttcgccggccagatgccgggccagcggcaggctgaggccgatgataccgtgcggatcgccctcgatgctgtcgatgaacgcgccgccgaagccttccagcgtgaacgatccggcgacttccagcggctcgccggtgacgatgtaccgttcgatgtcgtcatcggtgaattcgccgaaatggactttggcatggcttgcgccgcgcacggtacgtccggtcgcgaaatcgatcaggcagtggccggtccagagttcaccggtcgcgccgctcatgcgcttcagtcgttcgcgggccacggcttcgctgtgcggcttgccgtaacattcgccgtccaggaggaacatcgaatcacagccgagaatcagcgggccgaccgtcgcctcggtcagtcccggctgtccggcaatagcggtggcgatgggttcggtgatggtcggcatgtcgatgccggagaagtcgcgcgtggtggcgacttccgccttggaatagtcgatgggctggccagcggcggctttgcgcaggtcttcgacgacggcttcgcgttccgaatccttgatttccttggccttgagcgggtaggcaatcacgcgatcgccggttgcggcggcggcagtattggccacatcgcgatacgcacggtgaacggcctcggccttggctgcggcaagaatcatcacacgctgcttgatgatcaaatcgtcgacggtgacaccttcctcacgggcggccgcttccagcgcagcaggctcatccacgtgcgagacgcgaattgtggggcagatacccgccgaatacagcacgtcacggcgaggcttggacttggaagcaagaattagcggaatggacatgacttaagtccttatgctcccgctggcgggagctgtcgaacgaagtgagactgagggtggtctctgccggtatggcggaccaccctcagaccgcctgcggcggccagctcccgccagcgggagccttctcctcgacttagcgacgctcgatttcgacgccggcggtgttgatgggcaggtgaagcacacgccaatggccggaagcaagctgctccgatgcgatctggtcgatggcttcgcgggcgttgccgtaatgcagcacgagcacgcaggggccggcaccggagactgcggcggcatagcccttggagcggaagagcgcaatgagctcggtggacggcggcatcagggcaccgcgatacggctggtgcagtttgtcctgcgtggcggtgaacagcagcgcgttggactgggcctgagcggccgcaagctcgtcggcgaacgccgattcacgggttccgccagagcaagcgcacgtatcggcatcctgagccggggcagcggcgacgccggacttgccctgctgggcggcctgagccagcaccacgggattcatcgcagcgggcagcagacccacgcgagacacgttgtagacggcgtccttgtatggcagttccctaggcagcgcctgacgggccttctcagtggacagctcatagtcgggcacgaacacggcggcggtgatggacgggtccaccgggtagttgacggcgtggaatccgccgtgcagcggttcaccaccaggaacggcgaccgagccgacgccttctgcggtttcgaagtcccaagagacggtcaggccaccgaacacagccggggccacattgtccgggtgtccttcaatctgggcggccatatcgaagacggccggacggttgaggtcaccggtctgggcgaaggccgcggcggcggcgatgccggccacaatggcctcggcggaagagcccatgccacgagcctgagggatgttgttggtcgcttccagcgtgaagccgagtcggccgaggccgaacgtggcacaggcacggcggaaggtggagaccacgaggtgggtttcgtcgcatgggagggcgtcggcaccctcgccgtggatgatcacgtgggcaatgccgtcgttcgggtcgtcgttgagcgtgaaagtgagctcgtcatggtagtcgagcgccagacccacggtatcgaagccggagccgaggttggcggacgtggcgggcacgcgcacgtgaacgctattgcagattggattcatggttgttccttaaaaaggagctccctcatcagagggagcttgggtattcagctttcaccgttcgaccgcctcatcagagggagcttaggtcttgtcagtccagcacgcgcaggatggacgggtcgccggtgacgaagtcgagcgcctgcacggccttgacggtgttgcgcagggtttcctcgtcggtcaggtgggtcacgacgcgcaactgctgaatctcgccgtcgtagccgggatcggtcatggtgggcttcaggtcctggttcacaccgttgatggagacaccgttcttggcgaactcagcggcgatggcggccagcacgcccggcttgtcgtgaatcaggaagcgcacggcgaatgcagccttggaggcggtaatcggagccttcggcagattcttgtacagcgggatggacgggccggtgcagccagcagcaatgtggcgggcttcggtcaccacgtcgcccacgacggcggaggcggtcggagcgccgccggcgccacggccgtagaacatgaggtcgtcggcggcctcggccttgacgaacacggcgttgaaggagccatgcacggaggccagcgggtggttctcatcgatcagggccgggtagacgcgggcggaaacgccggcctcgccgttctcgaccacggcgagcagcttgatgaccttgtgctcggcggtagctgcagcgatgtcgtcggcggtgatcttggtgatgccttcaacggacacatcgtcgatggtcacggaggtgtggaagccgagggtggccatgatggcggccttgttggcagcatcgtagccttcgatgtcgccggtcgggtcggcttcggcgtagcccttggcctgggcgtccttgagcacgtcgtcgaattggagacccttggtggtcatctcgtcgaggatgtagttggtggtgccgttgacgatgccgagcatgctggtcaccttgtcgccgaccagggactcgcgcagcgggcgcaggaacggaatcgcaccacccacagcggcctcgaagtagatgtcgacgcccttggcctcggcggcggagtagatctccgggccgtacttggccagcagcgccttgttggcggtgaccacggaagcaccggattcgatggcggcaagcacgaacttgcgggccacggtggtgccgccgatgagctcgatgacgatgtccgagttggtggccacgctcaaagtatcggtggtgacgatggactggtcgatccacgggaacttctcagtttccttcgggtcgaggcaggcgacgccggtcagttcgaccgggcggccgatacgagcggacagttcgtccttctgctcgacaatcaggcgggcggtctgggagccgacggtgccggcaccaagcaggcctacgcgaatcggggtttcgttgttgcgagccaattcagggtccttccaaaaagttttctatatcccaccgctattttacggattatttccgacagcagaccgaaagtactcatcaaagctgacggcccttttcgtattatgacggatttggccgcacattacagactgtcaggcgctcacctctgcacgtggatcactcgctgacgtcgaggttgagtaggtcgtctacggtctggcggcggagcatgacgtgcgcgccggactcgctgacagcaaccaccgccggaatcagcgcttggttgtagttgctggccatggtgcggccgtatgcgccggtaaccggcacggcgagaatgtcaccgcgcttcaaatcggcgggcaactgcacttcgtgaaccacgatgtcgccggattcgcagtgcataccgcacacacgggcaagcatcgtttcagcggaaccggtgcggttcgccagacgcgcggtgtagtcggcaccgtagagtgccgggcgaatgttgtcggacatgccgccatccacagacacatacacgcgctcggcaatcgggttgccgtcactgtctttggcatcggacaagtgcacgtgcttgatggtgcccacgcggtacagggttacgccggcgggtgccacgatgtagcggccgggctcgaagctgatggccggggcgggcatgccgagcgcacggttggtgctgttgaccgcatccgccaagcgagcgagttccacgtcaatgtccattgaatcttcgccatcggtgtaggccacggagtagccgccgccgaggtcgatttcgggcaggatgtaggcgtcggtggcccacagggtcttgcgcagcagcatcatgcgcttggccgcgtgaatgaaggcgtccgcatcgtggatgttggagccgatgtgcgagtgggctccgaccagttcgagtacgtcctggttggcgaggatggtcttgagcacggcgatggacggaccgtccgcaatggcttccatcgcggcggccagcgccttgtctgtgtcggagacttcctcgtggctcaggtcgtacgggtacttgacgtcgtagtgcagctcgcgctctgatttctcggtcttttccgcgccattttccggggaatgcgtcgcagagatacgcgcgttggcagcggcaggcgtcacgtctttgaggtcgttcagcacgtcgagcacagcggcgtcggccccggcggccagcagcggcacgccgaacttctggtcctcgtgagcagtggagatgtactcgtggccgccggcgtggacaccgacggtgacgcgcagcatcacacgggcgcgtttgccgagcttgcgggcgatggcagcaacgcgttccggctcgtcgggctcgtcgaccacgattttggcgaagccctgttcgatggccagcgcgatttcctcatcggacttgttgttgccgtgcagcaccagacgacgtccgggaacgccagcggcgagggcgatcttcatctcgcccatcgtgcaagtgtccacaaacatgccggcctcggtgaccaatcgcacgacttctttggacaagaacgccttaccggcaaagctcacgtgcgtagtggaggtgttgaatgcttcggcggcagcgcgcacgaagtgcctagcacgtgcgactacttcatcagtgtcgatgagatagagcggcgagccgaactcgtcaagcagcgattcggcggtacgaccatgaaattcgatggagccttcggcattcacagtcgtagcggccggccaaattggagaaataggcataatcacatcttttcgggggcggtgacgccgaggaggtcgaggccgttggcgatgacctgctggacggcgtcattgagcttcaggcgggcggcggcacgggccggctccgggttcttggcaatctccaaggccttgcgagcctcgtcgtcgccacgggtttccggatcggtcagggccatcggcaccacgcgctctacgttgtaccacttgtgataggtggcggccagttcttcgaggtaacgggccaccttgtgcggctggcggtcgtcggccgcagtggcgagcacgctcgggaattgggcgagggcggcgagcacttcgccgtcggcctcggtgtcgagcagggccaggtcggcaccctcgtagctgatgccggcggcggctgcgttgcggtccacgttcttggagcgggcgtgcgcgtactgcacgtagtacaccgggttgtcgttggtgtgcgaggcgagcagggccaagtcgatgtcgaagttctggttgtaatcggagcgggccagcgagtagcgggcggcgtccacgccgaccacggagaccaggtcgtcgatggtcacgacgttgccggcgcgcttggacatgcgcacgggcttgccgtccttcatcacgttgaccagctggccgatgagaatctgcatgttcttgccgggctcatcgccgaaggccgcgcacatggccatcatgcggccgatgtagccgtggtggtccgcgccaagcatgtagatggccacgtcggccgggttttcggcgcgatggcgcttgtcccagtagtaggcgatgtcggcggcgaagtaggcgaactcaccattggacttgatgatcacacggtccttgtcgtcgccgtgcttggtggattcaaaccaagtggcgccgtccttgtcgaagatgtcgccgcgggacttgagctcttcgatggcggcgtcgaccttgccatcggcgtacaggctgttttcatggaaccagacgtcgaagttcacgcggaagtccttcatggacttctgaatctcgtcgaacatcatcggtacggcgcgcttgcggaattcctcgcgcacttcggtatcggcctcgccgagcggttcaccgtcatcgttcaggccctgatcctggtgggccagtgcggtcaggtccacgccgtcggactcggcttcggcctgaacacgggcggcgatctcgttgatgtaggcacccttgtagccgtcgcacggggtttcggtctggtagccggcctcacccaagttattggcctcggcccaagcggcgaccagcgacttggcgaagcggttgatctgctcgccgtggtcgttgaagtagtattcgcgcaccaccttggcgccgttggcctcgagcacgcgggccatggcatcgccgacggcagcccaacgggtgccgccgatgtgaatcggaccggtggggttggcggagacgaactcgagattcagggtctggccgcccagatggtcgttgcgtccgtattcgttgaccttgttgagatgcttgtcggcgtcggtcacggcaccggcggcgagtacggtgtccaccacggcggcggccgaggcggagtcaagcgtgatgttgatgaagccggggcctgccacctcgaccttggcaatgccgtcggcttcagcgagcgcggcggcgaacggctcggccagatcgcgcggcttcatgccggccttcttggccagctgcatggcgatgttggaggcccagtcgccatgcgcacggtccttcgggcgcatcacggcgagcttttcgacgggcggaatcagctcgtcggtcaacgcgccggcctggccggcggcgacgaggttgtgggcaatgctggaaatcagttcacttaaggcttcaggactcattcttctaaggatactgagaacggcgacacttgtaccctggtatgcctatatgctgcccctgctggcgggggcaagcacacagccgaaagataccaagcgaaaaagggtaggcgacaatctccggaatcgttggaggctcgccgaaaccgctatacataccgtcggtcggtatctatagtgatctgcaacatcaagcacagtagggaggccaccatggcacgtaacgctcaccccgaggtgacgcgcacccgcgtcctcgacgccgcacaacggctgttcatgaccaagggctatgagcacacctccatccagaacatcgtggacgagctcggcgacctctccaaaggcgcgatctaccaccacttcaaatccaaggaagccatcctcgaagagctcaccaaccgagacaacaatgtgcaggacgacttcaacgaatccgtcatgaatcgcactgaccttaccgccctcgaaaagttccgcgtgctatggcggcattcgatgaccgagcaagaccacgtgcagatcatgcgagccgccatgccgatgctgagcgatccggtttcgttcgccgcgaatatgcaggtatggagcaagcatctgcccgaacgcttcctgccgctgatcgaggcgggcgtcaaggatggctccatccccaccgagtatccgcgcgaggccgccgagctgctttcgttgctgccgaattattggctgatgccgtatttctacccggcgaccctgcccgaaatggagcatcgcatccgctgcttggccaccatgctcgacgcgatcggcgtgccgattttcgatgacgagctcatcacggtcgccgcgaagggcatgatgacgttcgcaggggagccggagaaaggctcagaatgaatagcacagtgaaacccgagaatgacatcgccggcaccgccacccaacgcccgctgctgtcccgcgacttcgtgctgctggtcgccggacaaggcatctcgctgttcggcaatgtgatgctgcgattcgcgatgtcgatgtgggtgctggacgaaaccggctcagccaccatcttcgcctcggtgctggccatctccatcgtgccgaccatcctgctctccccgttcggaggcgtgctggccgatcgcgtcaaccgccgcaccatcatggtggcgctcgacgccatttccgccgtgctcgtgctggcgagcgccatcgtcttcgccaccacgggcttccatatcgtagccatcgccaccatgcaggtgctgctcgccgtgctcggcgccttcgaaaccccgaccgtgcaggccgcactcccccagatgttccggcagtacggcccggccaccatgcgccaaggcatggccgtgatcaatcaggtccaacaactaagcagtctgctgccgagcttcctcggcggcgtgctgtatgcgatgttcggcatccgtctcatgatgatcatcgccatcgcaagcttcgccggcgcagccgcgctcgaatgcttcatccgcctcagtgccccggatcgcggcgacgaggagctgcccaccccacttgaagacctcaaggcaggcgtgcgattcctcatcaaggaccggccgaacgtgttcagactgctgttgttcgcggcggcgctcaactttgtgcttatcggctattccggcgtcggcttcccgtacacgattcgtacagtgctcggcttcgacgccactgtctacggcatcgccgacggcctgatcggtgtttccggcgtggcgggcgcattcatcgccggcctgttcgccgccaagctcacgatgcgctggctgccggggctgatggcgacgcttacgctggccatggtcccacagggtattgtgttcctgctgccggtcgacgcatggaccaaactcgtggtgctgatcgtattcacctgcggcacgatggtcgccagttgcttcacgaatctcatcgccgtgcccgccatccagctcagtacgcccgaggcaatggccggcaaagtgatgtccatggccgcggccgtgagcatgtgtgcccagccgctcggccagatggtgtacggctgggcctacgaccaaatgccggtcgccatcgtgctgttcatcaccaccgccctgttcgccgtgctcaccgtgctgatggttccgctcgccaagcagttcgaggactgacgatcggcgcgcacgccacatcctgccgcccggccataattgaatcaccgcacgaaaaggcacgaaaaggcacgaaagaggtacctatggccacgctcaacccccaatcattggtcacgttgtggcaaatcgaacagtatggttcgttctccgccacggccaaggccacgggttggtcgcagccggccatcagccagcagatcaaaaagctggaggcacagtgcggttcgactctggtgcaacgcacctcgcatggcgtggaactcaccgccaccggttcgatgctcgcccgccacggcgaggccatcgccgatcggctggagcgggcggcccgtgaagtcgaggattatcggcatcatcggtttgatcacctgcatttggtggccccaccgtcaatctgctctactatcgcggcccgtaccgtggtcaagctcagtatgttcacggacatcgagctgagcctgattcagatggagccgccggaggcgatcggtctgatttcccaaggcaaggccgataccgccgccgtgttccgctacagcagcatcccgaacttcctgcacatcggcgacgacctgaccttccattcgctgggttacgatccgatgcgactgctggtgcgccgctccagcggcatcgccaaacgattcgaggagaccggcgaacctgtgccgctgtccgccgccaaagacgagcattggatcgccggctgccccacctgccgcgcaaatttggtgaaactggccacccgtgccggattcaagccggatatccgccactgcacggatgattactgggccacgcagaacctggtcgaggttggtatgggcgtctcgctggtgccggcgctcgatacgcatatcaacttgcagggcgatctggtggcctgtcccattgccgacgattttgcggcgcgcgaggtcggcatcgtgactcgtgccggcgaccatcgccccgcgcttggttcattgctcgaggagctcgagcgcacgtcactcaaatatttgagtgccaagtagtcgcacagcgataagcaagcttgcgagcgccatcacgatttcggggagccagaccgttgagcagcccttctgcaccgggaacaatgacatgttatgagcatgaacaacattccccagtcaacgactttgagcaacacaaccgccggcacctcttgctttgatgccaatcacatcgacgtgacgaccatcgaggatctggagcaggtcggttcggataaatggacccgttaccccggctgcatcggcgcattcatcgccgagatggattacggtctggcaccatgcgtggccgaagccatcgaagaggctactgaacgtggcgcgctcggctacattcccgacccgtggaagaaggaggtcgcccgctcgtgcgccgcatggcagcgccgctacggctgggaggtggatccaacgtgcatccgcccggtgccggacgtgctggaggcgttcgaagtgttcctgcgcgagatcgtgcgcgccggcaactccatcgtggtaccgactccggcctatatgccgttcctgagcgtgccgcgcctgtatggcgtggaggtccttgagattccgatgctgtgcgcgggcgccggcgagagcagcgggcgcaatgatgaatggctgttcgatttcgacgccattgagcaggcgttcgcgaacggctgccatgccttcgtgctgtgcaacccgcacaacccgatcggcaaggtattgacgcgcgaagaaatgctgcgattgtccgatctggccgccaagtacgacgtgcgtatattctccgatgagattcacgcgccgttcgtccaccaaggccacacgcatgtgccattcgcctcaatcaaccggcagacggccatgcaggctttcacctccacttcagcctcgaagtcgttcaacattcccggcaccaagtgcgcgcaggtgattctcaccaatccggacgatctggaactatggatgaggaacgcggaatggtccgagcaccagacggccaccatcggtgccatagccaccactgcggcctatgacggcggcgcggcatggttcgagggcgtgatggcatatatcgagcgcaatatcgcgctggtcaacgagcagatgcgcacgagattcgccaaggtgcgctatgtggagccgcagggcacgtatatcgcgtggctggatttctcgccactgggcatcggcgacccggccaactatttctttaagaaggccaacgtggcgttgacggacggccgtgaatgcggcgaggtcgggcgcggatgcgtacgcatgaacttcgccatgccctacccgctactggaggaatgcttcgaccgcatggccgccgcgctcgaggcggacgggctgttgtagaaaattgtggctcccctcagagaggggagccgaggaacggccgaattaatcgaagtcggcacccaacgcttcgagtttgccgcggaagtcggcgtagcctcggtcgatcaggctgatgccgtgcacgtccgaggggcctgacgcggccaaggccgcgatcagatggctgaacccaccacgcaggtccggcacgtcgatgtcgcgtccggtcagcggggtcggtccgaagatcacggcggaatgcttgtagttgcgctgccggaaacggcacggcagcgagcccaggcactcgcggtacaactggatggtggcacccatctcgaccagcggcttggtgaagccgaaacggttctcgtacacggtctcgtgcacgatcgacaggccgttggcctgggtcagggccaccacgagcggctgctgccagtcggtcatgaacccgggatgcacgtccgtctcgatcgccacgggcttcaagtccccgcccggatgccagaaacgaatgcccttgtccgtcacctcgaatttgccgcccaccttgcggaacacgttgaggaacgtgatcatctccggctgggtggcacccttgacgaaaatgtcaccgtgcgtggcgagcgcggcggacgcccaggacgccgcctcgatgcgatccgtcagcgacgtgtgcgtgtacccctgcagttccttgacaccctcgatgcggaaggtgcgatcaacgtccacagaaatgattgcacccatcttctgcagcacgcacaccagatccatgatctcgggctcggtggccgcgccggatagttcggtcttgccttcggccagcacggcagccagcaaagtctgctcggtggcgcccacggacgggtacggcaggtgaatcttcgcgccatgcaggccattcggagcagtgatgtgaatgccgtccttatgttccttatccacggtggcgccgagcttgcgcagcgtctccagatggaagtcaatcggacgtccgccaatcgcgcagccgcccaacgcgggaatgaacgcttcacccaaacggtgcacgagcgggccggagaacaggatcgggatgcgcgacgaaccggacagtgtatccacgtcggccacatcggccagctgcacacgcgaggcgtcgatggtcacaatgccgttcgcaccgtccacatccacgtccacgccgtgcagacgtagcaaatcggacaccacatgcacgtcacgaatctccggcacgttcttcagcaccgacttgcccggtgccagcaacgcggcgaccatcgccttgctcacgaagttcttcgcgccacgcaccttgatcgtgccattcaaaggcttgccgccctcgacatgcaacacgtcatccggattctcagccacgccactctcctcaatcaatcaagattcaaaaaatgctaccgtccagtttgccataagccatgtgccgactccgtgaaatgcaccccagccgaactttgatcaccgtgcacaacggatcccataccccccgtcgaatcaaaccgataacgtgatcttcctcacatttgccgccacggtgttctccatacttctacgctacgattcagggcaatggcatcagacgccatggccacaagcaaaggagcattcatgaccacagtcgccgtcatcggctgcacgcacgccggcacgttcgccaccacctcgattctcgccgagcaccccgattggaccgtccatgttttcgagcgcaacggtacgctgtccttcctctcctgcggcatcgccctgtgggtgggcgaccacgtatccgacccgaagaaaatgttctactcctcccctgccgctctggccgaagccggcgcgaccatgcatatgcgcaccgacgtgacgtccgtggacctcgacgccagaaccctcacctaccgcgcgctggacgaggccggagaccccgccgaacagaccctcgctttcgacaaactggtcgtgaccaccggctcgcgcccggtcatcccgccgatccccggcatcgacagcccgcatgtgctgctgtgcaagaactgggatcacgccatcgccatcaaggaaaaggcgaaaaccgccaagtcggcagtggtgatcgggtcgggctatatcggcgcggaaatcgccgagcagttcagcgtcaccggcgtcaagaccacgctggtcgacggccttgatcgcccgctggccaataatttcgataagaccatcaccgatcaggtggcggccgcgttcgaggagcacggcgtcacgctcgcgctcggccagaaggtggtcgagttccgcgacaatgacgacgacaccgtcactgtggtcaccgaaaagggcgagtacacggccgaaatggcgattctggccgtcggcttcctgccgaacaccgacctgctcaagggcaaggtggacatgctgccgaacggcgcgatcgtggtcgacgactacatgcaggcgtccgcgccgggcgtgtacgccgccggcgactccgccaccgtgttctacaaccccaccggccagcacgattacattccgctggccaccaacgcggtgcgccagggcctgctggtgggccgcaacatcgagacgccgaccatgaagtacatgggcacgcaggccacgtccgccgtgcagctgtacgatctctcgctcgccgcctccggcctgacccgcgccggtgccgaacgccgcgggctcacggtccgcgagacctcgctcaccgaggattatcgcccggacttcatgctcaccaccaccccagtcacgtcgattctgacctgggacccggaaacccgcaaggtcaagggcggccagttctgttccaaggccgatatctccggcgcggcaaacgtgatttccatggcgattcaggccggcttcaccatcgaccagctcgccaacgtggacttcctgttccagccgaacttcgacaagccggtctactacgtcggcgccgtggccatgaaggcggcggccgagtaagacggctgtacccaccgcaaaaaagaaaccccggcgtgatgggcgccggggagagaaaggagagaagaagaaaaaagaggttaagttatgcagcttgttcggccgtgattacatataacaacaccagtttcaatgcaacgtgggcactggctgggaattgtctgggaatcacggcccgtacaggctgtttcttgttttggagccgatttaccggctcgccttgatcttgtgggccagctcggcgtcccacatcgcgccggttgcggacatcaccgaatccgcgccggcgtttctgtatgcctgatagtcggccggcgaaaccacgccgcccacgccattgatcttgaaatcaagaccgagcttctcgcggatcgcggccagacgggcgaccatgtcgaggccggcgccacgaatcgcattgccacacacgccggagcgatcgcggcctgcaccgggcagggcctgattgccattggcatcgaccagtttggcggaaatcgtattgatggtgctgaatccctgcacagtgccgtggcctacggtggaacgcaccatgagttcaaggtcgccgtcgctggggatgtaggcgagcttgaccatcagcgggatgtcgccgatctcctgcttcacggcctcggtgatgcggcccacgagcagcggattgtggcatagcaggcggttgtggccctcgttggggcagctggtgttcatcaccatgagcttggcaccggtttctttgaccaggcgggcggtggtggcatggtcggcgatgtattcctcctcgctcatgccctccacacgcgagccttggaagctcgggaccagcacttgaccggggccggcggcctcgatggcggcgcgcatgtccggctgccaggcatccgggctttgcgagggcacgccgaagctattggagatggagatcggagtctcgtaattggtgtcggcgagcacgccctcgtccagttcggcgctgcccggcgtcagtgaaccgtccgccgccttggggtgtacggcgagcacgttcgggaacggattgcagccccaggcgcgcgaacgcacggttttgtaggtcgccagatcgaagcccatgcggaaggcggccgtggtgaagcggctgttgagcagcgggcctgcgggaatgccgaaaggcaggttgaccggctggcccaggaaggaggccgaggcaccctcggaggcaccctcgctggtggttccggcggcatcggcaccgttgccatccttcagcgcctcggcaaacgcgccgaacggcccttgctcatagttgtcttcgtagctgcggctgacgtcgtaaaacggctcaaaatcactcatgcttcaacgataagccaacctacatgcgtacacgcacactcaacccaccatcgcgccgtcaaacgaaataatggcgaaagcggcattggctaccacaaagatgatgaacgtcggagctgcccagccaaagtacgtgtctggaatactacgattcgtacggtgatattggtgcaaacttaaatagtgcaaacacaccctagaagagataggagggaatggcactttctcgcgttgttggtggaagtatttgggacgctaagcgagttgccgcattggaaccagacgattgcgtgaagtgaccctatacgtaaaaggtctcactggcgagagccagtgagacctttgtctgatgcgatgcgagcgacccaataatctcaatcagacacagagccaacggccctgggcctgcaattatggactcgcctttcggcgaggctcaatgctggcctcgctgctgtcgcagctcggcaggccgatcgcggctaaataatgcctcgatcggccaacggccctgtccagtctgcgccctccggctcgcgggcggactcgattctttcttcggcccagtgtttggcggggatggtcttgggcttgaaggggaacttttcggcgcgcatcttttcgtagacggcgatgtcgtcctcgtgctgcagcgtcagatcgatgtcgtcgtagccgttcatcagacgccaacgcacgtaatcgttcacctcgaacggcagggtcacgtcaccgcaagtgacggtgcgagtctccagcgagacagtcatctcgcgaccaggctcttcctccagcagcttccacaggagctcgacggactcctgcggcataatcgcggccagcacgccgtttttggcggtgttgccgtagaagatgtcggcgaagctcggcgcgatgaccacgcggaaaccgtaatcgtgcagcgcccacacggcgtgctcgcgggaggagccgatgccgaattcggggccggcgaccagaatctggcccttaccggcgtattccggcttgttgagcacgaagttcgggtctcggcgccatgcgtagaacagggcgtcatcgaagccggacttggtcacgcgcttcaagaacacagcgggaatgatctggtcggtatcgacgttggagcggcgcagcggcacgcccacgccggtcagtgtggtgagtttttccataacaattttcctttcggggatctctcccccagtcagtcttcgactgacagccacctcgtcagagggggctcatgtgtattgactcagagatcggcgggggacgagattgtgccgcggatggcggtggcggcggctacggccggcgacgccaaatgcgtgcgcgagcccttgccctggcggccctcgaagttacggttcgaagtggaaatcgagcgctcgttcggcaccagcttgtccgggttcatgcccaggcacatcgagcagccggcgttacgccattcggcgccaaagtccttgaacaccttatcgaggccttccttctccgcctgcaaacgcacgcgggaggaggccggcaccaccagcacgcggtggatgttctcggccttgcggtggcccttcataatcgcggcggcctggcgcaaatcgtcgatacgaccgttggtgcacgaaccaatgaacacggtgtccacggcgatgtccttgatcggcatgcctggcttcaaacccatgtatgtaatcgcacgttcggcggcggcgcgcttggtggcgtcggcgatcttgcccggctccggcacggaggcggtgatcggcagaccttggccggggttggtgccccacgtcacatatggaccaagcttggtggcgtcaatatccaccaccttgtcgaatacggcatcgtcatcggtcttcagcgtcttccagtacgccacggcctgatcccacagctcgccttccggcgcgtgcggacggcccttcaggtactcgaacgtggtctcgtccggcgcgatcatgccggcacgcgcaccggcctcgatggacatgttgcacacggtcatgcgctcgtccatggtgaggttgcgaatcgcctcaccacggtattcgatcacgtaaccctggccgccgccggtgccgatcttggcgatgatcgccagaatgatgtccttggccgtcgcgtccgcgggcagcttgccgttgacgttgacggccatggtcttgaacggcttcagagacagcgtctgtgtggccatcacgtgttcgacttcggaagtgccgatgccgaacgccagcgcgccgaacgcgccgtgcgtcgacgtatgcgaatcaccgcacacgatggtcatgcccggctgggtcaggcccagaatcggggcgaacgcgtggacgatgccctgatcggcgtcgcccagcgggtgcaggcgcacgccgaactccttgcagttcttctccaaagtcgtcaactgcaacgcgctcgtctcatccgggttcgggcgatcgatatcaacggtcggcgtgttgtgatcctcggtggcaatgagctgatccacgtgacgcggcttgcggccggccaagcgcaggccctcaaacgcctgcgggctggtgacctcatgcatgagcatcagatcgatgtacagcaaatcaggggctccgtcgctgcccttgcgcaccagatgatcggcccagaccttctcggccagtgtcgttcccatagtgattcctccaaaaaattccgcgcgaggtattgtgttcgcgccttgttcgtggtattagcctatgtgcttgcgatgggcccggccatgagcatgccggatattgagatacggtcaaatgatggcctcaatatgactcggatacgactcgaacatgacctagtcatgactcggttccgctccagacatgtctcttcggcatccacgaacgccctttcaacttcatggccaccctgtgagacacttccccaatttgctatttcactatgtgagatggcataatcgcccttattatgactgattcccaagaagagccattgaacaacagcttgaccgagtccgagccggttgaagacaccaccgccaaggacgatggggaaatccattccggcgttggcgtccttgataaaaccgtaaagattcttgacgcactggagtccggcccgtccacgctgggacagcttgtggccgccaccggtctcgctcgaccgaccgcacatcgtttggctattgcactggaacgccaccgtttcgtactgcgcgaccagcatggccgattcgtactcggatcccgtttcgccgaacttgccgccgcagcaggcgaggatcgtctgctgaccgccgccggcccgatcctgcagaccctgctcgatcgcactggcgagtctgcgcagatttaccgccgccagggcgatcagcgcgtgtgcatcgccgctgtggaacgcacctccggcctgcgtgattccattcccgtgggtgccatgctgtcgatggaagccggttccgccgcccagattcttctggcttgggaggattccgaccgtctgcaccagggattgcgccacgccaagttcaccgccaccaagctggccgccgtacgcaagcgcggctggtccgagtccgtgaacgaacgcgaagagggcgtgtgctcgatttccgccccgatccgcaacgcctccggccaggtcatcgccgccatctcgatttctgggccgaccggccgcatgggcgccgctcccggacgccgttatgcgccgctggtgatggccgccggcaagtacctcaccgaggcactggtcaaagccgttcgctgaaacataccagtcaatccaaccgatagcccaaccggcagaaatcccgcgaggtatccgtcgagacgcgggatttctgccactaatacacagcggaaggcccccgaaaccccgaatacttcgcgccgcttcccgcctctatcaggaacagttacctgaataaaccggacagttgactccatagcgacggcttgcgcagcaaatcatcgccctcaccctcgccaggcgtggtctggttcaccgcataggtgtaggcgcgtttggaactgggcttgcccaccagttcgccaaactccagcaattgcgtacgcggctcgtaagggtgacggatatcaaattcgatcaatcgcgtggcacgtttggccggagccggtccgtacgtattgaatccgcaggttggcgtagcgataagcaacagaccctcatgttcgccgacgaaaccgttacgatgatcatgaccagctacgacgccgaaatacccctcgcgcagcaattcgaattcgcctgacgtatcagggcaggatatgccttctcccaaatatccgccgggctgggtttgcaattcgtccagcacgtagtaggtatcggcgtgcgaacgatagccctgcatggcaaacgccgcgttggccgccaccggcttcagcacgttgtaatactcgggcatcggcatgtgctggaacaccattgatttcgcaccgatacggtcgggcacggcgttcaggaaggcgagcgctgcgggcgatggtgcgccgaagccgccgccatgcacgtaatcgccggagtcaagaatgaccagacccagcacattgcgcgtatggtcaacgtccataaccggcagcgcgaaggtgcctggttcaccggaacccactgcggatgcgggggaagacacagcagaaggcacaacagcatcggcaccagcatcgtcaacgacgcccaacgtatcagccttcgcggtaatccccgcaccggagccagtggcaccagacggcgtctgcacagcgccacccgctccacaggtatatgcaatctggttcggcaaggtctcactcggcggattgacacaaccggggaactcacgatagataccgtccagttccgcattgcttagcccgcattggaaatcatggttgccatacgtcacagcccacggaatgccgcgcgccgccaacggctcagtgaactggccaatggccttgcgcaccagcgctcgggtatggttcagcgcggattcggcaataggttcgtcacaccagcgacgtttacggaatgaatcggcgaacgccggatcgtagccggcgatctggttgccggagaaaatcaccagatcaggccgtgtggcatcaaggctggcctcaatcagggcgatggtgtctttggagactttcggcccatcctgaatgtcggcaatctgcagcacgcggaacttgccggaatagtggaattgcagtcgtccgagacgcgcagagatagagaccgggcggccgtcttcggcatcggccggcttgatacgaggtttcgacgacatcccctctggcgtacgctgtgtttccgtcatgccctccactgtacacacaaacgaaaaggcccgccggagcgggccttttctacaagttcaactactggagcagaatctctgcacaacatcatcgttgtaacggtaagtctttccaatgcccgtccaacgtaacagtcctcgtgaccatacactatttgtgggctctgctctgttcagttgttcttgtacctcataatctattcatcactcccgtttctcgcaacctgcagagagtcgttgtgcgttttttatcacaactgttcaatcgcactttctggctatcggaaaacgagctgaaccgttcacatcgaacccgtccgatgttcgatttcgttcgtttcaccgccgctcacggcgtgtcgcgagcgacgctagcacactcaaaaccaaccaacaccgaactaacatgaacacccgttgaattctggcgcgttcagtcgttttccggccacgccaaagcttacgatataagctatggcacagatatttgacgcaccctcgaaggcaattctgcgcagccaaatcgcagagcatattgccgaaaacgacaacaacgaccgccgcgtcgatcaggaaggcgaggcaccgctgcccaaggaccgtttcttcgaccgcgagctcagctggctcaagttcaaccagcgcgtgctcgaatgtgcggagaacgaagacatgcccctgctcgagcgcgccaacttcgccgcgatcttcgcctcgaaccttgacgagttcttcatggtccgcgtcgccggcctgaagcgccgtatcgactcgggcatcgccgtgccgtctgccgccggcctgagcccgcgtcagcagctgcgcgcgatcagcgagaccgcacaccgtctgcaagacgagcacgcacattacacgatcgacaccattctgccggaattggagaaggagcgcatcgtcctgctgacgtgggacaagctcacatcctccgagcaggagcgcctctcgcgctactaccgccagcaggtgttcccggtcctgacgccgctcgccgtggatccggcccacccattcccctacatttccggcggttccatcaacctggccgtgattgtggagaacccggcctccggcaagtcgcacttcgcccgcgtcaagatcccgggcaacctgccgcgcctggtgccggtggacgacatgaccgatgaggagtccaaggacgagcgttacggcttcatcgccatggaaaagctcatcgccgcgcatctggaatccctgttcccgggcatgatcatcaaggaggcccgctccttccgcgtgactcgtaacgaggacatcgacgtggaagaggatgacgccgagaacctgctcaacgccatggagaaggagctgctgcgccgccgcttcggaccgccgatccgcctggagatcacggacaccacgagccccttcctctcccagctgctcgccgaccagctcggcgtgagccaggacgaggtataccgtctgcccagcccgctggacctgaccgtgctctttgagctcggcagcgtggaccgcccggacctgaagaaccgtccgttcgtgccgaccacgaaccgtcagatcgccgaggtcgagtcctcccgcgcacaggatattttcgccgccatccgcgagcgcgacatcctgctgcatcacccctatgactccttctccacttccgtgcaggccttccttgcgcaggccgccgcggacccgaaggtgctggccatcaagcagaccctgtaccgcaccagctccaactcgccgatcatcgacgccctgatcgacgccgctcatgccggcaagcaggtgctggctttggtggaaatcaaggctcgtttcgacgaggacgccaacatcgcgtgggcccgcaagctcgaacgcgccggcgtgcacgtggtgtacggcatcgtgggcttgaagacccactgcaagctcatcgaagtcgtgcgtcaggaagcggacggtctacgccgctactgccacgtaggcaccggtaactacaacccgaagaccgcgcgactgtacaccgatctgggtctgctgacctgcgacccggtggtcggccaggatctgactcgtctgttcaaccagctctccggttacgcgccgaagtccagcttccaccgtctgctggtggccccgcgcaccgtgcgcaccggtctgatccagcgcatccgccgcgaggaggacgccgcccgcgccggcaaggaggcctggatcaagatcaaggtcaactccatcgtggacgagaagaccatcgacgccctgtaccgtgcctctcaggccggcgtgaagatcgacatcgtcgaacgcggcatctgcgctctgaagcccggcgttcccggcctgtccgagaacatccgcgtacgttcgattctcggccgcttcctggagcactcccgcatctacgccttctgcaatgctgacggcccgcagatcggcgagggcccggcttccggcccggaggtctacatcggttcggctgacctcatgcaccgtaaccttgaccgccgcgtcgaggctctggtgcgcgtcaccgccccggagcagattgacgagctcatcaagtacgtggacctgcagatggccgactccaccatgagctggcacatgcagcccgacggcgcgtatgtgctgcacaccaaggacgacgagggccgcccgctggtcgatagtcaggaatacctgattcgcaagcaccagcgtcgccccaattcgcacaactgatttcactcgatgctccctgtcagcgcaagctgactggggtggttacgatgcccggctcctctttcgagaggatgccgggcatcgttgttcagcgcgcaaaaactacgtagcagcggtccaacgtgacctacaatacaagagatgggtacgaacagtatgagacgaatcgtggaagccgccggcggtattctgtaccggtggaaggatgatgccgagccgacgcaggcatcatctccatcaacgaaatccaatattgccaccgatggcaccatcatcgcgaacaccgcggattctgacggcgagaccacggcagcacccggcgcatcggacgcggcttccaccccggacccggcgcaggccgacagcccagccacggcggacaacgtactcaaccgcatcgaactgtgcatcgtgcatcgcccgaaatacgacgactggagctggccgaaaggcaaggtcgacccaaacgaatcacaccggcatgccgccgtgcgcgagatcggcgaggaatcgggcctgcccgtggagctcggcccctatctgggcgacatcgagtacccgctgtccgaagagggccgcaaacagcgccataccaaggatcggtcggcggacaccaagcacatccagttctggatggccacgccaatcagcgccatcgacaatctgcggcgcacccatgcgttcggcccggtgcatcgggcggacatcggcgaaatcgacgaagtcctgtggttgacgccggctgaggcccgcaagaaactcagccattccaccgataaggacatccttgcgctattcgttgaccgggtgcaggagggcgcgcttgacgccgtgccagtgattatcgtgcgccacagcaaggcagaagcgcgcaaactgtggaagggctcggacgagaaccgtccgatcacgccgcgcggcgcggctgcggcatacgcgctgaaccgtgagctggcgtgtttcaatccgaaccgactggccacgtcgccttgggtgcgctgccaggagacgttggagatgttcgcgtggcagaccggacgagacatggttcatctcgatccgctcaccgaagatgcatacgccgctgcgccggacaccgcatgggaatgtctactcagcgaaatcgagttcgcacttgagcgccgtcagcccatagcgatatgcatgcaccggccggtgattggtggtatgttcgaacacctgcgcagcatgtgcgttgcgccgtctctgagcaaacgcctaatcgccaagacaccgttcatgccgaccggcactgcggcggcgctgttcgtcactccgacgcctcatggtcccaaaatcatcgatattcagaaggttcaaccgcttgtctactagacccgcattccctgattcatccaactcctcggccgctgccgccgcagctcatgccgcgcacaatggtgccgccggcagtctgggcccaggcttcggctcgttgcgtgcggccggagcggcattcggacctgctcgcatgggttcttcgcgtccttcgcgcccggctcagctcgacccggctgtggccgatggattggccggcggcatggacccgcaagcgttgagcgagatgagccatctgtccgctgccgcattgctggatcgtgtgcgccatagcgaagacccggcggttgttgagcgggtgctcacgttggtggagacggtcggcgtggatgaaatcgccgaactgtggagcgatgctgagccggattcgctgcctggtgtgctgtggcgactgtatatgttgcgtacgtggatgcgatcgaatcgcgactcaatcgcgcatctgtggcgcttgggtgagccggtggccactaccgcctccgccatcgccggcgtggatcaggctcccagtgaagatgacatcgtgcgattggccgattcgattctctccggtgcttttgtgggcgattttgccgtggcgcttgagcgtgcggcggcgtttaccgatgtggtggcgttgggcttgcgcgtggaggcgcggcgcatggtgacccgggccgaggccaacggcgccttctcctcggatgccgatgagaaggccgtacgcaccaaagccgcccgccttatgcacaccgccggcagcctcatggccaccgccaaggatttccagcacggtgccaacctctggcgtcgcggacggttggagtaaccccgctccaggctccctctgatgagggagctgtcacgggcgatgcccatgactgagggagaaacccaccgaccgcaccccaacaatcagctaccggccaacaccaccccttccccggcgcggcgagacccatcgcaagctatactaagtatccgcgtcggaccgtgcttaagccccgggctccattttttgccgccgcgagcggcccttgcgccgacaggcgctttcgcggttcggcgcttctcttcttttaccagattcacgccccgagcgttgcgatgggcacgaccagtatgccgtcattgcggcgataggccttcccacctcggccggtaaggaacatcatgaactctggttcgcgaacttgggccatgggattgccgcagattttgttgcggaaggatttgagcttatccgcattgtcatcgttcaccttaaggtcactgagttttatttcgatggcaccccacctgccgtcagacaactcgataatgacatcaacttcaagccccttgtcatcgcggtaatacgcaatgcaattcccggcacccggcatagccgacagatatacattcaaatcacgaatgcacagcgtttcaaacagatcgccgagcgtctgtgtatcccgcatcagcgtcttcggcgacgcacctaaaaccgcagcaggcaacgaaggatccacgaaatatcgcttgggcttggttcgcacacgactctttgcgcggagtggcggttcccaaccctccaaatccgtcagcagatacaagtccttgaacatttccaaatagctcttcaccgtctgcgtatccggctcacgccgctcatcgccatatgccatatccgcagccagcgtcgcatattttggtgcctgcgagatgttcacggcaagagctcgcatcaaagctcgtgcagtttcaggattcttcttcatcttcggcacgctgatatccagcacacttgcgatatattcgcccgggatttccaaggcgaattcatcgtctagctcaagattcgcgggccaaccgccacggcaacaccatctggcgatgtcttcgatactcgtattgcattcggcaggctcgaatttcctctcgaacaaatcggataggctgaccgcgcccgtggattctccggattcagccaagctcatgggccacatgcgcagacgagcaatgcgaccagtgccgctgtgatgaatggcgtcacgatcctttggaatagccgaacctgtaagaatcagctgccccttgcggttcgcattgtcatctatatggcgacgagcggcatcccaaatttgcggtacatcttgccattcgtccaccagatggggctcctcccccatcagcaccaatgcaggatcggtttgggcggccgcgaaaactgccacatcatccagacggtcaacgcttcgagaccgggagagcgcggtccatgtcttgccgcaccatttcggcccaacgatttccaccgcaccgaacgccttgagcagtttgcttaatctgctatctaccacgcgtgaacgataatcaggcctggtcaaggtaccatcacgaccactcaaatcgttcatattgcagcctttcccagttctatcgttctaacaatatagattttacaccagtttcattcccgattttacgcctatctcattcccggttttataccagtttcattccctgttttacaccgtgttgtttttacgctttaccccctcagaggtatcagaggcagatctcgacacggacagggcattgtcctgctgcaactggcctatcgcagcaaaaagtcgaatcacccacaaatccaatccgatgagcaagccgcgccattaccaattcggcaggtcggcaaacttggactaggctgggaatcatggaactccatgttttgaatcatccgctggtcgagcacaagctcaccgtgctgcgcgacaagaacaccccctcctccaccttccgcgagctcgtctccgaactcgtgatgcttgaggcctacgaggccacccgcaacctgtccgtggtggccgcgccgatcgagacgccggtcgccccgatgaccggcaagaagctcgcctccccgcgcccgatcatcgtgccggtgctgcgcgctggcttgggcatgctcgacggcatgacccgcctgattccgactgctgaagtcggcttcctgggcatgaagcgcgacgaggagcaccccacccagcaggtgacgtacgcgaaccgtctgcccgaggacctgtccggccgccagtgcttcctcatcgacccgatgctcgccaccggcggaacgctggtcgccgccacgcactacctggccgagcgcggtgccaaggacgtgaccgcgatcaacatcatcgcggcccccgaaggcatcaagtacgtcgaggagcacatcgacccgtccatcgacttcaaggtcgtggtgtgcgcggtcgacgaacgtcttaacgacaagtgctacatcgtgccgggactcggcgacgccggtgaccgtctctatggcgtaattgactgatttccctggctcccctccccgaggggagccagcataacggaacatctatgcaaatcgacattattgcgccggggcgcgtgaaggagcgttaccttcgcgacgccattgacgagtattccaagcgactttcgcgctactgcaagctcaacatcattgaagtggcagatgagaaaacgcctgaccatgcctccgaaggcgttgaccgacagatcaaggccaaagaaggcgaacgcatcgccaagcatctgaaggacggcgcgtttgttattgcccttgccatcaatggcaagcagctgtccagtgaagagttggccgccaaaatcaacgaccttggattgcgtggcaccagccatattcagctggtcatcggcggttcaatcggccttgacgacgcgattctgcgtcgtgctgattttctgctgagtttctcgaagatgacgttcccgcatcagcttatgcgcgtgattctgctggagcagatctatcgcgcttataaaatcaacgctggcgagccgtatcacaagtaaaacgccatacctcatggggcgggaaatcccccatggggcggtaattgccccatggggccgtaaaaccctcatggggcggtatgccaaaatggcttaattccgcggtttcacatattcttcaaaccgccccatgggcaagttaccgcccgatgagcctgtaaccgccccatgggcgcatcaataacgccctcaacctcacactgcgtcggggacgaacgcttcgaagatgtggcggtcgaagtagggggcgcactgggcgagttcatcgctgttgcgcacggtccatgaaaccggcatcgcacccatcgaacgagcgagcttgacttgcggcgaagcgccaccggtccagtcataagccacgaaatcaggacgagacagccagtcgaacgccagtaagccggcggcccattcagccgcaccattcttgctcagcttcgccggccagctcagctgaccgcggcacacctcagggtgatgctccttgtaccaattcaccgcgcccgggtggaaggattcgatcacgtacgggccgtcatacgcctcaagcaaggcatggcccttttccatgagctcttcgctacgctcatcccaagccctgttgttgctgaacttgtattccacaatcagcggagcccggccggccaccacgtccagcacatcggagaacagcggcacatgctggtagtaccccttcggcgcggcggacggcgtgaccaccagcggcgggttcgcgtcggcacccggcaacggttcggccttcaaatcgcctgactcgccgttcgggaagagcggaatacgggtgagttcgtcgtaagtcaggtcttcgatgcggcgcggatcgccggccacgcgcaacaaatcggcgtcatggaccacgaccacttggccgtcgagcgtaagctgcacgtcgagttcgatgccatagccagcctcgcaggcggcggcgaacgcggccagcgagttttcgggagcaatcggaccggtcatatccgcactgccgtagccggccttgacagccatgcgacgggcaagcgacacataatcatcgttttcggcgatggatcgctcagtggtatcggcttgggcgctgaccggattatccccaccataatcagcgatatcggtatagccgaccaaaccagaacccgcatcatgcaagccacgatgggcataccatacctccggaatggagggcacgaaattacgacgcttgtcattgaacgtgcgcggggccacggcccacacggcagcaccggcggcggccacgcctgccagcgccacgtttctccagagcttcgacgacattggaatccttcctgttgggctgcctctagcctaacgcttctgccagccattgtggagtggttggatcatccggtttcagcgcgcggtccaggtggttggcgcgcagtggctcccagctgaaatctgccagcagatcggcgggtttgcaaggaattggagtgggttgccgacgcagcagccaggcgcagtatccgatgatttgctcgggggttacgttgcgggcgcgcaaggctcccatatccagcgaacgttcgcgcttggctaaacgccggccggccgcattgtcgataagcggcaggtgcgcatactcggggtgctcggcgagaggcttttccgtgttgccgcattccggctcaaagccgccagccaacagacactggcgaatccagatttgcagcgcggtggagcgcagcagatcacggccgcgcacgatatcatcaacacccatatcgaggtcatccacgaccacgaccagttgatagccgaacagtccatcggctcggcgaatcacggaatcgcctacctcgcgggccaaatcgtagtgctgtggactatagacacggtcgttaaagcatgcgacaccatcaacgattccggcatcgccctgccgttccggcggcacggctcccaacagcgcagcggaatcgtcaggcactgtacgttgcttttctcccgctgccgattccggcatggcgatacggatggaatgctggtcgccgcgaaccaaacgggcacggacctcgtcgggatggtcgtgcagcaggcggcggcacgtgccggggtacaccatgaagccgtcgccctcgttgggggccgaggcggcgcgaatgtcggcacgcgagcagaaacaggggtacagcacaccttgcgagcgcaggcattcgagagcgtattcgtatcgttcagtgcgctgggattggaacatcggttcgccatcccagtcgaggccaagccaatgcaggtcatccatcatgagctggtccgcaccggcggccacacgcggcttgtccacgtcctcgatacgcatcagcatgcggtcgccacgcgagcgggccgaaagccatgcacccaacatggcgtacacgttgccgatatgcatgcgccccgacggcgtcggcgcgaatcgtccagtcactggtcctcctcgtatgaagttcagcaccatggtagcgaaaaggctctcctcctcagaggagagccaatatagtgaagctcgccagcccgaactcccctcagtcagcttcgctgacagctttgctcagagagggagccagtgattgtcacttgtcttcggtgacgttgcccacgctcacgtccggatcgtcggagacgatctggtcgctggcccaggcggaaagctcaagatgctcaccaccggtctggtcgaccagcacggtgtcgccatcgtggaccttgccggccagcagcatacgggccagctggtcgcccacttcggtctgtaccaggcggcgcagcggacgagcgccataagccgggtcgtaaccggtgttggcaagccattcgcgagccgagtcggtgacgtccagcgtgatgcggcgatcggtcagacgctgggacacgccagccacctggatatccacgatgccgccaagctcctcgcgcgtaagcgggtggaacatgacgatgtcgtccagacggttcaggaactccggcttgaagttcatgtggacagcgtccatcacggcctttttcttggcgtcggcgtccatgtcctcgttcacgaggaactgcgagccgaggttagaggtcataatcaggatcgtgttcttgaagtccacggtccttccctggccatcggtcaggcgaccatcgtcaagtacctgcagcagcacgtcgaagatctccgggttggccttctcgacctcgtcgaacagcaccacggaatacgggcggcggcgcacggcctcggtcagctggccgccctgctcgtagcccacgtagcccggcgccgcgccaatcaggcgcgagaccgaagccttctccatgtattcggacatgtcgatgcggaccatggccttctcgtcgtcgaacaggaagtcggcgagcgccttggccagttcggtcttgcccacaccggtggggccgaggaacaggaacgatccggtcggacggttcgggtcggagatgccggcacgcgaacggcgcaccgcgtcggacacggcggcgatggcttccttctggccgatcacacgcttgccgaggtagtcctccatgtgcagcagcttctcgttttcgccctgcatcaggcggccgacgggaatgccggtccagtcggagacgatctcagccaccgagtcggcgtccacgcggtccgggaccatcggctcattggccgggttggccgcgctggcatcagcagattcagcatccgcgctctccgcggcggcaagctccttctgaatggacggaatctcgccgtacagaatcttcgaggcctcggccaagttaccctcacgagtgaacttgtcagcctgcacgcgcaggtcgtcgagcttggcacgcaggtcgccgaccttgttgtggccggcctgttccgcatcccaacgcgccttgagaccgctgagcttctcacgggtgtccgcgagttcggcttgcagcttgcccagacgctccttggacgcggggtcctcggccttcttgagctgcatttcctccatttcaagacgggtcaccttgcgctgcagctcatcgatctcctcaggcgaggagtcgagctccatacgcaggtgagcggccgcctcatcgaccaggtcgatggccttgtccggcagctgacggcctgaaatgtaacggttcgagagggttgcggcggcaaccagcgcgtcgtcgccgatcgttaccttgtggtgcgcctcgtaacgctgcttcagaccacgcagaatggcgatggtgtcttccacgctcggctcgcccacgaacacctgctggaacctgcgctccagcgccggatccttctcgatgttctcgcggtactcgtccagcgtggtcgcgccgatcaggcgcagctcgccacgggccagcatgggcttcaacatattgccggcatccatcgagccttcggccgcacccgcgccgacgatggtgtggatctcatcgatgaaggtgatgatctggccgtccgcattcttgatttcgttcaggacgctcttcaggcgctcctcgaactcgccacggtacttcgagccggccaccatggagcccaagtcaagggagatgagcttcttgccttgcagggtggtaggaacgtcgcccgccacgatacgctgggccaggccttccacgacggcggtcttgccgacgccgggctcgccgatcagcaccgggttgttcttggtacgacgggagaggatctgaatcacgcggcggatttcctggtcacggccgatgaccgggtccagcttgccttccttggcggcggccgtcaggtcggtggagtacttctctagggccttgtacgagccttccgcgtccgggctggtgaccttcgcgccaccacgcacgccgggtacggccttgcgcagggaggctgcggtgacgccgttcttctccaagatttcggccgactggttcggcttgctggccgcgatgccgataagcagatgttcggtggagacgtattcgtcgcccatctgctgcatttccttctcagcctgggcgatggcggcggtcagctggcggctggcctgtggctgcgaggtgctggagccggatgcgctcggcagtgcgaccaaagcgttgcgcacggcggcggcgatggcctgcgggtccccgcccgcggcctcgatcagagagcgcgccacgccgttttcctggcgcagcagcgcatccatgacgtgcagggtctcgacctgcgcgtttcctgcggcggacgcactctgaatcgcgtcgccgacggcttcttgggccatagtggtgaacttctgttccatatcgtattcctccatatcatgcggtctgcgcagtgcggctcgcgggcttcgaaagccctgcgagcgttgcgacagaccgcagcttgtcgttgtctgatatggtcaaccgacctggaacccattctattcccaaaacttgagtgcatatgactcaagttttggattttggtggggagggtgactagtagctccttctgatgagggagcttgggcagccgctacttcagtgcgccgacggcggattcggcggcggcgaggacttcgccggagagaatcgcctcggcaacgccctcaatctgcggggtggtccaggtatcgcgtacgtcggggccgatttcgttggcgtactggcgcaccacgcggtatacggcggcgcccgccgcacccggacggtacggcttgcggaagtcgaaggagcggcaggagcacagcagttccacggccagcacgcgcgcgaaggccggaatcgaccggcgcagcttgcgggcggcggcccaacccatcgacacgtgatcttcctgcatggcggagcttggaatcgaatcgaccgaggcaggcacggcgttacgcttcatttcggagacgatgccggcagcggtgtattgggcgatcatgaaaccggagtccacgcccgggtcaccagccaggaacgccggcaggccgcggttgcgcgccacgtcaaggaagcggtcggtacgacgctcggagatagaggctacgtcggcggtcggaatcgccaggaaatcgagcacataggccagcggcgcgccatggaagttgccgttggactccacacggccgtccagcgtgacgcacgggttatcgatggcggaggcgagttccacgcccgccacggaggccgcgtattccacggtgtcgcgggcggcgccgtgcacctgcggggtgcagcgcagcgagtaggcgtcctgcacacgcacggtggagcccgggcggccggcctcgatcagaccagagtccttgagcatgcgggcgatgttcgcggcggaatcgccttggccgcgatgcgggcgcagcgcctgcaagtcggcggcgaatacgcggtcgttgccgagcatgccttccacgctcatcgcggcggcgacatccgcggtcttgagtagcaggcgcagatcggtgatggccatacacaacatgccgagcatgccgtcggtgccgttgaccagcgccagtccttccttctctttcaaatcgacgggcgtgatgccggccgcacgcagcgcttcgccgccgccgatcttgaggccgtcagcgttgcgggcctcgccttcacccatcgccaccaaagcacaggctgcgagcggcgccagatcaccggagcatccgagtgaaccgtattcgtagaccaccggggtgatgccggcgttcagcatatcggcgtagacctgcgcggtttccgggcgcacaccggtgcgtccagtgcacagggtgctcaggcgcagcaccagcaggccgcgcaccacctcacgctccacttccggtccggcaccggcggcatgcgagcgaatcagacttttctgcagctgcgcacgctgttccttggggatggaggtggaggcgagcgcgccgaatccggtggagataccgtaatgcggcacggtgtcgtcggccaaatgatcgataaccgcgcgactcagcgccatctcatgcttcgattcgtccgaaatcgccactttggcaccgccgcgcgctacggcgataacgtcctcgatgctcagcgctccaacacctacggtgaccgtctgctctgccatgctcatacctttctatatatgtgccgcattccgcatatacgacatatgcggcacatgcttcgccggggatccgcgactgcccgcattcgctcaccgcacctgcccatcaacagcaggcgacgcaaacgcgaccaatcgctccccgagtaatcaaaccttggccatttcacctcagtcggatgcccgccataagccacttcgtccatcttgtgtctgaaatctcagacatgtaaggtgatggaaatatgagccatgcctcgcagcaatacgccttcaccgagccacgtaccgtcaagcgggcgcaggtgaagccatcagaacgggaacatcagacatcatcatccgcgccacgtgtctcgctggctccggcggccgaccgtacgctcgacatcctcgagttcatcgcgagcaatggtcagacgcaagccgccacgctcgctcgcgaactcggcattccgcgctccacggtgtaccaattgttggagattttggagcgtcacggactggtcacccgccttgccgagcagcgcgcgtacggcatcggactcaagactttcgagctgggatcggcctattctcgccaacatcgtgtatcgcaggtcgcgcatccggtgttggcgcgtcttgttgacgagaccggcgaaaacggacatctggccgtgctgcacggcaacgaaatcatttatgtgattgaggagcgcgccgcgcatcgcccgccgctagtgtcaggcgtgggcgtgcgcctacccagtcacctgaccgccaccgggcgggccattctgtccgcactcccccgcaatcaggtccgcgcgctatatcccaatcgtcaggcgttcaccgaccgcaccggcatcggccccaaatcgcccaaggagctggaggcaacgctcgccgaaacccaacgcaccggttttgccgaggaacacggagacgtgacgcccggctttgattcatacgccgtcgctgtgcgcgactacaacgactttcccatcgccgggctggctctcactttcgtgagcggatcgctgcgccccgaacaggagcggttgcttaagaccaagctgcggcttgccggcacggaactgtcccggcgtctcggcgcggtcggcagtttgacatgaggattcgcgagatcatcgtgctgggctccttcgccccgatcacgattttctcaactaagttcaccgattcgctgaccggcaacgccaaactcgccggcttctcgctgacagtgacggccatcatcagcctggtggtgatgaccgccctgcacgcacttctgccgggagcgtaaggcgcgttcttgttctccgcctggacggttcccctcagagaggggaaccagaacgaatcacgcccgaacgattacgttgcgcagatcaccgatgccttcgacgtgcacgatggtctcgtcgccggggtcgaggtggccggaggcgttcggagtgccggtcatgatgacgtcgccaggcagcagcgtggagaacgacgaaatcgcggcaatctgctcggggatgccgtgaatcaggttcgcggtggtgccagacgccatcggcacatcctcgccgttcagcgtgaaggaaatcttggcgtccttccagttgaggtcgtcacgcatcacgatccacgggccgagcgggcaggaggtatcgaagcccttggcgcgcgtccacgtggggtcgatgccctgcagatcgcgcaacgtcacgtcgttgacgcaggtgaagccgagcacgtaatccatcgcgttttcaacggacacgttcttggcgatgcgtcccatcaccacggccacttccggctcgaagttcatgtccttggagcaggccgggtacacgatcggatcgtcggggccgattaccgaggtggacggcttggtgaagatcaccatgtcctccggcgcgtgggcgatttcggaatggccggcctcgtgcatgaactgggcgtgggcctcgtagttcttggccagaccgtaaaccttggaggggatcaccggggaaagcaggcggatgccgtcgccgtcgaccgggtaacgagtgccggtgggcttgacctggtcgccggccagcggatgaccgtcgagttcgatgaggtagtccttgccgtccgtttcgtccttttgtacgaaggcgtagcgcggcgaatcattcaaagaaaaacgtgcgagtctcatgcctgtaagcctactccttggcggttccttccgcagaagcatccgtccaaggagcaagcagaccggccttcaatcgaccaaaacgcacgttcgctgggattgctacttttcggtccaggttttgtcatacagcgactggccgctttgcgtgtgcatgatgacgcgcaatgatgccttgccgctggaggtcttgcacatcgagcccagcagattcgcggtggattgataggtgctgtccatagcatccagtgaggaagcgaaggtatcgcctagcgaggcgtagctgtcgtcgagcacgtactcgtacaccaaggtgtcaccgtcgacacggtagttgaaggtgatgccggtgtctgcaaacgtatccgcttcggattcaatggagtccttgaattccaaagagtcgacgaaatcctgaatcgaatcgtacagcccataatcgccgtcggttagatcgtcatgggtttcgcccaacgtgtcgtccagcacatcgtcaagattatcttgagctttgctcttatcgctgctatcaccgttgcccgaagaggactgactatagaaggaatcggttttcgcctcatctatagccttgctggcatacgaggcaccgccgacgatcagcgcgatgaccagtattacctgtatcaccatgcccgccgcactgatgatgatgccggcgatggccaagcccttgcccttgccgccctgtttcttaatctggttgaggcccacgatgctcaggatcagaccgaggagtgagacaaggaacgagcagataaaaccggcaatagccagaccgttgtacttctggttcgcttcaggcggcacactgccgtaagaaccagaccatcccggctggccgttcggttggccgccttgcatatacgggttatagggcgtttgcggaggcacggccccgccgcccggatataccggagcactgacgctgccgtagaccggaggaaccgatccgcctgccggagccgcccccggatagggcgaattgggtgctgccggtgcgggcgcaggcgcgggcgctgccggtgcgggcgcgggcgcagcggcaggagtcactggtggcaaagcctgcgtaggcggtaccggctgattggccggcgcaaaaggctgggtgggctgctcggcaggtgtaaacgcctgcgtaggctgttcaacaggagtgaacgcttgagtgggctgctcgcccgctgcgattgcttgggtcggagcattgttggcggcggttcccgtttccgccgtcatcgcatttaacggctcagtcggattggcgtcagcttgctgccacggcacctggccgttcggattgacattcggatcagtcatgacatgcactccttcaactgcatcgcaccccacttgcgagatgcgcccctcgtcttacgcgccacattgtgcgttacagacaactgtactcctcgtggcgagccttaagcaccccaggaaatttggcttccaaaaaacacaaaagcctgaaaccggctattgcctcagcaatattcagtcggtttcaggctcaatcgttaatcctctggcgaaacgacggtctacttcttcagcagcggtgcgacttgctcctcgtaagcggtcagggcggtgtcgatcacgttgtgcatgtcgtagtacttgtacgtgcccaggcgaccgccgaacacggtgttcggctcggccttggccttggcctcgtactgggcgtacagtgccttgtccgcatccgtgttgaccgggtagtacggctcgtcgccacgctcggcgaaacggctgtattcctcccacaccacggtcttgttcgggttctgggcatcgtggcgctccgggttgaagttcttgaattcgatggcgcgggtgtagggtacgtccgcgtcggagaagttcatcaccgggcagccgaagtggtcgccttcgtcgtagcggacctccttgaagtcgaccgtgcgccacttgaggtcgccgagctcatagtcgaagtaacggtccaccgggcccgtgtacaccaccggcacgcccgcggccttgagcgcggtcttgttgtacggctgggattcgtcgaagaagtcgacgccgagctccacggtgatgcgcgggtcgtcgatcatcttctccatccacgcggtgtagccgtcggcgggcaggccctcccacgtgtccttgaagtagcggttgtcgtagttgaagcgcacgggcaggcgcttgatgatggcggccggcagctcggacgggtcggtctgccactgcttgccggtgtagttcttgatgaacgcctcgtacagcgggcggccgatgagctggatgcctttgtcgttcaggttggccggatcggtgccggccagctcgcccgcctgctgttcaatcagggccttggcttcggccggcgtgtaatgcgcatggaagaactggttgatggtgcccaggttgatgggcagcgggtagacctcgccgtcatgcgtggcatacacgcggtgcacgtagttcgtgaagctcgtgaaacggttcacgtagtcccagacgcgcttgttggaggtgtggaacagatgcgcgccatacttgtggatttcggcgccggtctcctcgtccatatacgagtaggcgttgccgccgatgtgatcgcggatatcgatgatgtgcacgcgggcgccggtgtgctccaccgcctgctgcgccaccgtcaggccaaacaggcccgcgccgacaatgactaggtctgggtattgagtagtttccggcatgcgcgcattccctttcataaagtcaatatatcaattattatgttcgatttccgagaaaatatactatgattattcaccatcgcggcgaaacccgccactctcccaatagccagtccaggatgttaacttgcttgatgccggcgtggtctgatgtgacttgatttttgttccgcatttcctctcacttgataggagatgatggaatcatggcaaggggcatccgttacacgagggaattccaggagaaggcgctgcggcttctgggcgagtcacgcgcgaaccattcgtcggagacgaaggccttggcctcggtctcgcagagcctgggcatagccccggagaccctgcgccgttggcgcaacagggccgataggacggtcacggcgcaatccgcgcgcgatgcgcaggcggcggccgagctgaagaggctcagggcggaggtcgcggaactgcgcaaggcgaatgagatactgacgacggcgtcggcttttttcgcggccaggctcgacccgacacggcgttgaaggccgcgtgcatcgacgcgtaccgcggccgtttcgggggtcgggccgatctgccgggtgctgtcggccgggccggactgcggtttcctgaccgcccgcggctaccgcgccttcaagacggggcctctcagccgcatggcggcgcgccgcgaggcattggcgcgtgacatcacgtcgatccacggggacgagttcatgcgcgtgtacgggtaccgcaaggtgtggcgtcagctgctcgaccaaggctgggatcccttggaggccggccgagaccaggtcgcccgcatcatgcgcgaactcggtctgcggggcgttcggggcggccgcaggccggtcaccaccatccccgccagggggacgggcggcaggctcgacctggcggggcgcaagttcgccgcccgcgcgccgaaccggctgcacgtcgccgacatcacctacgtgcggctggcggacggctcgttcgcgtacgcggcgttcgtcaccgacgcatacgccagaagaattgtcggctgggccgtcgcctccacgatgcgcaccggggagctgccgctgcaggctgtgttttagcaagttggcgtccgctttgtgagcggtgtttttccgcagtgtaggcagcgggttttccgcagggtgtgcggtatcggccgctgcctgtctgcgttgtgttggttatttggtcatga

SEQ ID NO: 30 - DNA, 52822 bp, Bifidobacterium longum
cggcatgagcatcatggatcgtcgacgcgagctcggtcttgtggcatgattggtggtgatggaatcaacgacgagtccaacaaaacggcaccagccccaacacgaaacaccgacttgacgaaatacacatagcgtcgtttgcccgtggcggggtcgcggccgacctcacgccggaactcccacgagccatccttgcggtggatgatgcttcccgcacccttcgtgcgtcgtctgccgttcgtcgccatgatgttcctcccttgtcgggagcgccttcgagcatccgctacaagcgccctcaaaaagggcactctattggcacactatccgggccacaaacggccagatacggggcataatcggccattcttcaataatcgaaaaacggcgcaattccacagttccgaaaactcgaaaacgttggaatcacgccgttttctggggtgttcacaccctacttggacacattgaacttgaactccacaatatctccgtcggccatgacgtagtcgcggccctcctgacggagcttgccttcctccttgatcttggccatggagccgtcggcggccacgaaatcgtcgtaggagacgatgtcggccttgatgaagcccttttcgaagtcggtgtgaatcacgccggcggcctgcggggcggtccaacccttgtggatctgccaggcgcgcacttccttgacgcctgcggtcaggaaggtctgcaggccgaggatgtcgaagcccacgcgggccagctggtcgagaccggactcgctcaagccagcgtcggccagcatttcgcgggcatccgcctcgtcgagctcggtcaggtctgcctcgaactgagcgttgaggaacacggccggagccggagccacggatgcggcgagcttagcctgcaggtccttgttggccagctcgttgtcgtccacgttgaacacgtagatgaacggcttggcggtcatcagatgcaggtcgtagacggaatccttgtcgaagcggccttcgcgtgcggccttgtcgagcgtctcgccggcttcaaggatggtctttgcctgcttgactgcgtccatgtaggccggctcgatcttcttgccgcgcagatccttctccagcttgggcagcgcgttttcgatggtctgcaggtcggcgaggatcagctcagtgttgatggtgtcgatgtcgtcggccggatccaccttgccgttgacgtggacgatgtcgtcgtcctcgaaggcgcgcacgacctcgcagatcgcgtccgcctcgcggatgttggccaggaacttgttgcccaagccttcgccttcggaggcgcccttgacgatgccggcgatgtccacgaaggtcaccgtggccggcacgatcttctccgtgttgaccagcttggccagcacaggcagacgatcatccggaagcggcacgataccggtgttcggctcgatggtggcgaacgggtagttttcggccagcacgttgttgcgggtcagtgcgttgaacatggtggacttgccgacgttgggcagtccgacgattccgatagtaagagacatgattccaagtctagggagaagctggacaccttgaacctgcatgtggtgaaccggccatatgcaaaggcctccgagcatacggctcgaaggctttgactgtgatatgcgaatatacgcgaactctgattggcagtcagccgacgatggcatcgacggcgtcgatgaccgagccgcggaaaccgtccttttcgagctgggcgacgcccttgatggtggtgccgccgggcgagcacacggcgtccttcatggccccgggatgggtttcggtggccatgtagagcgcgccgacaccttcgaccatcttggcggcgagccggtaggcggtggctcgctgcagaccgtactgcacgccggcgtcgcccaaggcctcgatgtacatgtcagtgaaggcgggcgcgcagccggccaccaccatggcgatgttcatatgcgcggtgtccacgcgctcgatgaggctgatcggcccgaacagctgctcgaaggtttcggtttcgtcgtcggtcagggtgttgacggattcggtgacgagcacgcccttgcccacagccatcggagtgttcggaatggtgcactggatatggatgtccgaagagtcaacggattcgccgtcttcggtggcgaacaggtcctggtacttcttgagattccagccggcggcgatggagacgacgatcttgcccggcttagcaagttcgtcggccagcggcttgacaacggcggcaatctggtagggcttgatggcgatgatgaccacgtcagcggccgtcaccacttccagcgcattgtgcagcgggcgcacgccaagttcggcggtggtcttctcaagcttgtcgtagtgggcagcacaagcgaccatctggccgccggtgaccacgcccgcgtcaacgaagccctgggcgatggcctgggccatgttgccatatccgataaaaccgatggtgaggttctgagtcatacgttttcctttcgtgcatgtatacagagctccctcatcagagggagcttgcttccttgagtcagaacagttcttcgaggtcgcctcggttgagggcttcggtgtagaggtgcttgaagacgagcgagccgtgcagaccgtcatgctcgaattcgttggtggtccagtagtggctgttacccacgcggctcaaggtgtcgagctgcataccggaatcgacatacatgtcgtcgaagtaaacggcggcctgcagcggcacctcattgcgggccagctgttcttcgtcatagatcacgccgaagtgcgtgtcttccatgagcaggtccatggccggcctgaacgggcgtaacgcagactcctgttcgaacatccacgggaacatggcctcgccggtgaagttgagcgggcgttcatcagcaccgaattcgggcttgccatcgcgcacgcgctgggcggcccagcgaatcggctgttccatctcaccgttggcgtagatgaactcctgcagcggccagtacagcgggcgcgacgaagtggcgttcatcaccttggtcaaaaattcgtcagacaacggcgagtcggcagaagcggaaccatcgccatcaaggaaggcgtcgtcaagaatccaatggacacgctcgaagctcggcttcatgccaaagtcggatcccaagcactggaagcgttcgacggtgagcgggtcgccgttcggcatcagcgggaagccgtgggcggccatgccggcgatcacgccaagtcgatgctccacatcggtaccagccatcggattcagtaccgaatcggtgagtttgccaatgaattcggcgacttccgcagtagtcggcagcttgtcggcgatggcggccacgcgctccttgtcctgtgggtagcgctcgtagaactgagtcgtcttgcgcaccatgcgcgggaaggtatgctcgtacacttcagcggcgtcggccggcacgtgcgggatgccgccggtggtgaagctggcgattacgccggccgggaacagggacagtgtggtcagggtcaggaagccgccgtagctttggcccatcgtcacccacttgcggccaccgaattcggtcaggcgcagatgttcgaagtcacgcacgatggaatcggcaaggaacttcttcagatagtcggcttgggctcgtgcgccggccgcggcatcatcgtcgtgcgcggcggcgatgcgggccatggcgtgcgtgtccacacgcgaggagcggccggtgccgcgctgatcgggcagaatcacgcggaaatgcttggttgcctcctcaatccagccatcagaagtcgggctgttgaggcgagggccggcaccgccgggaccgccttgcaggaagatcagcaggggcaggtcgtcatgcacgtgttcgggcgtggtgaccacgcgatagaacagtttgatggtttccccgtcgaacgcccgcccgggctcgtggccggtccagtcgagcggaacatcgatggaatggtcctctatggccagtccgggcacatagtatttgctcagcattgtcatggttcaagactctagtccataaatcctcctgaagagtgataccggttcgtcgccggacacgctagcattgtgcgttatggagatgatggcgcgcgtgagggcatggtgcgcacgggagtcgacccgcacactgctatgggacacgttgctcgccgcggtgctgatcgccggttgtgtgccgttcaacggcgtcaccaaccctgattcgacgggcggcatattgtttcccgcaactcaggcgtcgatgacgctgtggtcgctgccggtcttcgtgccgctgatgctgcgcaggtattgcccggagccggcggcctggctgttcgtggcgctgaccatcacgcatcttgtgttcggcccggcgatcacgtatttcgatttctacgccctgatcatggtgtattcggtgattctgtacggcagtccccgacattcctggcggttcatcgtcacggcgttcgtcatgggactgatcacggcgacggtctggtcggtgtctttcaacgtgggtccgctgtttgccgaaccttcctccggttcgcgcaccatccgcgacggctggctggccgatgccatcacgatgcccacatgcccggcggtcaccggcgtcgtgggggcaagcgccgccgtcaactgcggggccaagatgctcgctgacgtcggcatggaggcggcgctcatcgaatcgagcgtgctgagcattatcatcatggccttgtggcagcgtgcgcgcaaggccacgctcacggccatgcgcgaacgcaatgcttccatcgtggcccgggaagcagaggagacgcatatcgcggcgctggccgagcgtgcgcgcattgcccgcgatatgcatgatgtggtggcccatacgctctccacgattattgtgcagtcggatggcggccgatatgcgggcgcgcatgatcttgccgtcgccaggcatacgatgagcacgattcgccatgaagcggaacgcgcgcagcgtgatatgcagcgtctgttcaatgtgttcggtgcgagtggcagtaccggatatgccgacatcgattcgctgtttgatggccatctggtggtgtcccggcatatgaccggcaaagcgcaacctgaccggctgtccgccgacgcggaaaccgccgtgttccgtcttgtgcaggaagcgctgaccaatacgcgcaaacatgcgggcgagggtgctaaagccaccatcgatgaattctggtcaaacgatgtgctgtcgattaccgtatccgataacggccgtggcgcggcgtctgcagcagacggtcataagcccggatacggattggttggtatgcacgaacgcattgagtcgttgggcggcagcgtgcaggccggcccagggccgaatggtggctttattgtggaggctacgattccgctctcctctgccgccccacagtctggcaccgatgcggaggatccggtgctaaccattatctcgcgtatacgaggattgatgaatcgggcgcgccccaaagtactcgaccaaggagatacgcgtgagtcgaactgggtgggtcgatttgcgcagtggaccgagcggcactatcttctgatggacgttatcgccactatcgtgctgattgcgctatttgattccgccacgtatggcgatttgcaaatgatcggcaatgccccgtattcgccgaaccgcgtgctgactatagcgctgacgattattatgctttcgcctttggcgttccgccgccgcttcccagagggcagcgcactggtcatggcgattctgtccgccgtgcagctgctgtttctgccatccatcctgaccgtcaacatgttcgcattggtgtccgtgcatgccgccgtgctgtatggccgcgaacatgcgtggcgctgggtcagcgtggcactggttgcggattcgtggctggccggcatcaagataatgtccggctggaacggctatgggatgctgattcagatgctgctgcccttcaacggcgaatcggcgatgtcccgctggctgctggtgctttccggtctgatgccgggtggcgtggtgatgctgtttggctttgcctgcattgcgatggcccggtggagccgttcacgcggttcgaacgcgctggtgctcatgcaacgcgaggaagcgctcaaggccgagcaggatcggcagaaggtgctggccgccaatctggagcgcaatcgcatcggcacggccatgcaggccgaggtattgaatacgttggaatcggtgatcacgcaagccgatgatgggctggccatgctgaactccgaaccggctcccgatagcgagcagatcatcgccgcgttcacggtcatcggggaacgcgggcgtgcggctctggcgcacatgcggcaattgctgacggtgctgcgtgaaaccggattcagcgacgagatgcatgaaggcgcacaacccgacatgcaactgcgaccggctgctcctctgtccagccagatgaggcaggcggaatccacatctcagacggattcgtccacgaacatgaactcagggaacaatcagggtgtccatggagcggcgctccgataggaaacggatacagtggagagcatgaacgagagcagaagcattcgcgtgattattgcggacgaccaggagctggtgcgtgccggttttgccatggtcattggttcgcagccggatatggaggtggtcgggcaggcacccgacggcgcccaagccgtggcgttggcggaatccctgcatcccgacgtggtgctgatggatgtgcgcatgcccagcatggatggcattgaggccacgagccgtattacctcgctctccgccgcgccgggcgacgcggccgattcggccagtctggccgccgacgcgaccgtctcggccgaatcggctgacgaccggccgacgcgcgtaatcattctgacgacgttcgatttggacgagtatgtgatggcggccatcaatgccggcgcctcgggcttcctgctcaaggacaccgaaccggaaacgttgctcaattcgattcgtactgtattccaaggcaatgcgattatcgcgccttccgccacgaagcgactcatcgaaaagatgatgcaggacggttacgcgcagcatggttcgttgggtggagaaaccacacactccggtgccgtgtacggttccgccggcggcgtctctggcggtgcggccggcaacggtgctggctcgatgaccggcttcccctcccctgccggagccgcttccgacggttccaatacgtcacgcccggcatacaccgatcccgaactggatctgcttaccgaccgcgaacgcgaggtgctggtggagatcgcccatggtctgagcaatcaggagatcgcggacaagctcttcatttctctgcccaccgtcaaaacccatgtggcacatattctggccaaaatcaacgcccgcgaccgcgtacaagccgtagtcttcgcgtacgataacgggctggtgtaacaaagctccctctgatgagggagcttattgccctacgcctcggccaaagcctcgacgggtggcgtcttgacggctcggcgggcgggagccacgctggccagcagagcggcgagcgcggcgacgccgagcaccacaccgttggtagcccattcgaacgggaacacggtgtcgccgtacaaactaaacaccatgtaggatccgagccagccgaacagggtacccagtaccactcccaccacgccggagacgagcgaaagcagcaacgcttccaccgccagcgagcgccgcagttggccgcgcgtcatgccgatggcacgcaaggtggcggattcgcgtgtgcgttcgatcaccgacagactcagcgtgttcgccacaccgaccaaggcgatgagcacagccaccgcaatcaaaccgaccaacaatgccatcatgccgttgatcatggtctcccattgagtacgttcggccaccggaccggtcacggtaacacccgcactggcggagaacacattctgcacgttggtgaatacgtcgttcaacgcaacacccgcgccttcggcgtcaatgcgcataagcatgatatgcccgtcggccttgatcccaccgttggtgaagtggctggcgtccacgaaggcgaccgcggcgtagttggaggcgatgcggcgatagtccaccttccgcggtttgagcgtcagcgtctgtgtgccgccggattgtccattgccgttttcggcgctgccgttcgcatcattgccggacggaccattggcggcatcggcttgtgcttcggccgctccagccgtgaacgtaacgctcttgtccagcggaatatccttgcctgtagcggcggaatacttgggcatcagtacggaatcgccatcaatggtcacaccggacaaatcggagcgcaccaccttgcgcagcgcgtcgacgccatccacgcccacgaccagcacactcaggctcttgccgtcggcatccttcatggtcatcatgcgggtcggcgcgtagataccgcgctgaacgcccttgactttggctgcctcgctggcctgtttaccagtcatatcggtgccagcggcaatcatgtcgacgctgtagcgcgtggtcagcgcctcgttcatggtttgcttggcgctggcggcaccggtggcgatggtggagaccagcgtcacgccgataagcagtgcggcaccggtggcggccacgcggcgcgggttcttctgaatgttcgcatgtgccactttggcggacggaccggccagtgcaaccatcgcgcccacgccgcgcatgagcaccggtagccagaacgtggcggaaagcaccagtccaaggaagatcaatgcacatccgatgatggcggcgagcagcaccagcggatactgcttgtcggccattgaatcacgtccggcgatgttctcggacatctgccatacagagaatgcgcacagtgccacgccggccacaatcagcagcacggaaatcacggcgcggaccacaccggcccgtcgcgtgtcggtcagttcgatgggtcgcaacgcttccagcggggtgacggcggtagcggaacgcgcagagcctagcgaggcaatcaccgtcataatgatgccgaatgccataggcaccgtgaacaccggaccggatagcaccagtcgcatggtcatgccggtggctttcatcaggcccgactggcatagtgcggccatgagtccgatgcccaggcccactcccagtgcggaggcgatcagtcccagcacaccggcttcaaacagcacggagacatacagctggcttttgttcgcgccgatggtgcgcagcagggcgagtgtgcggcggcgctgtgccacgagcacttggaaggtgttggcgatgacgagtgccgcgaccagcatggcaagtatgccgaagctcagcaggaagatggtggtgatgctggtttcgcccgagctcatgcttttgacggattcctcgacgagcgcggcacgggattgcacgctgaaatgcttagggagcagtgtgctgacctgtttcacggtggatgccgcagccgtgtcactggcatcgtcgatatcgagatagacgaggtagacaggcaggttgccgaaatcgttgctgccggccatcgcggtaataacgttgtcggaaagcacggaagcgccaccgtagtaggcgtaggcaccgttcgggtcgtcggtaaggcctaccacgcgcacggtcatgccggagtcggcagtgttggcgccatcggatgagacggacgcaccggacgcggcatcggaatcaccgtcgtgcgagctcgtgccatcggcgttctgggccgactcatcaccagcgtcaccggtattaccggccgaatcgccggtcttgcccgcatactgcgccgcctgcgagttgacggtcacacggtcccctaccttgacgccaagctggtcggctacggacttggtcagggcaatctcgttgctgtccgccggctggtctccttgcgtgatggtgaccggcagcagcgtacgttttgcggcggtggtgatgacgtagctgctggcatgcttgttgccacgggttacggtcacggaacccgcgtagctggcgcgcgcgtccttgacgccttcggtggcgcggatgcggtcaagctggaagtcgttaaccgtgcgcgtgtagatgtagtcctggtccttatcggtcaggtccttgccgctatccgggctgatcacgtagttcgcgccgccgagctgggcggtgttctgagcggcaagcgcatcgttcatcgcgttgccgaacaggaaggtagcggcgatgaacgcagtgccgatcaggatggcgatgcctgccggaatcagcatcctggcgcttttcttcatgagtttcagagtgatggaaaacatgggggtgtcctgtctctcgctttccggctcagcgagcgtgctgggcggcggcgcgggcatggcgcatggtgccggttctcccagctgggggcaatggagcgtcggtgatgggcaggttgggcacatcctttacaccggcaagacgggcgagcgtgtcggcgcgtgtgctggtgacggcagtgcgcgtggcgcgttcgcgttcggccataagcagctcgttcatcgtttcggcagtgggattcgcctcgtcggccacgatctgtccgtcggcgaatacgatggcacggtcggcgtaggaggcggccaccgcatcgtgcgtgaccatgacgatggtttggccaagctcgttgaccgaacgcttcaggaagccaagcacttcggcgctggaaacggagtcgaggttgccggtcggctcatcagcgaacaccagcttcggcttggtaatcagcgcgcgggcgatggccacgcgctgctgctggccaccggacagttcattcggtcggtggttcaggcgctgcttcagtcccagggtatcgacgagcaggtcgaaccaggcgtggtcgggcttgtctccggcgagagtcagtggcatgaggatgttctgttcggcggtgaacatgggcaacaggttgaagctttggaagatgaagccgatcttgtggcgacgtagcaaggtgagctgcttgtcgtccatgcgggtcaggtctgccccgccgaaaagaatatgcccggatgtggcggagtcgaggccggcgagcgtgtgcataagcgtggatttgccggagccggacgggcccatgatggcggtgaatttgccgcgttcgaaactcacgttcacgccgcgcagggcatggaccatattgctgccagcgccgtagttcttgaccaagtcgacggcctgaatagcgatgccgcgcgatgcggccgggttctgcacgttcataatgtctctccatatttggccgggccttatgcccggatgatgattccaacttatgaagaaataacggcgcgccccatcgtgcgccagactgaattgggcggtcggccacgcgccggccctcatccttgaggattatgtcgtctcaggtctcacactattcatgcctctgcgcaaacagtgtgaggcatacagacgcaagaaagcccgcactgcatgacatcagtgcgagctttctattccttgggtcaagcgatcaggcggaaggcaccccatgcggctcgatgattcgtgatgcaccccattagcatcgcgccccttctcatcgggccgtcaaccttcctgtcgacctcacttggccaagccggaagcgcgaagggcttcgaagccgcccttcaggtcatcgaggatgtcctcgatgttctcggtgccgatggacaggcggatggtgccttggtggatgccctgatcctcgagctcctccactgtctcctgggagtgcgtggtggaggccgggtgaatcacgaggctcttggcgtcggccacgttggccaacaggctgaacaggtgcaggttgtcgatgaacacgcgtgccgcgtccttgccgcccttgatgtcgaaggtgaagatggagccgccgccattcgggaagtacttcttgtacagctcgttgtccttgcggccttcgatggacgggtgggagatggactcgacttccggaacggtcttcaggtaatcgatgaccttcagcgcgttctggacgtggcgttcgacgcgcagggacagggtttcggtgccctgcagcagcaggaaggccgcgaacggggacagggtggcgccggtgtcgcgcagcaggatggcgcgcacgcgggtcacgaaggcggcgccgccgagggcctcatagaagttcaggccatggtaggacggatccggctcggtcagggtcgggaacttgcccggcacttcggcccagttgaacttgccgccttccacgatcacgccgccgagggtggtgccgtggccgccgatgaacttggtggcggattccacaacgacgtcggcgccgtgctccagcgggcggaacaggtacggggaggcgaaggtgttgtccacgatcaccggcaggtggtgcttgtgggcgatggcggtgatggcctcgaagtcgggcaggtcggcgttcgggttgccgaaggtctcgaagtagacgagcttggtgttctcctggatggcgtcctcgaactcctgcgggttctcggcggagacgaaggtggtggtgatgccgtcgcgcggcagggtgtggcgcagcaggttgaaggtgccgccgtacacgttcttggctgcgacgatgtggtcgccggactgggtgatgttgcgcaccgcgtattccacggcggccgcgccggacgcgacggccaggcctgcggtgccgccttcgagggccgcgatgcggtcttcgaacacgccctgggtggagttggtcagacggccgtagatgttgcccgggtccgccagtccgaagcgggcctcggcgtggtcgaagttgtggaagacgtaggaggtggtctggtagatcggcaccgcgcgggagtcggtggccgggtcggcctgctcctggccgacgtgcagctgcagggtttcaaaacggtacttcttgttgttctcggccatggtattctccttggttgtgctaggtcgcgaggatttttccttgccacccgcctgccgtgttcgggcggttggcgaggtgttggttatgaagttacgacgcttgggccgcgcggcgcaagctgaacgttatcggacttgcctataagggcttataaagccttggaatcattgacgtgagcgactgtcagaagtcacgaaaaagtcgttgaaattatcgcgacacgccgggccgcacgcatgcgctttcaaggtcgactgcggtcacggtgatatcgctgccatgcctttcgcgcatggctcaagtgtccgtgatgattgcttgttccacccgtcaccaagacggtttgcccgctcggtgatgacgtctgtttcattttcctgccgcccggttacatggtttacatgacgaacgactacagtcaaacatcgccaatgaattattccgccaacatggtgaagggattcgaacagacatgaccgatgtaactctgtatgaccgtgatccgaactatattccgcgcgtggccgccgtgcacgacatgtgcggctacggcaagtgctcgctgaccgccgcgattccgattctctcggccgccggctgcgatgtgtgcccggtgccgaccgccctgttctcggcgcacacacgctatgcagtgttcacgttccatgacaccacggatattctctccggttacttggatgcctggcagaaggaagacgtggagctggatggcgtgtattcaggcttcctcggctcccccgatcaggtggcgatcattcagcgtctctaccgcgaatatccgaacgcgctgcgtctggttgacccggtgatgggagacgccggcgaaatgtaccccacgtacacaccggagctgtgcgaggcaatgggcgcgctggccgatggtgccgacgtgttgatgccgaacctcaccgaagcgagcattctcaccaagcgtgactatcctggccaggatattgatgaggccacggttaacgagctgcttggtgctctgctggagttgggtgccaagaacgtggtgctgaagggcattgaccatggcgatggcaaaatcgtcaactatgtggccagcgcttccaccggtgttgccggcaagatcgagctggctcatgagaagttgccatacatgattcatggcacgggtgacgccttcgcctctgccctgtgcggcgcggtgatggccggccgcggcctggccgagtcggccgaaatcgccggtgagttcgtgcgtcacgccatggtcagcacccgtaaccagccgcatttcgaggatcgtggcgtcagtttcgaactgaaccttggcgaactcaccgatttggtgaagtgaccgcaccttggctcccctctccgctcactgggtctgacgtattcagcgaacaatccgatgggttgttttttcgtcacagggaagtcgactggtgagccttggtaaaccttctgaactaatggtggataaccgagttttcatccacacgttatccacaacacgccaaaccgcgtcatagtatccacatttgccggttgcgcttgtgctcttacataagtaacccgcacagtggaatcatgaacgctttaccacctactcagccgacgacgaagtccggcatcgacgccggtcttgcctttcaccagcccatgctggcttcacctgatccgcaggcaatgctgccttcggaacggattgcggccacgatgggcgaccgcaatctgacgcccaaacagttcggcgcgctcggcgagcagtatgccgccgcgtggctggaggaacacggttggacgaccttgagccgcaattggcatacccgttacggcgaattggacatcgtgatgctcaatcccgagtacacggtggtgttcgtcgaagtgaaatcacgccggtccatgcattacggatatccgcaagaggccattacgccggcgaaacagcacaatctcaggaaagccgcctgcgattggctacttgaccggcgtaatcgggtgccgcattcggcggtccgtttcgatgtcgtcaccatcgtgcttcgggtgggcaggccgctcgtgcatcacattgaaaatgccttctgaagcccccccccccaaaaaaaacagccacgttgcgaaacacattgtgaaaggagtagacatggctatcggcagcaccctctcagtcggactgatcggccttaaggccttcatcgtccaagtgcaggctttcatcagccctggcttgccatacttcagcatcatcggattgccggatgcatcgttgtccgaagcccgcgagcgcgtgaaatcagcgtgtcaagccactggattcggttggccgcaaacccgtgtgaccgtgaacatgagccctgcggccatgcccaaacgcggttcgtcgcatgatctggccatcgcggccagcgtcctatgtgcggcgggtgccatagggcatgattgcctagaagataccattgtgctcggcgaagtgaatcttgacggctcggtgctgccgattcatgggctgctcccgatcatgctgcatgccgaggaacgtggcgtgcgcaaaatgattgttccccatcgcaatcttgacgaggcttcgatggtggatggactggatgtagtgggcgtgaggcatgtgggtgagctcatcgaactgatgggcggcgatgccacctatacgattcccgatacaccggttaccgacgagaccaccacggatcaatcgcccacaagtcatcccaacgattgtggcgatatgaacgaggttctgggtcaggagcatgccaaatgggcactgcaagtggcggcggcaggcgggcataatctcatcatgaccggcccgccaggcagcggcaaaaccatgttggcctcacgtatgcccggcatcatgtgcccgttgaacgaggcggaacagctggaggtggcatcgattcgatcgctgtgcggcatactgcctcagtacggcatcaccgacatgccgccgttcgaggcaccgcaccacaccgccagcacggcggccttggtgggtggtggcagcggcatcgccgttcccggcgcaatcacacgcgcgcatcgaggcattctgtttctggacgaggcaccggaattcagcgcacgcgccctgcagacgttgcgcgaaccattggaatccgggtatgtggcgctttcccgttcaaaaggcagcacctactacccggcctcattccaactcatcatggcggccaacccctgtccgtgcggatactattacggcaccggcgaacgttgcgcttgccgggaaaaagaccgtatacgttatttctcgcgattgtccggaccgatactggatcgtgtggatattcagatggcggtgccaccagtctcgcgcattgccgcgcaaagcgagccaatcggcgagtccagtgccgggatacaagctcgtgtgattcgtgcccgtcaagtggccaaagaccggttcagacagtatggatgggtgtgcaacgcgcaagcttcgggcaaatggctgcacgccaatacatcgctgaaagcgatggaattggtcaatcgggccctgtccaatcatcaactcacattgcgcggggctgatcgcgccatgcgtctgtcttggacgctcgccgatctggccggccgcgtatcccccactgaacaggacgtccatcagggcatcgaaatgagaacgaggatgacatgagtaacgctactgatatccggcaatctggcggcaccgcaggaagtgtggatcacaccgatacgagtctcgccgtttcgcgcactattcccgtacctcccacggatacgttgtatcgtgccgcgctcacgttctgtcttgatggcgcggatgtgatgatgtacgccacgctcaaaggcgcggaaaacgccgaatccctctggcatgcgttggcgcaatcccatccaagccagccatctgaaatctgcggcccggcgctgtcacgtattgaccgcatgttcgtggacggcctcactcgatggggccgcaaggcgtcggcgaacgcgatgcgctccttccgcaatgcactggcctgctggcataaccgcatgatggacctgccctcgcaagacatcatccaactggccgactggttcactatggatggcacgcaatggattatcggccctggccatccatgttggccctcgcagttggccgacctgtccattcgctccgattgggcgccaccgctgtgtttgtggatcaaaggcgatccacgcgcattgaccagttgcgccaaaccggtcggcatcgtcggttcacgggacgtgaccgaatatggccggtatgtggcacacaccgtagccgaacaggcagccgttgccgggcatctggtcgtgtccggaggcgcgatgggcacggatgcggcggcacattggggagcgttgaatgcgctgcacggcagaatgcccgccaatgtgggcaaaaccgttgccgtattcgccggcgggctcaaccatatcggaccgatgcgtaaccgcacgctgttcgaacgcatcgaggcgcagggtggtgcactgatcagtgaactgtgccccgggacgattcccgaagcccgtcgttttctgcttcgcaaccgcattatcgcggccatgtcttccacattgattgtgacgcaagcccggttgcgttccggagcgctcaacaccgcgggatgggcatgcgaattgctgcgcgaagtgtatgcggttcccggtgacatcaatcagccttgcaacgccgggtgcaataagatgatcggcgaccaccgagcgatgattctgtgtgccgccacatccaccgaggatatatgccatgaacggcataagcccgttatggcagcatgcccaggcatatcgaaatccacaggtcaggactcgtccgaaaacgaggaggccatggaagtgccggcaacgactccgttatcgccagcatcctcggaatcatcggtgtcacaggagtcgtcacaagattcaggtcattcgaaacgttcgaagaccaagcatactcagcctacgcgcactcaatccaaggatgggccggcgagcgcaactgccgattccggtaacgacaaaagcaagggtgaagagcttccctcgtcgcatcagatgccggatcttcgtgtcaagccgaagcccgatcccgagaaggaagcccaacaacgtatcatcatcgccaagctgccggaaatggaacgcacattagtggcattgattcgtgaatgccgtaaacgacatctcatcgtcaccccggacgcactattgcgtgtggcgcgagagacggtacccgacgagattcccaatatcggcaccatacttgagctactcggcgcattggagctgaagggagtgatcgagcgggatgccggcatactcaagctgagcagccgtgtcggctaatcggcttccatgacacggctcgaaggctgttcggcgggtgtgcgagaatcgaacccatgagtccgaaacgtttggaagatatgtatgatgcggtgatcgtcggcgccggagcggccggcctgtcggcggcgttgggactgctgcgctcccccgagatcaccgagctcaaggaacaaggcgtggacccgaagatcctcgtggtctccaaactgcagccgctgcgttcgcacaccggttcagccgagggcggcatcgccgcgagcctgggcaatgtggagtccgatgactggcactggcattactacgacaccatcaagggcggcgactggctggtggaccaggatgcggccaaactgctcgccgaatacgcgccgcagaccgtgatcaacctggagcgtcagggcgtggccttctcccgtaccgaggacgggcatatcgcccagcgccggttcggcggccacacgcgcgagttcggcggcgccccggtcaagcgcgccgcctatgcggccgaccgcatcggccaccagattctgcacgccttgtggcagcagtgcgtggccgccggcgtcgagttcgccgaggaatggtatgtgaccgacctggtgctcgccgacgacggcaagcaggcggccggcatcgtggcctttgacacgcattcgggcaagattcaggccatccacgcgcgcaacgtgctgcttgccaccggtggcgcgggccgactgttccacaccacgtcaaattcctgggatctgaccggcgacggcatggccttgaccttggccgccggtctgcagctggaggacatcgaatttgtgcagttccaccccaccgggctcgcgcacaccggcatcctgctgtccgaggcggcccgcgccgagggcggcattctgaggaacgccgacggtgagccgtttatggaacgctacgctccggagcataaggatctggccgcacgagacgtggtctcccgctccatcatggcggagatcgacgccggtcgcggcgtcgccgacccgaaggacccggatggtccgaaggactgcgtctggctggatatgaccggcatcgaccccgaacgtatgaaggaagtgctgccgcaggtggtcgaaaccatcgagcagtacgcgaacctcgatccggccaaggacctagtacccatcaagcccactgcacactacacgatgggcggcatccccatcaccaccgacggcgaggtgtaccgttgggccgacggtgccgtgcaggtagtcgatggactgttcgccgctggcgaatgctcttgtgtctccgtacatggtgcgaatcgtctgggcggcaattctctgctcgacgcctgcctgttcggcacacgcgctggtcagacgatggccgcacgcatcgccgagaacccggttgactcccccatggccgatgattcggccgatgacatgctgaccgatgccgccgatcaggctgccgattctcgcaaagcggagcttgacgaactgctcgccgggccaatagatgattcagacgatggagtgcccaccgccaatccttatcagctcatggcccaactcggatcagtgatggagcaggctctggccgtacgttgcaccgctcagaccatcgatacggcgttgacccagatcaacggtgacatcacaccggttgccgataccttgcgggcccatgacaagaccgccgctttcaatcaggaggtcaccgccatctgggaagtccgtcatctgatcgaactggccgaggtcatgctgcacgcttccgaatcccgtcaggaatctcgcggatccatgcaacgccttgatttccccgaacgcgacgatgagcatttccttgctcactcgatggtcgccgatgatggttcggtaagtttcaagccggtgcacatcaccgactatccgcccaagaagcgcgagtactgatccgctggtggtaatacccaagccgcctagggcttgtggcacaataggttggctaatattggacttgacatcccactgtttcatggaggcagaacatggctgaggcgagcaacacgacggttaccctgcaagtgcatcgtttcacgccgcgacccgagcgtgccgaacgtgcacgcggtggcagcccgtttgccaagaaaggctccccgttcggcggcggctcggattcggcggcgcgccgtcgtccgcgcggcaagcagtgggtgcaggagtacacgattcccgcgcgcccttcggatactgtgttggattgtctgctgaccatcaaacgcaccgtcgacccgacgctggccttccgttattcgtgcggtcatggcatgtgcggttcggacgccgtggccatcaacggcacccccaccctgctgtgcacagccaccatccgcgattgggccaagcaacccggcgccatgcccgaagtcgatgacgaagggttccgacacaccggcaccgaggctgaggaatccgacgattccgcggaaaacgtcgcaaacgcggcggccgcccagaactcagccgcaaacggttcgctgggagtcatcgaactggcgtccctgcccggcttcccgccgcagcgcgacctcatcgccgacatcgcccctatgctcaaccagatcaggaagctcaccccgtatcttcaggcggacggcgtgctcgccaccaccgccgaaggcaaggtggacgtgttcgaatacctgcagaaccccgaacaactcgccaaatacgagctgctgagcaactgcatcgcctgcggcgtgtgcgaaggcgcctgcccggtgtacgccggcggcgacgccttcatcggcccggccgcgctgatttgggcctcccgtttcgtcaacgattcgcgcgacaccaaggccatggagcgtatggatgccatcgacaccgccgacggcgtggccgcctgccagtccgtgcgcgcctgctcccgccactgcccgcgcggcatcgatgtgggcgaggagatgtggcagatcgtggctaaggtccgcgagcgctaagccgcgccgcggctggctgcggcgatcgcctaagcacatgcgtcgatgcatccgctgggtgcccgcacgagagaagacatgaaagaacgaattatggacagaacgcagtacaccaacctcgccaaggcatgggaattcaccgaggaacacgcgcgcgaacgtgaatccgatgcgttgaccgacacccgtacggccgccgacgagtccggccagttgcagggttcggcggcgcaggcccgtctgctgggcatgctggtgcgcatcaccggcgccgcttcggtgattgccgtgggcaccggctcgctggtggagaccttgcagctcgcccatgcactggataacaagggcctgctgactgcggtcgattccaccgcccagggcatcgcgctgattcgcaaggcgttcgccgagctgcaggacgagaccgacaccacgttgcgtgcggtgaacgccccggccagcgtgtttctgccgcgcctcaacgccaatgattacgatctgatcgtggtggcgggcgacgccgagaactatgccgccacgttcgcccaggcctcccgtctgctgcgcgtgcacggcgtgatcgtgttcaccgatgtgctggcgttggaggacggtcagggcggcgtgatcaatccggccgaccgcagcgacaaggccatcgccatgcgtgagctgctcaccaccgtcgaagatgacgaaggtttcgagtccacgctcacccctgacggcaccggcctgctcatcgcctacaaaaagtaactctgtccttggctcccctcggagaggggagccactctatctcgcttacctcacaattgcgctgacggccacgtccacggcttcgtcggcgtcatcggttacggtgaccagtttcgggtcgatcgtcgagatcatgccatgctcggccaccggaccgttgagccagtcaaagagcccctgccagtattccttgccgtagagcaccaccggaatattcgccaccttgtgggtctgaaccaaggtcaataattcgaacatctcatccagtgtgccgaagcctcccgggcatacgatcacgccggaggaatacttgatgaacatggtttttcgcacaaagaagtaccggaagctcatgccgaggttcacccactggttcaacccctgctcgtgcggcaattcgatgccaagtcccaccgatttgccgccggccagtgccgctcccctattcgcggcttccatgatgccgggaccaccgccggtgatgacggcgatgttgcgcttggctatctggctacccatgcgccgtgctgccttatagatcgattcggtgcgctgggtgcgtgcggagccgaaaatagagaccgcaggtccgagctcggcgagcgccccgaaaccgtccacgaattccgattggatgcgcagcacacgccatgggtccatgtgcagccagtcggtgtcctgatcgggtttcagcaggttggcggtggtgttgtccgagggaatcatctggccgcgtagaatcaccgggccgcgatgataggtatcgcccagcggcgaggcgtcctccagatcgaccgggttcaccggtgtggccgcagcctcagttgccgtctcagcctccaacgccgccgcatcattcgcggctgtggcttccaatggttccatatcgtccacgactgcggacttggatgcggcctcggctagattctttgcttcagcggcctttttgccgtcgttcttcttggatttcttctgcttctttgccatccaatgtcctcctgtacggcgctatcgactcttcgcattctagcgcctgaagctctgcgtacgttttccgcgaaatcatccttgacttcgtgaagaacgtacggtgagtgacactgagcgtacgttttccgcgaaataaggcctcatctcgtgaagaacgtacactgagcgcgtctcagcgtacggttttcacgaaacaaggccaacaatggagtagggaccgtctaagccatcagtggcggaagtcgatttccacactggcggtgccgtcggcgagggtgccggggtgttccgtgggcgtggtgggctctgtggtgtggcttggctgcccgatgccatcaccatcaatcgattcgtcatcctccgcatcagccgctgctgcggctgcggtcttctcgaatcgcttggactgacggctcagcagcacaccggaaatcgcggcggcgatcagggaggccaccagcacgccgaagcgcgcctcagcggaaagttccgcgttcttgtacgccagcgaagcgatgaggaaggacacagtgaagccaatgccgcaggcgacggcagcgggaatcatgtcgcgcacacgcagccccttggccatcttgagcccgcccacatgcgtggacagccatgcggtggtgatgatacccagaggtttgccgaccaccaaagccacaatcagtgcgatgaccagcggcgaggccaacaatagcgggctcatcgactcgaagtgtacgccggtggcgaacaaggcgaagatgggcagggccagcagtgcggagaatggctggagcttgttggcatagcgttcggcacgcggcgagagttcgccgtgcatttcacgagagggggtcagcaggccaaccagcacgccggccagtgtggggtgcacgcctgcctcgaacatcatgatccaagcgaggataccgacgatgccaaccgcgatccacggcacttttttcagtcgtacgaggtatgcccagatggcggcgcatacggcgatgccgatgaaccaataccaggcgttaatcgaggagaagaatacggcgatcagaataatggccagcaggtcgtcgacggtggcaagcgtcatcaggaacgcgcggatcgaaccgggcagggccttggcgaacagggcgagcacggccagcgagaacgcgatatccgtggcggtgggcactgcccagccgtgcgacatctccgagaacgggatgctgctgccggtggtggtcagaatcagcgtgccgggttcaccaggcccgatctgagagaacaatgccgtgacggccaggaacaggatgggcggggcgatcatgccgcccaccgcgcacagcatcggcacggcggccgctttcggattggcaagcgagccggtggtgagttcctgcttcagttcgaggcccacggtcaggaagaagatggtaagcagaccatcctgggcccagtggccaataggcaggtcgagattggtgtaggggatgaacagatgcgtttccgctacggtctcgaacgcatgcgcggtggcgggcagattcgcgagcaccaggccggtgagcgcgaagccaagcatgatgagtccggaaatacggtctgaggcggcgattcgcctgatggtggaccaaagtcccttcttcgcgccggcggtcgtggccatcgcgtctccttgctgcactctcttggatgaaccgtatgtaatagtacggaatatctcaggacgttccgctccgggctgagtcgcgaagggcaaccttagcccaaccctgtgtggccgactcaaccgactcaaacgggccaatacaattggaaaagcctcggaagcatttcgctttcgaggcttactgtgcgccagacaggattcgaacctgcgacctgctgatccgtagtcagctgctctaatccgctgggctactggcgcataccactgttgtccccgtggttcgggagtgcgccagacaggattcgaacctgcgacctgctgatccgtagtcagctgctctaatccgctgggctactggcgcatgttgtctttcagacaactcgatatataatacacgccgttcagctgaatgcaactcggcgtgttgcggcgagtcgcaccatcccgaccactaccgcaacggcgtatttactggcctcacgcctcgtgtgtacggactcggtcaagcaaaaccgactacgcaactttgagacgtccctgcggcacatccacggcttcgcgcaggagtttgggcgtgctggaaccctctacggacgccttgtccacaatcacctgcctcacatcatccaaactcggcaactggaacatcgtgtcctgcaacgtacgttcgataatcgaacgcaacccgcgtgcgccggtcccctgcttgatagcgatatcagcaatcgcccgaatggcctgttctgtgaattgcaggtcgacgccgtcgacggcaaatagtttacggtactgcttgatcagcgcgttggctggctgggtgagaatcgccgtcagatcgtctacggtaagttccttcagcacactggtgaccggcaaacgtccgatgaactcaggcaacagtccgaactcggccagatcatcggcattgacctgttcgagcaattcctcgtctttcatgtcggcgtcgtgccaattcgcgccgaagccggtctctcgacggcctaatcgcttgcgaacaatgtccgtcagccccacgaacgcaccgccgcagatgaataggatgccgcgtgtgtccatctgcgcaacgtcttgctccttatgcttgcgcgtgccctccaacggcacggaggcgatggttccttccaagatcttcagcaacgcctgctgaacgccctcaccggacacgtcacgggtgatggaggtgttctcaccggatttgcgggcgatcttatcgatttcgtcaatgtaaatgatgccgtgctgggctcggcttacgtcgccatccgcagcttggaggagacgttggagcacggtttccacatcgtcgcctacatagccggcttcggtcagggtggtggcgtcggtgatgacgaacggcacgttcattacgcgggccaacgcctgcgcaagataggttttgcccacgccggtggggccgagcaacagaatgtttgacttggcgacctcgacgtcagccaaagggtcattgctgcggcgggcagcacgcgtctgggtgggaacggattgcttggcttgtttgccggtctggccactgtgcccgttattcccgtcaagctgctcagcggactcctgaagctccatgttgacgcgcttgtaatggttgtatacggctacggataatgcgcgcttggcgttctcctgaccgatgacgtagcggttgagataatcgaagatctgagcgggcttgggcaggctcagcgaattgacctcggcatctttgacacgctcctcggagatgatgtccacgcacagggcgatgcattcatcgcagatggaggcattgggaccggccaccagttttcgtacctgatgttcggttttgccgcagaacgtgcaacggggtacgtcctcgttgtagctcaccacacgtcccatgattctcctttgccgactgcgccgcaccgtcgaaccgccactctgcgcattatcattgtcatccttgaaatacaatacccccggtcgttgccgaccgagggtattgcaatgtccggaagttttactggcggtgttccaacacctcgtccacgatgccgtattccttggcttcaggagcggtcaggaaagtgtccacttcgatgtcgcggcgaatcttctcgacgtcctggccggtgtgcttggcgagggtctcctccagccattcacgcatacgcagcatttccttggcctgaatctcgatctccgtggccttgccgaagccttggtcgatggccggctggtggatgagcacacgggcgttcggcagcatcaggcgcttgcccttggtgccggaggccagcagaatggcggcggcggaggcggcctggccgaggcacacggtctgcacgtcgggcttgatgtactgcatggtgtcgtagatggcggtcatggccgtcatcgaaccgccgggtgagttgatgtacatcatcacgtcacggttcggatcttgggattcgaggaccagcagctgggccatcacgtcgtcggcggaggcgtcgtccacctgcacgccgaggaagatgatgcgatcctcgaacaggcgggagtaggcgtcctgggtcttcatgccatacggggtcttctccacgaactgcggcatgatgtaacggttggtcggcgcgggctgggctgcgcgggcggaggccggcatgaaaccggctacgccctgacggccggccaagcggtcggcacgggcggcgaactttgcttcttcacttgccatgagtctcactccccctgctggttgttgccgatggtgtccggcgtggtcacgagcttgtccacgaagccatagtcgagggcttcctgggcggtgaaccagtggtcgtattcgttgtcgcggtagatttcctcgagggtgtggccggtctgctcagcggtcagctcgctcatggtcttcttcatgtccatgatgagctcggcgttgatgcgcacgtcagtggcggtgccgccgatgccgccggaaggctggtgcatgagcacacgggcgtgcgaggtcaggtaacgcttgcccttggtaccggagctcagcaggaattggcccatggaagcacacatgcccaggcccacggtcgccacgtcaggctcgatgagctgcatggtgtcgtagatggccatgccggcggtgatggagccgcccggcgagttgatgtacagccagatgtccttcttcgggtcttcggcggccagcatcagcagctgagcgcagatgcggttggccatatcgtccttgacctcttcacccatccagatgatgcggtctttgagcagacggttgaaaatcgggtcgacggggccggccgggacgtcatcgcccgccatgaccggcaaggtcgcaaaggtattgctcaccttgattctccttctaattactcgaacattgttcagactaccgccttgaagcgactgaaggcggcttttcgcgtgctttttggcgggcagcgtagggatttcggtttattcgagggtgtcgaggacgtcgtcaatgaggaggcgggtctgggaggcggcatcgtcgcccagacgcgggaagcgacgggcggcattggcggggctggcaccggcggctcgcgctacgttggacttgctggcaccatgggccacggctttttccgcgagccgatcgaccagtgaatcggcgacttggcgcatctgttcggccacccataattgggccatatccgcaggtaagtcgtagtcttcggccacatcgctggctgcctcctgaatggcggcccataacaccatgaatggctttcgatagtagtcaatctgctcagtgagcggctcagcggcaagcaattcaagtgccgagcgaatttctgtattttctgacatagctttctttacctcggctcccctctctgaggggagctgtcgccataggcggctgaggggagtttcgaccggggcagctcccctcagagaggggagccagaatatatgtatttacttacgactcagcaaccactttgatatcaacgacgacgtggccacggccatgccgaccggcacaaagaaggtaatcggcgcttcagagagctccatcaccaagcacatggccataagcggtgcctgttgtgaggccgaaagcaacgaagccgcaccgatcaaggcacacgcggttaccgaatcggtcggaaacatcagtatccatacgaggccgagcatcgcacccagcgtggaacctaatgcgatgccgggctgcagcacaccgcccgacgcaccggagcgaatggtcatcagcgtcaccagcgctttggcaacaaaggtgagtgccaacacacccagcaacatccagatattggactgggacagcgggaaaccggcgttcatcacggatccagaagggccgctcccaccctgaagcatggcccagaacgatgccattccagagcccgctcccccgccagaggccgaatcggatacattaccgccgcccgtcagcaagttccatggagaggcggccgctgaagatgccgactgcatggcaccagcagtgccggcggtttcaggaatgaatgtgctgaatccaagttgcgctgcggcacggccgttgcccatcacctgcggcacaacagtcgccaccaaaccggtgatgagaccagccagcggcatctgccacagaatagccttaccggttggcttgtgcgcttccgcccattgcgaaccttttcggaacaatgcgccgcccactccacatgccgcaccgcagatcagagcgaacagcattaacgttggcgtggattccggttgcatggcggtaatgtcgtagaacaggtgatgccctttgatcgcaaccgccacgaatgcggcaatggcagacatgcccagtccaaacgcaactttttcgattgtcacatctaccaacaggatttcgacggcgaagaacatgccggccagtggcgcgtcatagacgcctcctagaccagcaccggcagccactgccaccaccatgcgccggtcgatgccgtcaacgccctcgatatggaacaggtcgcagaaacgttgcgcgagcatggcgccgagttcgcgtggggcgacttctcggccgatcgaggcaccggagccgacgatgaaaatctgcaataccacatgcgcaatggtttgccagaaaggcattcgctttcccgccacggccttcttgactgagggcaccgcagtcgttttgtgtcgcatcagataccagataatgcctgcgatgctgagtcccacggtcaccgatatcgcacggcgtgcagcgggcacgccgaatggaccaggcaattctgggccttcgatgtagccgagcagcacatgttcaacgccgtagagcaacagggtcagcagacctgctcccacaccgatgagcacgccgagcacaatggtcgccgcagcgagccaaccaaggcgtttgatagtaaccgttggctgcatgtcaacctccgcaccctatgcaacgagtatgccttgggaactcccctcagtctcgctacgctcgacagctccccctcaaagaggggagccaaagaaacagtccttttgccagaataggaagagcccggaaccatgaaacacgattccgggctcaaacaatcatgctaacgcgatgaggctatgctcactcagcatccttggcgtcatccttggcggacagttcgtcggccacggcggcagcagcggaagcggcctcgacggactcggactcttcgtcctcagcggcctcgcccaggaaggcggagaggtccacaacctcgccatcagcggtgaacttgacggcgcgcatgccggcgagcaggcccttggaacggccgacttcctgcacagcggagccaagctggccattcttgacgatggcctggatgaagttgttcggatccatgccgtactgctgggcgatggaagcgaggaagttgaacacgtcggactgggacacctgaacgtccagcttctcggccagagcgtcgagcaccatctgatcgcgcagatccttctccacggtctcctcggcctgagccttctgctccttggtggccttctccgggtccggggtcatgcccttgagctgctcttcgaccatgttggccttgacgcccttcggcaccgggatctcgaggccttcctgcagcttggcgatgaaggcatcgcgagcctcggtggcctgacgaccttcggcgtcctgagcggcagccttgcggatgtcagccttgagctcgtccagagtgtcgaactcggaagcttcggaagcgaactcatcgttcagctccggcagttcctcagccttgacggagttgaccttgaccttcacggtggccttctggccctcgtgctcgccggcttccagcgtgccttcgaaggtggtctcctcgccggcggacaggccgtcaagggcctcgtccagaccgtcgagcatggtgttggagccgagctcgtagctcacgccttcctgggagtcgacggtctcgccgtcaatctcagcagtcaggtcgatgttggcgaagtcgcccttggcggccgggcggtccacgccgaccaaggtgccgaagcgctgacgcagggcctcgaggcgcttgtcgacgtcctcatccttgacttccggcttggagatggcgatctcaagaccgtcgatttccggcagttcgatgtcaggacgacgctcgacggtggcggtgaacttcagcttggtctcgtcgttggcggactgcggaacatcctgcacgtcgaactccggctgagccatcggacgaatcttcttctcatccagggccttggagtacagctccgggaccgcgtcgttcacggcctcaccggcgacggcggcgaaaccgatgcgctggtcgatgatcttgccgggaacgtggcccttacggaagccgggaacgttcacctgcttggcgatttccttacgggccgcatccagatacgggttgagctcttccggttcaacagtgacggtgagcttcaccttggtgggctcgaggttacgaacgctgatcttcacgctaatgactcctcaaaagtcgttatttcttacagttctgccgtaaggcaacctctacatgataacgccacttacggacggtgcaatgagtttcacttgccagttccttgcgccctgctcgatcaggaacgtctcgacgtccacttccaccgggtcttccacccagcacaggttgcgtaggatctgtggcttgatgatcatctcggccggcgtgcgggtgtcttcggcgatgcggttgatcacacgccgcacccgttgcagacggtcataacgctccggatggcgctgttgccacagccgcatggatcggggcgcgttcaccacaccgttttcgtcctgttcgggggcgggcatggtaggccattgggcgggcttcagggccatggctcgatcgatggcctgcttccagaccttcggtttgaccgcacgctgaatcggcgcgtaccgctcgaacattttgtcctgctcggtgccggtatggatgcgcacacgctcgttcagggatcggagcgcgcggaattgggcagcattgtgcggcttgttggtcgccgcctcgatgattgaggaatcggccaataacaggctgggcgcaatatcgtattgccgggcgagtcggtcgcgctcctcccatagggatttggcgatggccaagccccttggatcacgactcagctgggtgatgcgcgagatacgcagccaaggaatcggatgcggtttgcgcggggcaaggcccgcaaccaaagcgtgagaaaactcttcagcggcccactcgtccttgcctgcggctttcaggtcacgacgcatcatggtttcaagttcgataagcacctccacgtcgagcgccgcatagttgcgccagtcgcgcggcagcggacggtaggaccaatcggcggcggaatgctctttggctagcgtgatgccgaggtagtgttcggtgacggcggccagaccaaagcggtgcaggccgagcaatcgcgccgctatttccgtgtcgaacagggctttgggtttgagcccgatttcggcgaatccgggcaagtccatcagagaatcatgcagaatccacgtggcgtcgcccacggcgtcattgaattcattccaatcagctccggcccgggtcagggcgacgggatcaagcaaggcgatgcctgcaccctcacgtttgaactgaatcagccaatcctcgtgtccatagcggaagccggacgcccgttcggcgtcggcggccagcgagcccgtcgcctcggccagcgcatcgcagacacgatgatagccgtccagcgtcgaagtgacatcgggtactcccccgcgaggctctttcagcagtcggggttcggtgtcacggacgtcactcaactggcgtcatcctcctcaaaacggatggtggatctgatgaatgcggcccacgagcggacttgtgcgccggcgtccatagtaccgtccggcccggtcccgtcaagcggggtccatgagacgcgaatctcacacccggcgctggtggagccggccatcgagccaaaagccgtgttttgggtcacggtgactgtgccggataccgaatccggctcgatgccgtcgaaatagtcgcacatgtcatcccagtacatgccgggggtcagagaatcgttttcggcggtttccagcggcagtcgcgcgaacgccacgcaacgccagttagaatcccagtcaatgcgcagctcatgagcataaagcatcatgatccagcctgtggcgattcgtgattcggcatcgctgccaagaccggcggaaaaggcatcgccgagggcacgctctcccgcttcgaattccacgccgataccataatcggccaaggtggaaggcacgggaatctcccgatagcgcacgtcatggatgcgcttcatggtgctgacggattcgacggctgcccatacttcatccggcacaccctgagggcgcacggggcgtccgtcgttggactctcccgtaggaaatgcgtagatgtcggccatatctctagggtatgggcgaacgggccgaatcgtggtatttacgcgcggttcggccctgcaatttaatacacggtgaagccgtggtccttgaactggttggccacccgttcgcgggtggcggcgttgggtcccttctggttctccagcgggtatgggatgcgcagttcgtgccacttcgggcggccaagctggtggaatcccagcacgtcgatgtgttcgacggcatcgccgaaggactcgcagatcttcgccacgttttcgacgttctcttcggagtcggtcaggcccggcacgagcacaaatcgcacccagatcttcttgccggccttggccagtcgctggccaaaatcgatggtgggctgcaaggtgccgccggtgaccttgtgataggtctcctcgtcgccggatttgacgtcgagcagacacaggtcgatgtcctcgagcatctcgtcggtgtagctcgtgttgaggaagccggacgtgtcgaggcaggtgtgcacgcccatctccttggcggcatggaacacacgcgagacgaaggcgggctgcatcatggattcgccgccggagaaggtgataccgccatgcgtggccttgaacaggtccttgtaacgatcgaccttcttgatcatggcgtcaaggtagacgggcttgccgtcgcgcatcttccaagtgtccgggttctggcagtactggcagcgcaacgggcagccggacatgaacacggtcatgcgggtgcccggtccatccacggaggtgttgatgtcccaagagtggacgaagccgatatcgccggatttcagggcggaaaggcggtcacgtcggtcgagtccgattggggattcaaagccggaaaggccacccatcaaagtctgcgaggcataggtcttcgattccttgagcatatgcctggtcgtggtgcggaacgtgggtgttgcgggcatcgttgtcctcctgttccaaatgatgcgaaagtctgtgggaaataaggaaggggtggagccgtgccccaccccttcagttagtcattgccgcggttcgcggggttggtcatcagtcgacgacggcaccctggtggaaggtacgggagatgacgtcgagctgctgctccttggtgagcttgacgaagttcaccgcgtagccggagacacgcacggtcaggtgcgggtacttttcggggtgctcgacggcgtcctccatggtctccttgcgcagaacgttgatgttcgcgtggtagaggccgtggccgttgccggcgtccaggatgccgaccaggttgccgatgcgctcgtcctcgtcgcggcccaggccatcaggggtgatggtgttggtcagcgagatgccgtcaagagcgtcgttgtagtcgatcttgccgacggagaacatggacggcagcatgccgtgggagtccatgccgttctccgggttggcgcccggagcgtacggggtgcccttggcgtggccggacgggaaggaaccggtgttcttgccgtactcgacgttggaggtgatcgtcaggatggactgggtcgggacggcgccgcggtagaccgggagcctcttgacctggcccatgaccgtggagacgacccacttggcgatgtcgtcggcgcggtcgtcgtcgttgccgtagaccgggaactcgccctcggtgcggtagccgacgatcaggtcgtcgtcggcgccctcaacgtactcgtactcgtggccttccagggtcttcgcgtccttgttgtagatcgggtagaccttggcgtacttgacggcggcgagggagtcggcggcgatggacagaccggacatgccgcagccgagggtgcggtacacttccttgtcgtgcagggccatctcgatggactcgtacgcgtacttatcgtgcatgtagtggatgatgttcagggccatgacgtaggtctcggacagccactcgagagccttctcgtagttgttcttgaccttctcgtagtccagggtgccgtcggcctccggggtaatcggctcgatcacgcccttgtcgatgacctgcatgccggtcatctcgtcgcggccgccgttgatggcgtacagcagggccttggcggagttcacgcgggcggcgaagaactgcatctgcttgccgacacgcatcggggacacgcagcaggcgatagccgcgtcgtcgccccagtggctgcgaatctccttgtcggactcgtactggatggccgaggtgtcgatggagatcttggcgcagaagcgcttgtaggcctcaggcagcttcggatcccagaagatggtgatgttcggctcggggccaggtccgaggtgctcgagggtcagggtgttgagcagacggaacgaggtcttggtgaccatcgaacggccgtcatcgccgaagccggcgtcggaccaggtcgcccagtacgggtcgccggagaagatcgaatcgtagtccttggtacgcaggaagcgcacgatgcgcagcttcatgacgatgttgtcgatgagctcctgggcgtcggtctcggtgatcttgccggcctggaggtcgcgctcgatgtagcagtcgaggaaggcggagttgcggccgaaggacatggcggcgccgtcctgggacttgatggaggccaggtagcccatgtaggtccactgcacggcttcctgcgcggtctgggccgggcgggacaggtcgaggccgtactcgttgccgaggttgatgagcttcttcagggccttgatctgctcgtcgtgctcctcacggaagcggatccagtgctcgatctccggctcggtgaagtcgttgcggtacggcacggagtccttgtcgcgcttcttgaaggcgatgagcttgttcacgccgtacagggcgacgcggcggtagtcgccgatgatgcggccacggccgtaggcgtccggcagaccggtgaggatcttgttgtggcgggcgaccttgatctgcttggtgtacacgccgaagacgccgtcgttgtgggtcttgcggtacttggtgaagatcttcttgatctccggatccggttccttgccggcttccttgatggcctgctcgaccatgcgccagccaccgttcggcatcatcgcgcgcttgcagggaacgtcggtctggaggccaacgaccacgttatcgacttccggggagtcgatgtagccggccgggaaggcgtcgacgtcggccggggtatgggtgtccacgtcgtagacgcgctgcttgcgctccacggccaggtagttgtcgtcgaggtacttccacaggtgcttggtcttctcggtggcaggagccaggaatgtctcgtcgccctcgtacggggtgtagttcttctggatgaagtcgcggacgtcaatatccttctgccagttgccctcggtgaagccggcccacgccttggcgtcgagctcctcctgggagacagctgcattttccactgcggtcatgtcactccttaaatggggttgtaggtttcgcatcttcacggaacccttggttcaacagtgtagttggcacttgcttgagaaaagctgaaattgggagtgagctatctcacattgtttttgtgaacgctaccattccaatggcttctaggtattgatgggactattgcacgtctccagatatgggaaaccgctcatactgtgatgttcgtatgagcggtttgatgagcggttcggtcttgagattgacagcagaaccgtatcagtcagttttcgaccgtcaatcctcggggtgagcctgtgcgggtttcacgccgtagttcttccagcgccggttctcctcctcccatctggcattgcggtccaccacgatgtcccacgcatgttcggcgtcttccttggtcttgtacggacccatgcgctgttcgatcggtgagatcatgcccagctcggcctgcttcttgacggtgttgaaataccactgcttcttgttatcgtctgtcattggtacctcctcaacggtattacttgctcccgctggcgggagcaatatatgtttattccctgaatgcgttggtgacgggcaggcggcggtcgcggccgaacgcgagggccgtgaccttgggacccagcgggtattggcggcgcttccattcggcgcggtccaccaatcgcatcacggtgtctacggtgacctggtcgaagccgtcggctaacaggtcggcgcggccgtgcgcgtgctcgatgtatgcggcgagcaccttgtcgagcagcgcgtattcgggcagggagtcggagtccttctgcccggggcgcaactcggccgagggtgccttctcgatggaggagaccggaatcatcacgccgtccttcaacgggatgccggtgttgccgtcctcgttgcccacgatcttgagaccgccgatgccgacgcctgcggccgcggccttgttacgccaacggctgatctcccagacacgggtcttgagcaggtccttgatgggtgcgtagccgcctaccgcatcgccgtagatggtcgagtagccgcaggcgagctctgacttgttgccggtggccacggcgagcagaccgcgcgaattggagctggccatcacgatcacaccgcggatgcgggcctgcaggttctcggcggagacgccatcaaggtcaagttgctgttggtaggcgttgaacaatggctcaatgggctggacctcgtaatgggcgccaatgttggaggccaaatcggcggcgtcgtctttggaaccgtcggaggagtacatggagggcatggagatgccccagacgttctcgccgccgcatgcgtcggccgccatggcggctaccagtgcggagtcgatgcctcccgagaggcccagcgtcacgccggtgaagtggttcttggccatgtagtccttgaggccgagcacgcaggcagtgtatacctcttcgtccgggtcgagttccggaacgatctcggccttggcctgatgttcggcggcggaatcgaagtcccagaacgtcaggttttccatgaacatcgggctgcgttcgataagcgtgccgtcggcgtcgaccacgaagctgccgccgtcgaagacgaggtcgtcttgaccgccgacctgattcaggtagatgaccggggcgttaacctcggcggcacgacgctgggcgagctcgaaacgggtgttggtcttgccttcctcatacggcgagccgttgatggtgagaagcaggtcgatgttcttggtggccaggtcggccaccgggccgccgtcctgccagatgtcctcgcagatggccacgccaatggtggcgccgtccacgtcgagggtcacggagcggtcgccggcggagaagatgcggaattcgtcgaacacgccgtagttgggcaggaagtgcttgtcgtagccggcccagaccacgccctggtgcaagaccaccagtcggttgcgcggcttggaggtcttgcggtcggtgcccacggtgccgaccaccacgaacagatcgccgaggccgtcgtcgttgagctgggtggcgagttcgttggccttgtcccatgcggcttggcggaaggtgcggcgcagggccagatcctcgatggggtatccggtgagggtcatttccgggaaaacaaccacttgggcgtttcctgcggcggctttacgggagtagtcgagcaccttggcggcgttggcgtcaagcgcgccgacgcaggtgtcgatctgggcgagtgcgaagcgaagctgtgtcatagcttcttagtgtagccgcgtatggcgtcggattgcctgttcttccggcttggcgtcattcattaggtcgttttttcgttcattaggtcactgcaatgcgatatcagtcgctgcaatggcgcgattccaacaaccagtatcgccgttcaccaacctaatggacgatgaatcgacctaatgaacgaatgccactcccctcagtcagcttcgctgatagctcgtcctgcacttatggacggacgaggtccgtccatatccggttcggctgtcgcctcaccttcggctacagacagcccactgggctgtctgcctaacgcctcagcctccggaggggagccagaaaaggatttacctcagctcgttgagcacgcgcagagcggtgttgacgtagaagttgacgaaagtgggaatggattcgtcgagacccacgaaatgcgggctatgccagtcggcgcaaccttcctggccgtttgacccgacgaacgcgaacaccggcaacgtcaccttggcgaattcgcagaagtcctcccccgccatcgactgacgtatcggttcgagctgcgcgtagtcgttgacatccgccgccacggccttggcgagacctggatcggagaccagcgggtcttgaaagtcatcccagaccacgtcggcgctgatgccgtatgcctcggcggtgtgttccaccacttccttgaatcggcggccgaccagattgccatccgacttgtggaaatagcgcacagtcccttggaatccggcttcggcgggcaccacgttccacacatggccgccgtgcacttcggtaacggacagcaccagcgggtggaagggcgtgacgttgcggctcacgatggtctgcaggctcagaataatactggcgagcgcttcgatgggcccggtgcccttgtacgggtaaccggcgtgggtgccttgggcgtggagggtcacgcggaatttcacgcagccggccatcatcggctcaacgccgatggccagctggccgggcgcatagttgggattgttgtgcgtgccgataatggcttcgacgtcatccacgagtccggcgtcgatcatggcgcgagcgccttggccggtctcctcactcggctggaacagaatcttgatcgagccggcgaacttgtcacggtgctcggcgagccagaaggcggcaccgagcagaccggtcatgtgcaggtcgtggccgcagccgtgcatcacgccttcattgacggagctgaactccagtccggagtcttccacgatgggcaggccgtcgatgtcagcgcgcagcccgatacgcggcccgggaccggcctcgccctgaatgagccccacaacaccagtctccagcgggttgtgcaggatctcgatgccgtgcgccttgagctggtcggtcagatagatgctggtgccgaattcacggaaactacgctccggatgggcgtgcaggtagtggcggatggtgatgagttcgtggtcgatgtcgatatgttcactcatggttcccgattctagtagcgcgaagaatatattgcggccctcgctccatattggcgagggccgcgatctatggggtcagtatgtcttgttattgctggcgtttgagcagtcgtttggcgatggcgttggcgatgccctgcaccacctggaccagtacgatcatgatgatcacggccgtccaggtgacggtctggtcgaacttctggtagccgtaggcgatggcgaagttaccgagaccgccaccgccgatgtagccggccatggcagacatgtcgagcacgccgatgaacaggaaggcgtaggccaggatcagcggtgccagggcttcggggatgagcacggtgcggatgatggtgagcttgccggcacccatcgaacgcgcggcctcgattactcccgggtcgaccggcacgagattctgttcgaccagacgagaagtggcgaaggtgcacatgaccaccatcgggaagatggcggccacggtgccgatggacgtgccgaccacgacgatggtgagcggctgcatggctgccaggaaaatgatgaacggaatcgggcgcacgatgttgacgatgatgtcaaggatgcggtagacgaccgcgttctcgaacaggttgccggggcgggtgccgtagagcaccacgccgaggatcaggccgaggaatccgccaatgacgagggtcacgagcaccatggtcagggtctgtccaatggattcgaacagtagcgggcgcagcacgttccagtcgctacgcgggttggcgaggatgatcatgcgttgtctccttcatgtgcggcggcggatacagcgggcgcggtggcagtatcggccgccagcgggtcataggatcggtcttcggcgtaggcggcgtgtccagcgaccgcgtcggcgtaagccacaggctttgcggcggtgccgaagtcgatgacgtcgctattgacggcgagctcgcgcaggaattcgtccacatgccagccgggcccgttgaattcgtaggtgatggcaccgatggcggtacctttgaccgtgtcgataccgccgtagagcaggctggattcaacgccgtatttggcgatgagttcggagatattctgtccggatgccttgagttcatggccttgggtgccggaaacgtccttttggcggataagcacggtgacaatgcggcccgaccattcgtgatgcaatcgctcgacccggtcttcctcgggcaggccagacaatgcggtggcgatgaatcgcttggtcaccggctgctggggtgcagcgaacacgtcgtatacgtcgccggattcgaccacgcgtccggcgctcattacggccacgcggccggcaatctgctggaccacgttcatctgatgggtgataagcacaatggtgatgccgaattcctcgttcacacgcttgagcaaggccagcacttcggtggtggtttccgggtcgagcgcgctggtggcttcgtcggcgagcagaatctccggattagtggccagtgcgcgggcgatgccgacgcgctgcttctggccgccggacagctgcgaagggtatttgtttgcgtgctcactgaggcccacgaattcaaggagttcgttgacacgacgatcctgatagtccttgcgccagtgatcgagttgcagtgggtaggcgatgttctgggccacggttttggtggagaacaggttgaactgctggaaaatcatgccgattttctggcggatgggccgcagcttggtctcactcagagaggtgatatcagtgccaagcacggtcacagcgccggaggtgggtcgttcgagcgcgttgataagccggaccagtgtggatttgcctgcaccggaatagccgatgatgccgaagatgtcgccgcgatcgatggtcaggctgacgtcatccacggctcgtgcgatgttcgcgccgcgtccgcgtgttttgaattccttcacgacatggtcgaaggtgatgatggggtcgctcatagtgctccctgatgctggttgttggtgtccggtcacggaagcggagcgaatcccgattgttggctcgggtactcgctccgcttggtggtaatggctatggataggttagtcgtgcactcgtatcagccacggctcactgctgggctttggcgtccttctcaatgtcggacaggaagccttgcagctcgctggcgctgaacttgtcggcgaacaccgcggtaccgccggagttctcctgcagggcgtcgagcacatccttctgctggtagatggaaacgagcttcttgtaggtctcgttgttcacgtccgccttgcgggccacccacacgttgatgtaggggcgagcctcttcggattcggcgtcatcctggtagatggcgtccttcgggtcgagaccggcgtcggccacgtagtcgttgttgatcacaccagcggcgatggtcgggtccttcagggtggtggccacctgttcggccttgagcggggtgaccttgaccttgctcttggcttcgtcgatgtcggccggggtggagaaggcggtccagtcgtccttgagcgtcacgagaccggcggccttgagcacgccgatagcgcgggcctggttggtttcgtcgttcggaatggtgacggtgtcgccctgcttcaggtccttgatgtccttgaccttggtggagtacacgccgagcgggtagatggcggtgccgccgatgggctgcaggtccttcttgttgctcacgttgtagttggccaagtagagcaggtgctggaattcgttgaggtccagctcgccggagtcaagggccgggttttcggaggtgtagtcctggaagtcgacgatgtcgacgtagatgccggccttctcggcgttctgcttgaacttgacccattcggggttggtagcgccgaccacgccgatcttgaccgggttgcccttgctgcccttggcggacgactcgttggcaccggcaaacgcgcggtagccgaagaacgcggccacggcgataatcgccacgaccacgatggtgatgatgacgttgcgggcggtgtggttcacacgcaccggctcgttattgttaggagcggccggggttgccggctgggttgctgctgtcattggatttcctctctccaaaattgatgtcgggtaacaccataacgcgcttgaaccgcgaaagtgacggaaaatggccgattgccgtataggtgtcttttatggcgcgcatgcaatgtccgggattcgtgcgtttgataacccgctataggcgtgctgaacacgccggaaagcacgtcgagaggagctttgacaatggaagttatgactaccgatactgccaatgccgatatccgagccgtattcttcgatatcgatggcacgctcaccagtttcacgacccatacggtgccggattccacaatcgaggcgattcaccggctgcaggccgcaggcgtcaaggtgctgatttgcacgggccgcgcgccttcacagatgcacgtggtgctggataccatgccggtgacgttcgatggcgtggtggcgttcaatgggcagtattgttttgatgacaccggcttctttgcctcgcaggccttggatactgctgatattgaggtgattctcgactggctggaccgtcaccccgatgtggtgtgcaatttcggcgagaaggattacgtgtacttcaaccagtccaatgatctgcttcgcgccacgtggagcaaactgggcaaaaccgcaccgacccggtatttcgaggacccgcgcacccgcgcgctggatcatgagaccttccagatcagtccctttgtcgggcccgagctggaggccgaactggtgggactgtgcagcaatgtgcgcggggtgcgttggcatccggatttcacggatctgattccggccgatggcggcaagccgcgcggcatccagcggttcatggcgcattacggcatcacgcgcgagcagaccatggccttcggcgatggcggcaatgacacggatatgctcgcctacgccggcatcggagtcgcgatgggcaacgcgaccgccgagccaaaggccgccgccgattacatcaccgatgacgtggaccacgacggcgtactcaacgccctactgcatttcggggtgctacgcgattaaaacatcacaacagttcgctttgttctgccccgccgtgacagggcttatgaataagcaaagggctcgggacgaatcccgagccctttggtgttagcgaactaacaacaccgtggaggtgttatcactcgttgtcgccagcggtagcggcggtagcggtgacggcacccttcttgtcggtgttcacgccggagtacacccagtcggtgtagtccgggtggtcgtagccgttgtcgacggcgaactggaaggcctcatcacggaacttctcgagctcgtcgatcttgtcggcgtacttgtcggcgtcgatcatgcgcagagcctcagcggtcagctcgtagcggtcgatgcggttgacacgaaccatgtcgtacggggtggtggtggagccctcctcctcgtagccgtggacgttgaagttgtcgtggttcggacggtcgtagatcaggccacgcacgtcgtgagcgtaggagtggtacgcgaacagcaccggcttgtcggcggtgaagatgtcggcgaactcctcgtcggtcagagcctcgtcgttctccttggcggactgcagggagagcaggtcggcaacgttcacaaccttgaacttgacgcccagttccttcagcttgtcggaagcagccatgatctcctgagtcgggacatcgccggcggcggcaagcacgacctcggcctcatcgttgttcttggcggtggaagcccaatcccaagcggcggcacccttctcgagctcggcacgagcctcgtccagggtcagccaggtggcagcaggctgcttgccggcgatgatggcgttgatcttgttggtggacttgtagcacttctcggcgatggccagcagcatgttcgcatcggtggcgaagtagatgccgatgacgtggtcgttgtggaagcacttgttcagcaggacggaggtgacacccgggtcctggtgggagaagccgttgtggtcctgacgccaaacgtgggaggagaccagcaggttcatggaggcgatcggcttgcgccacggaatctcgcggacggtagcctcaagccacttggcgtgctggttcagcatggagtcgatcacgtggacgaaggactcgtaggagctccagatgccgtgacgaccggtcagcaggtaggcctcgaggaagccttccatctggtgctcggacagctgctcaacgacctggccggagacgtgcatgtgctcgtcgacctcgtcggagatgtagccggcatcccactgcttgttggtgacttcgtaggaagcctgcagacggttggaagcggtctcatccggtccgaagatgcggaagtcgcgcgggttgttcttgatgatgtcgcgagtgtaggcacccagggtacgggtggcctcgagctggccccagccgtggccgtactcagccacttccttgacctcgtagtcctcgaggttcggcagcttcaggtcgttgcggatcacaccaccgttggcgttcgggttggcaccgatacgcagctcgcccttcggcatgaaggcaaggacgtcgtccttgacagcaccgttggcgtcgaacagctcttccggcttgtaggactcgagccagttcttgagaacctcgaagtgggcctcggtgtcgcgggcggaagccagcggcacctggtgagagcgccaggagccctcggtcttcttgccgtcgatgtacttcgggcaggtccagcccttcggggtgcggaagatcagcatcgggtagaacggacggtgcacgttgtcggtctgagcggtggccttgatgtcgcagatctcgtcccagatggtctcccacagctcggcgaagcgacggtggatggacatgtggtcctcatcatcgaagccagcgacgaactcgtagggctcataacccatgccgtggaagaactcgtggagctcttcgtcggagatgcgggacaggatggtcgggttggcgatcttgtagccgttgaggtgcaggatcggcagcacgataccgtcggtgcgcgggttcacgagcttgttggactgccagccggtagccagcgggccggtctcagcctcgccgtcgccgacgatggccgggacgaacaggctcgggttgtccatgatggcaccgtaagcgtgggacagagcgtaacccagctcaccaccctcgtggatggagcccggggtctccggagcgaagtgggacggaataccgcccgggtaagagaactgacggaagaacttctgcagaccagcttcgtccttggtgatcttcgggaaggtctcggtgtaggtgccgtccaggtaggactgggaggtaccggccgggccaccgtggcccgggcccatgatgatcacggtgttctggccgtggtcagcaatgaaacggttgatgtggccgatgaggaagttcaggccaggggtggtgccccagtggcccaccagacggtgcttcacatcttcgcgggtgaagggctccttcatcagcgggttggaacgcagataaatctggccgatggaaaggtagttggcaacgcgccagtacttgtcaacgccttcgagggcttcctcggaaaccggagcgttgagcttcttccaaggggtgccaataacaggactcgtcatgtgtactcctgtactcctgcacgtgatcgtgcgattgattatttctgttcggtcacggtccctgacccttgcggtgccaaggttttccgttcccaatcaatcgtcatggtacgaggacaacgcgacttttgaacgatttcttgcgggtgtgttcggaattgttgcggaaatttcagtatttgtgcggttcaactgaccgtttgtcaacattagttttttcaaaatactttttcaaaacggcggaagcatgcggaaatccagcatttggctagaacagcgcacgttcgatttcccatgttcgaaatcggcgtgttgtccgtctacgggcatgtagtttgttcgatttgcgcacatagtctctgcgtgtcggccttgtcgccttgaccagtgataatcaggggtgttcagcccacgtaaaattccaatgaacgttaggggaatatcaatggcaaacggtcctgtgcttgtcgtcgacttcggcgcccagtacgcccagctcatcgcccgccgcgtgcgcgaagcaggcgtgtactccgagctggtccctcattccatgccggtcgacgagatcctggccaaggatccgaaggcgattattctgtctggcggcccggcctccgtgttcgagcccggcgcgccgaccatagacaccaaggtattcgaatccggtgttccggtgcttggtatctgctacggcttccaggtcatggcctatgagctcggcggcaaggtggataaggccgcgctcggcgaatacggcaagacctcagccaccatcgacgacgccgccggcatcctcgccgactcccccgccgagcagaccacgtggatgagccacggtgtggcggtcgaacaggccccggccggcttcgaagtgctggcccacaccgaaggcgcgcccgtggccgccatggcggacgaatcccgcaagctctatggtgtgcagtggcacccggaagtcaagcactccccgcttggccagaagcttatcgaaaacttcctgcaccgttgcgccgcgctgcccaacgactgggatgcctcctcgattatcgaggatcaagtcaagaagatccgcgagcaggtcggcgacgccgaggtgatctgcggcctgtccggcggcgttgattccgccgtggccgccgctctggtgcacaaggccatcggcgaccagctcacctgcgtgttcgtggaccacggcctgctgcgcaagggcgaagtcgagcaggtcaagcacgacttcgtcgccgcgaccggcatccgcctcatcaccgtcgacgccgccgacgacttcctcgacgccctcgcaggcgtctccgagccggagcgcaagcgcaagatcatcggcgagaagttcatccgcaccttcgagaaggcccagcgccaggtcctcgaagaggccggcgcccgcggcaaggaggtcaagttcctcgtgcagggcacgctctacccggacgtcgtcgaatccggcggcggcgacggtgcggccaacatcaagagccaccacaacgtcggcggcctgcccgaggacatcaagttccagctcatcgaaccgctgcgcactctgttcaaggatgaggtgcgcgccatcggcaccgagctcggtctgcccgacgaaatcgtctggcgtcagcccttcccgggcccgggtctgggcatccgcatcatcggcgagatcaccaaggagcgcctcgacctgctgcgcgaggccgacgccatcgcccgcgaggaactctccaaggccggtctcgaccgcgacatctggcagtgcccggtcgtgcttctggctgacgttcactctgtcggcgtccaaggcgacgagcgcacctacggctcccccatcgtgctgcgcccggtgagctcggaagacgccatgaccgccgactggtcccgtgtcccctacgatgtgctcgccacgatctccacgcgcatcaccaacgaatgccgccagatcaaccgcgtcgtcctcgattgcacctccaagccgccggcgaccatcgaatgggagtaagccgatagggctttgacctgctcttttgagtgccgtggtgtaccgctgagtttcgtttcgtacgagagtcatggcaaaaccgccagcgacggcagtgagtaaaaacgatttcctagcctccgttccctcgttggaacggaggctttttctttgccgttttactccctttcacctgcgatttcgccatttactccccgtgtttcaagacaacaaggcacggggaggtattcgagggaatgggagtaaggatttatcccaagtgagttgacgcgcggtttttgtccccgagggcgaaacggtgccgtttcggggcccgtgaaactcaaatcgaactcaacgggcattttttgctgggcgtttccaatgttcccgttccgtgggataccctgattctctctgtggtactgtttgtggtgattcctctggctggcggtatgctgacccgttcggctgtcatcaagcggaaggggcagtgtactttgaggagactttcatccgtatgtttgacagtgcaactaccattggcttattgctgacgctggtgatgattttctcgttccaaggcaataccattctggaaaaacctctgcacattgttttgattgcggtaccgctgattttacagaccttcctgatttttgcgattgcgtatatcgcttgccgggttttgaagctgccctacaagattgctgctcccgccggaatgattggtgcttccaacttctttgaactggctgttgctgttgcaatcgccttgtttggaacgacttcccctgcggcactggcaacgactgtgggtgtgctgacagaagttcccgtgatgctgttccttgtaaaaaaacgcaaataaaatgaaagactggttcaaatatgagtaagaaaaaggtggcatttatctgcgtccataattcctgccgcagtcagattgccgaggccttgggaaagcacttggcttccgatgtgtttgaaagctattccgcaggaacggaaacaaaaccgcaaatcaatcaggatgctgtccgcattatgaaagaactgtacgggattgacatggagaaaacccagtattccaaactgatctcggatattcctgcccctgatattgcaatctccatggggtgcaatgtgagctgtcctttcattggtagagcatttgacgataactggggattagaagatccgaccggaagcgaagatcaagtctttgtcgagatcattcgagagattgaaaaacggattctacagttgaagcagtcccttatttgattgaaatagcactctgcttgtggtataatacagatgatccaaaccattgcttttctgctgataacattgggcttgataatcttttgataacaggagtccgacaacgccgtataagttggataattggtatcaaattgagcaactaagagtcaaatcccctaaacagtattgtttagaaccagttttactttggcgagtgggagtaaactggagcggattttgcgcaatcgaaattccgtccgtagagtgtcgcagtgtgccgccacgtacgaaaaagcgtaaagccacctgtgattttgggtgagtaaaaactattgagaccctctggaaacaacgttttcagggggtctctttatgccttttgacctgtagtttcagtcatttttactctaaaagcgcgtacaccacggacatggcgacacgcagcggacgaagagtaaaggatttttcggagagtgaactgtcccagtagtttgtcccaccaccccaaaaacgcccctgaaactcaataggaacgcaagggcgtcatcgtgcgagcaccgcagcctgagccgccgataccaggctcgtttgcgacgccgtcgctgcttgcctggatcgtcaacggcaagtacgtcatgtcgctgccgctctaccgcatagaggcagacctcaaggcgtgcggcgcgacgatatcgcgccaggacatggcgaactggatgatgaacgtgcacgcgcgctggctggcgaaggtccatgagagaatgaaggtcgagctgctgtcgcatgtcaggattcatgccgatgagaccacggttcaggtcctgaaagagccgaaccgcgaggcgaagaagaaatcgaggatgtgtctgttctgctcggcgcgctgcgacgtgcccgtgtatgtattcgaataccacgagacccgcaggaagggcgttgcccaggagtttcttgcgggctggtccggcacgcttaccaccgacggctacaaaccctacttcaatctcggcaaccccaacatcgccaacacggcgtgcctcgtccacgtgcgccgctacttcgcccaaatcgtgaagatcgccggcggcggcgccaaggcggcgtctgcggccagcgttgcgctcgaggcaaggcgcaggatcgacgccatgtttcaaggtcgactccaagttcgacgacatggagccgggtgccaggaaggccgcccgcgacgcggagctccgcccgctcatggaggacttcggggggatgggcgcgggccagcttcccctagcctcgccgaagctggcgctgcaccgtgcgctgcagtacgccgtggagttctggccctacgtcatgaacgtgctcgaagacgggcacctggagctctcgaacaacgtcgccgagcaggcccagcgaatcttcgtcgtagggcgcaagaactggctcttcagcgatgcgccacgcggcgcgcgggcgtctgcggcgatatacagcgtcaccaccacggccaaggccaacgggctcaatcccaggctttacgtcgagtggctgctgaccgagatgcccaacgccggcgagctcaccgatgaggttgtggactcgttcctgccatggtcggatagggtgcctgagtcctgcaagctcgacccagccgctgccgagaaggccaaagagatgcctgacgacttcataattaacatcgaccccgatgcgttcgacgacgagatggcgaacaacgccgaggagggcctgtagcgacatagcggcctaaggcataccgcaacgcaaagatggaaacgtccaggacttttccatccgtatgccggaatggccctggacgtttctgtgttttagcaagttggcgtccgctttgtgagcggtgtttttccgcagtgtaggcagcgggttttccgcagggtgtgcggtatcggccgctgcctgtctgcgttgtgttggttatttggtcatg

SEQ ID NO: 31 - DNA, 36565 bp, Bifidobacterium longum
atatacaggcggcggcaccgatgcctatcacatcaccgggaaacgatgacgacaccggggaaaaccatcagcccacactacggaaaaacactgccgaacctgtcgaacaaacattgaagcaaaacacaggtgctcgcggatgtccttctggaacccgcggctcatgccgcaggtgacgagccgcacgcgcccaggcaccccgtcgtggtccatgaagtccccggcgaaccgttcgaccgtggtcgagtccctgcccggggtcacgtcggtcacgtcgtgctcgaccaggccggcgaccacggtgatgcagttgcggcccttgcggctggtcccgtcgacgccgatggcctccacgcccgtgtggtcctcgagtcccctcgcctcgtccacgtaatgcgagatgaaccgccacaggcgggtgtcggtctcgtccaactgcccggcgagcgtgctcaccggcaggtgccgggccatctccacggcccacgcctcgaacaggagcgtgaacccgctgccgggcctggcccacgggggcggacaccgtcctcaccccgtgcacgggacaggtgacgcggggcatggcggcgtggatgaacgccttgtactggaagaagttcaggtgtcgccacacgcgctccctcgtgtcatgcaccggacaggcgcccccccccggcagcccgtctcggggcaatggaagcgcacgccgggctcgaagccgatcatgatgtgcagtccccgcccgccgtcgcccgcgtccctgaaatccacggacccgaccttccaaggcccccgcaactgcaatgcggcggtgaacaggcaagaggtatccatgcctccaacccacccgccggcatcaccccacaccacaaccacccaccacaaacagcgaaaggcccaaattgttatcgtgcgatgatcgaccgcccctttatcggccgggttccgcacctttttcgcgctgacgaagctgctccgtttgccagcgcgaactgtgttctcatacggccatgcaccgctctgccccctcgaacgacaccgtttttgagggactggggcgctgcagggccgcatctttagttgtaagtacttacaattttagtgtgagcgttcacttttggaggggtggattccttttcgggaaggcaatcagtagaacgcgaatgttgttcacaggtcgtaagtctcttccccacatggcttcgccgggagcccgtcccgcaatcaaggacgggctttgcccgcagcttgtcggttcgcctatcggctcaccctcgcctacgaacagcccactgggctgttcgctatacggctcggcccgtcagaggggggagcttgatggccactcaggcgcgacgcttgcgctggagagtcagagcgataccggcgacagcaagcgccacggctacgccgctaagactaagcacagccgcaccggtcttggacaaaccaagattgttgcccgtcttatcgcccgcatcgacgctcgaaccgtcgctcggcttagtcgaatcgcccgagccatcgcctgaatcggaaccatcaatcttcactaacgcagcctgcgccttaaccaacgcgacggtcgtgtcatcgacgtccttctgcgtagcagtatcgtcggcatagaccttctcagcggaggtcagcatcgtggcaaacgccttccacgaggcggcggtgtagtcggacccgtgcagctgcttggcggacgcaagcgccttggacaaaccagacttatcgaccgcaaccgcatcgtcaaccacatgcaccgtaacggaaacgatcttgttcgccagctcctcggaagagctcatgtcgaacaccggcataccgtcggcagcccagtgcacgcggcgtacgaacatgtcgcggccggtggcattcacggagccgaggttcttcgtagcataagcatggaacacgtagatctggttgccgtcctcgtcctcgctccacatgccgtgaccggtgccgagctgcatctcgccattgaatggaccggacttctgaatcgggtagttgagcgccgtccagctggccgggtcggtcaggtcggagccggcggcatcagccacggccaaaccggtggtgtaggtcttgcctacgccggaaccggagaacatgaggtacagcttgccatcacgcatggtcacgttcggaccttcggctatggcggcgttccacgcatactccggggtgacgatgcgcaccggggagctggtcacatgggccgggtccttcggatccatcgtggcgatgtaggtggcgccgagctgctgccaggcgtagtaggacctgccgtcggcatcctggaaataggtcatgtcgagcgacatgcccactccgccggacgcggtggctgcgagctgcttgttaccgttgagcagcgaggcgtcattgcggtagatcggtgtcggcacagtccagttatcggggtcggtcgggtcgaggtcatgaccgtcggcatcctgcttgagctgcatgtacaccgacttgccgttggaccatgtgttgccgtatccggccatgaacagaatcgtgagcctaccatcaatctcatgaatttctggagcccagaagctgtgcatgatggcattaccctcggagtccttgtcgccagccttgagcagcgacacctccttgttgttgtagccgttcgactgaatcagggcattcgggttgcccggctcgtcggcgagaccggaaatcgtgtcggccatgcggaacggcatgtggggcgaaccatgctgccaagtgacatcaccttggatgtcgttggaagcgatcatcaggaacttggtttcggtgacttccttgccgtcgacctcatgcgtccactgccacttatacaccgatggatcggcgcggtcctcggcgaacggaatctggtattcggtctgcttgacggtgccggtgacagtgtaatcacccaccttcgtcagatctataccctcagtgttccatgaggaaatcggcagggagccggtagaaccgtcggagtaagtgaggtccacgttcttcggcagctgcgaggtcatctcatcaatcgaggaacctttctcgacggtgatgtcagtgagattgctcgtgccggtgttctcagagcggccgtaacgggtgttgagcgccttgacggtcgcctcgtccaccgcgatggtggcaccggagcggaagttcgcgatgccctgcacgccgtcggcatcgagtacgccggacttggcgatggaaccgtacagtacgctgccatgcttggacgcggagcccttgagcgaatcgaacgtggtgtacttggccacgccgttgtcatcggcccagccgacaacatactgcttgctggcggtgtcgtacacggcgtacggagcgttgacgccgttggtctcgccaaggtcgacgatggaaccggagtcctcctgttcgctataggtgagcaggtcttcggaggtggcgatgagcacgctggacttcgcggtggagtcaccggtggcggtgccgcggttggtacgcacggaaatcacgccataggtgccgtcggccatgcggagcaggctcggatccttgagactgcggtaatcattgccgtcgaggttctcgttgagattctgcgccttcggcgaacgtgcgaagaagataccgtaattctcgttgtacggggtgtacgaaccgtcagcgttctgcaacgcgaggtgcatgctgtaggcgatgtcgccgttgttggcctcgtcggcgctggtggcgttgcaatcataggcggcgatggtcgcggacttcgcgtcgggcagcacctttacggtgaagaccttggtaatgggctcgatgccggcgagaccgttcttggagaactcgacggtgatggtaccggtcgtggcctcgtcgccatcgatggtgatcttgccatcctcgacggctacgtccttagtggacgtaaccgtgacggtagtgccattcacagccgccgggagggcgtctccggaacgcacgacggacgggatcacgtagccggccgcggcttccttgagctgttcagcggcagttttcgtggtcgggttgactgtgaccgtgaattccttcgtagcggtctggccacggatcgtgacggcggcggtcagcgtgacagtcttggctgcctcgcccttggcgggctggttgactgtgccgtcagtcgcgatgacgctgctatcggaggacgcccacgtcacgccgttcgcagtgggcaacgaaatgaacggatcgtcgaccgtcgtggggatggtgatgccattcagcacggaaccggtgagttcactggcatgaattgaggcatcggcagtgctgattgcagcgatctgactggcggtgagcgcggcatcgtatacgcggaagttcgagaccgcacccttgaacaggttgtcgggccacggcgaacgtgcgatggcattgagcgactggtccttgacgctggacagtttggccggcacggtgccggatgccacctgcgtgccgtcgatgtacagtttcgcggcggcgccatcaatggtggcggtcaccgacaaccattggtcggccttggccacgcaggagctggactgcacgagcgtctccgtaccgcccgatttcaggccgacgagcgggttacgcgaactgccgcagttgagcgtggcgaagaaatactccgtatcggagctgtcgttaccgatgttccacaggaaatggaaagcattgagcatgctggaatccgctttgacctccaactgcaccgtggcggcgtccttgccgggcagcagattcgagggcaacttgacccagtcgccggaaccagtcttggcaccgccggaaagggtaagagcgctatcggcccagagcgagtcggcggagttctgcacttcggccgcgccaagcgtagcgttcggcgcactgttggccacggtcttgccgtcacttggcttcgtggtgaagtcgtaggcggcgatgagattatcggtcggaacggtatcggccgcgaccgccgtggtcgcaccgattcccatgccggcaagcgccatcggcactgccagcatcacaccgagcaggcgcttgcctatcgatggtttggttgtcattgcttctccttcttgcgcgcggtgatactgcttgccgcgcaacagatctagatgttgagtggtgaagttcggtaatggctattggagctatggggccataaagcttatgcgtctgacagcgtcgtcggacgaacgtgcaatacgccccctctgatgggaccgcaccatgaagcaaacaatccagtaggctgcttgctatacggctcggcccgtcagagggggcttggtctacgctgcaagcagctcaggcctggcgcttgcggagggtgtaggcggcgccggcggcgacgagcagtgtgaccgcggtgatacccacaccgaataccgaggcgccggtgttggacagagcgctgtccggcttggaggcgggcttttgggcaccgtcgtccttgccgtcggtcttgccggagtcgccggacttcttgaccagcttgtcggcggcggactggagctgcgacagcgccttgtccacttcctgctggtcggtggagctctgcaacacctgctgcgcgtcggcaagcgcggcggcgaaagcatcccaaccagactggtaatcagccttgttatagcccttcaccttatcgacaagcgcctgcaacttggacttgtccagcgtggagccgggctcgccggccttgatggtgaacgttgccgaagcagtaccggagtacttgccagcgccggttacggtcactgtggcggtgccgggttcgacgttgttcgtgtaggccaccgtgtagtcggcgccttccttgagcgtcgcgccatcgagcgtaacggttacggccggttccttggcagcaccgtctgcggtgaactcgttggggtcggccgtgacgaccgccccggagatgtcagtgccagtcacggtgacggtcgcctcgaccggcatacgggaatcgtcctgggcgacgcccttgacggtgaaagtgccggtcttggcataggaagctgcgtcaatggcatcccactcaactgcaacgtcagaaacggaaccgtccgcatgagtcagatgcgcggtttccggcagcgtcggcgccacaccaaccgtcgtctcggcagacagcgcgtcaacggacttcacagccgcagccggagcgtacgcctccagcaccttctgatactgggcgcgggtcacgggcagcacagtgccgtgacgcggcttgccgccatcggaattggtcgggaagttcgcctcaggcatcttattgccgataacggtccactgaccgctggcgatatcctcagtcgccatcggcacatagtggtttggaccttgatgatagctcggctgatcggcgaacaggtagtactggtagccgttcacatcgccatcgttggccttgaatagcgatggaccttcgccggaagtgaaggttttaccgtaaccgttagcctggcctttaccgaggttcgtggcaacttcgctccatgcactacccttaagcgcatcggcgtagttcttcacgccggcaccaccaattgcggcagtcaaatctgtggacttctcctgacgcaaagacatcgtgttttcatctttgtagatgcggtagtaggtatcccctaccttttgcacggtcacatcgatggatccactgcctgcaccgcctcggcgatcaacgtcaatccacactaccgggtcggagaagttgacgaagtcatcggtggtgacgtacaccatgcggttgtaggtcagctgcttgcggctgttctcgtcggtgttgtcgtacaggttcgaggcccaatagaccacgtacttgccgatttcctcgtcgtagtaggcctcaggcgcccaagtgttgcctgcgtaatcagagctcaccttgacgtggctttgcctggaccagttgaccagatcgtcggacttccaaatctcaatgtacttggaaccgttagcctgtgcaccagcaaagccattcagcccgttgaggggggcacgaccgtcaatcttcagatcggtagcaagcatgtagaacttgtcaccatccttggacttcatgatgaacggatcgcgcaaacccttctcgccaaactcggaagtgaacagcggagtgccattgttcagcgtgttccagtcgagcgcatcgttgcccttggaagccgcgaggctgattttctcgccgcccacgccctcgccggtgaagaacgcccacacgtaggcctcgtccttctcttcggcggcaggcatcggctgaatggtgacggtgaaggtcttcgtttcggtggcggtaccgtacttggcagtggctttgagcgtcacagtggcggcatcgcttccggcggcagggcgcttaacagtgaccgttcgagatttgtcgttcacgccttcgcctagtgtggcgatatccttgtcaccggtcacttcccacgagatggtcgaaccattgttgcccttggtgggcacggagaagttgctacggatgtcgtcggagtcctcgatggtgacggcgtcaaggtcggccttggcttgctcggcatcggagaactgcttcggcacgaggaccgtgtaggcggcggttttggcgttgttgccgaacgtggcggtgagggttacctcggcatcagctgcggttgcggccggacgagtgactgtggccttgccggtagcgttgtcaacggcgatggctgcgttgcccgacttccacgcaatgctcacgccagcggcgctggtcggcagcgcgaagtcctcggtagcggatgcgggcacagcggccttgacagcggcctcggccttgtcgagcacctgagcgtcatacagcttggtcacgtctgcggcgctgatggcagtgtcgtatacggcgtaatcgtccacgtcgagcttggagttcgggtcagcgtaggaggacttgccaatgtaggcgacgaggtcgccgtaattggtcaggccaccggccggaatggtgtaggtggcgtctccaacctgcttgccgttgaggtagaagctcatggtgctgttggtgccgctgatgacggtggtgtacagagccaaatcgctggtggccttggtgccgatggtggcggcgttcgtcgatccagggccgacttcggtgccccacgggctgttattcgggtcggccgcagtggcattggtcattacggatttcgcgtagccactcgggttggccgggttgagcagccagtagccgttggccggataattgccggtcttggccgcgccgatgtacgcggcggcggtattgccgttgccgtaattgttcttgagccagatggagacggtaacgtccttcttaccggcgatggccgtggtcggcacgctaatggtttgcgagccggtcaggttgatctggccattggccaccgtggcgtcgccggatagggtggcatcgctgttggccgcgctgccctcgttggcgatggtcttggacgtcagtgcgttatcgaatgaatagtggatgatcggactggcgtcgattggcgatgcgctctcggcactggccgtcatcggcagcaccagaccagcgagcagtgttgccacgccgaccgtaagtccggttgcctttcgtatcagctttctcatgtttctcctcattgatagggttgattgtggttgcgcctccagttatgaggcacagttttgaaattgttcaagttatggtgatactaggtgcttcctctccgtccgtcagaagccgactgagaggaagcatttgaatccgctcaagcgcggcgcttgcgccagatagtgagggagatgccggcgacggcgagcgccaccacggcaccaccaaggctgagcacggctgcaccagtctcggacaggtcagcgccgggcttgtcgcccttgttgtcgcccttgtcaggatccttgccggtgttcttgtcaccgttatccttgccggaatcaggatcggtcgggtcttcagggtcaggagcgacggccttcttggtgagcacgaccctgtagaccttgacggtcgtgccatcctgcgtggtcacggtcaccgtcaccacgttgtttgccacggccacagtggccttggcgttggcatcgtttgccacagcctgcacatcggcatcggtcaccttgctcggatcgtcgacttcaagcgcggcaccctcagtagaggcagccgtgtcgaggtcgatatcggaaccgacaacgttcagcgacttcagcgtggcatcagaagacacctggtcctcggtcaccacgaccttcagcgtcacgtttttcttcgactggtcgagctcctcgctagtggtcatgtcgataatcggcgtgccatcggcacggaagtgcaccggaacaacaccggcatggcgagccgtgttgttggtgccactggtcatcgcgtgatacacgttgtacgtatcaccgtacgggtcagtgaagtaggagttgtggcccaagccaaactgaccggcgaaagtaccgttgtgcaaccacgggtagttggacttcgtccagctggccggatcggtcaagtcgtcaccgacatttgcgatgagcataccggtggcatactgcggagtgaccagctgcgcggagaacaccatgtacaccttgccgccggagacgaggacgttcgggccctcattcacgccgtccagctcccaaccccattcggggcgcatgagacgctgcggctcggtgatggcctgccacggcttgtccgagttgacctcggcaatggacacgttggccttggcacccttacgctcctgatcgccttggctccaagcaatgtacgacttgccgccagcctcgaagtaggtcatgtcgatggacagaccgtgcggggacagcacgccgccatccttggcctgcacgcgatgctcaagccagtcggcggtcttggtgggatcgccgccatccttgagctccatcacgtaagcagatggaccggcccagttgggagaattagtgatgttttcatcaccagccttaccggccgggaaggtagcgtagaagcagtatagcttgccgttgataacgtgcagctcaggtgcccagtggtaacccttgtgccccaaaccatcgttctcgccaaacaggtacacatcctgaccttcgaccttgtagccgccttcagttgcggtgccggccttctgatccttcagcccggcgagcgtatcggaggatcggatgaacagtgtcttcataccgccggtgtcggaggtgcccatggcgtagtacttaccgttgtagtacacgatgttcggatcggcgcggttgctcatcatcgggaactgctcggagtagttctgctggttgatggtgccgctgatttcgtaagtaccggcctcggtcaggtcgatcttgttcagatcgtcctgattccagttgacgcggaagtcgaaggtggagccatcggagtaagtggcggttgccgtggcacccttggagaggttgccgttgtcgagctctgcgccgccgttgatctgcgcgagcaggtcatccttggtggtcttgttggcctgcacggtgatgtctgtcgggacttccacaccagtgttgtgcacgcggccaagcctctcggtcaggctgtcagcaacatccttggtaagcgcgatggcgttgccgctaccagcaaccgcattatcgataccggtcaagtcagcttgcgcgcgctcgaagcctacgccgttcttgacttcagagaaggtcttaaagtccttggtcgtcacgtacttggcaacgccgttcaccttccacgagatacggtattcgcctgcggaagcgtcgtatccagctgcgatggaaccggcatcaaacagagtagcgtcagaggtgaccgtaaccatgtcgccacgctcgtcctcattcggcttgccggaccagtccgtcagattgctggaggtagagaaagcaacctggccgccatctacgcgattgccgttcacatcagtgaacactgccacataggcgtacttgccatccttcaactggaacaagtacgggtctacgagaccacgaacttcagtggattcagtgtttgcggttgcgttgatcttcgcctcggcaaaagccacaccgtagttggtgttgagcgcagtggtcgtagtgccgttgttcagcgccagatgcaaggcattgcccacgcgggagccaccgttgatggacctgtcgcgagtgtaggaggagagcttctgggcgctcttcggcataacgcgcacgccggtgaacttctttgtggtgctggtggtgccgagcgtaaccgtcgcagtaaggtcgacggtcttctcagcgtcgccgtttgtgccaacgactgtgccatcgtctttgacgaggctcgtgtcggaggacttccacgtcaccttcgcatcaggggccgcagcaattgcagtcggcagcgttgcgccggcagtgagctggtagtcaaccagcagtcgttcggcggctgcgtcggcggtggtgatggccgcagccacgttcaccgtgaatgtcttcgtgtattcgatgccgttgaccgtggacttggcggtgaacgtcacatcggtgtcttgggccggggctttgacgagtgtgccgtcgttgccgagcactgcggtgttggacgaagaccatgtgatcgtgttgccgagcgcatctttggcaggcagagtcacgctgccttcggtggagccgggcagggtcacgccatcccacaccatgccgtcggaggcgtaggcagccttccaaatcttgatgttatcaagaccgccgttgtagtacttgtcgccggcccatgtggacttgccgaagttcatcggcaggtcggtgccgagctcggagagcttcgtggtcacgttcttgttgatggcggcaaggttgccgtcgatgaacgtggcgatgaaggtcgggctcacggaaatgcggtacgtgtgccacacgttcgcggactgcgtagcggtcacgccctgctcgttaccgttggaggccttggtgatggcagtgtacacgctggttgggcgcagacgggagaagaagtacttctggttgtcggagccgatggtgaacgagaagaagttgtcgttcgcagccatgcgggacttcgagtcgaactgcacggtgaaggagtcggtgccattgagcagaccgttcggcagttcgaggtattgaccatcgttgcctcgcaactggatggcgttgccgcctgactgatggtctccgggtacgccgtattcgacattctcgcccttgacggtcaggtcgttattgttgccggagatgtcctttcctttatcgttggcatcctcaaaatcgtaggatgcgacgagattagcgtccgtcagacctccgtcgttgtctgccgccatcgcggtgactggtcctaaggccagtcccgcaatcatgaccggtagcgccgctaccgccgctaccgttttcttccacttgcccatatatttctcctcattgaatggtggggtggctgagttggttgttaagttgtgaagtgtgtttattgggaaaccacgtttgttgggctcctctcagtccatctgaggcggactgaggggagctatgcagactaggcctgctcagtccttgcgcttgcgccaggcttccagaccggcaccagctgcggtgagagcgaccatggctgtgccgagggctagcacggcggcaccagaggacggcagaccggagtctgctcccgtaccagcgttaccgttatcgctgcctgcaccatcgccggaaccgtcgcccgaaccgggcttaccgggctcggtcttggcactcacggtcaccacgaacgacgtggtgagctgatcgttggccttgagcgtgacggtgacggtcttggtgcccacagcggacatgtccacgtcgccgaccgtgtagtcggcggcatcgagcgtcttcaccgtgccgtccgacatcgtcgcctcgatcacaagaccatcggcggagaactgctcgcccaccgtgtacttggtctttgtcggctcgctcttgacgcggatgccggtgatggacggctcaaccggcgtatcgggctcgccgacggtcaccgtaatggtcaccgtgcggttggccggagcaacctcctgatccttggtcagcgacatgtcgagcatgccgttggcgcgcacgttcacggccttggcccacgtattgcggtcctgatcgaacaggccacccgctgcggaaccggagtgaatttccgggtaggggcgtgcgtggtaggccatgacgatgttgccggcctcatcatgtgcaagcgagatgtggccggggccggcctgcttgcgctcgtacgaggcctcatccgcaccgtaggcaccggtgtaggtgtcattggtgtcgaacgacgggaagtcggccgtggtccagctcgacagatcctgcaggtcggcattcttggcggcacgcatcacgttggtgttgtaatacttatccaccgtggcacccgcataggcaatgtagacgtagtcgccatgttcgaacatgaacggtgcctctacgattgcctgatcagaaccttcagagttgtctccgggggtaggcgcatacttgccgtactcgaactgctggctgacctgatagatgtgctcaaggctgccatccaccagcggagtgacgccatcgcccatctttgccttggcaaggtacagtcctgcgctcttcgggaagagccagtagccctgggccttgccgttctcctcgcgctcgaagtacgtcacgtcgaatgcggcgccttccagcacggtcggctcgccccagttttcggcctcgaggaatccgccatccttgatggaccgctcgtcgccggtgtacgggatgaggatggtgttgttgcaccagccaccgttcgtggacgaggcacccctgtggaagccggccacaatccaccacttgccgttaatcttgtggaactcctgggcccaaatgaacgcgctccaaccgtagaacgagttggggtactggtcttcgtggcccggagtgccgttctccggcttgatgatgatgtgttcctcagcatccttcagaccgttgatggtcttggcgcgcttgaggccgatggaacggtagctgtccttctggttgttggtcgaatcagtggactttacctcataggtggaaccggtgaggtagtagtagccatcgtcttcgttgtagaagatgtccggatcggcgcgagcgtcgttgtacatggcctcggtggtctgctgaacagtgcccttgacctcatacgtgccggcctttgaggtgtccacggcggccagatcatcggcgttccagtcgacgttgaaggtcttcgtggagccgtcgttgtaggtcattgtggcctgcgttccggaaaccgctgcggtgacgtcctcggcggaagcaccgttctccacggttgcgccgcccagagctttaacgccggtgttctgcagatcgacatagttcttgtagaacgcatcgaattcagaggagctcacagcgaatgcgcgggtctggccttcgccggcccatgcgggcagaccttcggtcacgtcgcccacacccatcgcaaccgcgtcggccttgagcgtctcgccgaccgttgccttggcagtcaggtcggagagcgtggccatacggccttcgccgctcaggccatcggtccagaagaccttgtagcccttggaggcggcatcatagacgatgcgcgggttggtgaccatggagctgtcggtcacggtgatggcgcgctcgttggtgaacgtggcaccgtcgcccttgccatcccacacgtaaatcgcaccggtggcgttgttctgcgaggaaaccacaccaagggtaccgtcctccgcacggaagaaagcgggtgagcccatctgcgcattcagcttggcagactgcgagccgtcccacttgaccgacagaatcgactgcgaacggttcaggggctcccatttgccgccatcggcggccttggcggccacgtacagcgagtcggcgcgacgatcgtcgttgtaggcgagcgggtcgtacttggcaccgttctggtcggagcgatcgacatccttgacgtaggaagcgatttcgccgccgttgttgaggatttcggattcggcggtgatagctttatccacgccgtcgatggtggcggtgagcttgacctttacggccttctcgccggacttcggctgcgtgaccttgccgtctgcggctacgagcttcgcaccgtcgccggtcgcggaccaagtaaccgtcttgcccagcacagtgctcggcaggtcgccggtgatttgcgctgggatggcgagcgcagcggcgtagtcggtcttcgcgctttccacgccaagctcgtcgtcgctcagggccttgccccagatcttgaggttgtcgagcagaccggagaagtactcgccgttgctccagttggccttgccgatctgcagcacgccgccatcagcaccgaggatgtcggtgagcttctggccgttgttgttcacggctaccagcttggagtcgatgtacagcttagcggttgcgccggaaatcacgatatcgacgtgcttccagtcggcgttcgtcttggtataggagacgttgccggaggaatcgcgcttgccatcgttgttgttgtagcgttcgacggtaataccggtggtcttgtcgagcacgccgacgtagtgctcctggccgtactcttgcttggtggcgttggaggcggcgaagaaggtccagccggtgttgccggaggcgtcgggcttgacatcgtagctgatggtcacgtcgttcttgcccttgagcagagcgtcgccgttcttggcggtgacgttgagccagaagttcttgctgagcttcgcggccttgccatccttgccgtcggcgagcgtggcggtgccctgagtggcacccgtcgcattgccgccgtcgaaggtctcgccggcgttctcgaaagtgaagtcggcgagcaaatccgggtcggtcggctcggtttcgccggtcacggtcaccttggcggtcacagtgatggcggtggagctgtatagcgtgcggttcttgttggcggtttcgttgtcgacaaaaccaccggtctgcttccagttgttgttcgcgttcgcaccggtgttgatgaggtcgtcctcgtcggtcttcgactcgccggcggcgttcgtccacttccagtggttcttgttcgcgccgatggtgtcgaccgtgccggtgacggcgtactcgccgggcttggaggcgtcgacgttagaaacgtcccacgtcacgtcgcgcttggcagtgccgtaaccgttggcaagagtgacctgctgcgtcttcggcagcttggcagtgatgtccgtatcggcagaacccttatccaccgtcacatcctcggccttcaggtcggcgttgtcggaagccttggcatcagccgcgcgaatcgcgtcgtactgggccttggtgagcgaaacaatgtcaccgtgcttggtgttggcggtgaggaagtagtcgtcggccttcaggacgctccacggattctcggaatcgaggttgtcggcttcgagtaggttgtagccgtagcgggcaccggaggcgacagatccatagttgtcaacgaacatgtaccacttgttttcaccgttgaccttgaaaccgttggcaccttcctgcgcgctgccgagcgtgtgtccgatgttggtctggcgcaacacccagcccttggccgggtcggtcgcgtactgaccctgatcgttggcacgccaccaatcggcacgatcggtgtattccatgaagatcacgccggagccggtggtgcggtatgtgcgggaaccgttctgcagcatcgtggtgtcgatggtgttgccacggttgtacttgctgttaggcacgaagacgccgccaaacatgtaagtctcgttggtgaagtccttggtggcggcccacagcacgtgagtcaccttcttgccgggctgactgttctcgccatcgtatttggcggagacagaccaatacacaacgaatgcgccgccctgctggttcttcgggttgtccttatcggaaccgttgagctggccgtcgtcgttgagatcatagaagttcggcacccacgtagcctcaggagcccatgccatgccgatctcggagatggtattgccggtcacggaatcggtgagcgtctggctcttgttcggattggcagtgtacttgtcggcggtggcggtctccagttccgtcatgtcgttgaagtgaatgagatctttggacgaccacacatgcaacttggtgctgtaacctgtagcccacgtgccccaaccggcattatcgctgccgaacacacgcaaatcggtggccagcacgtagtaggtcttcgactcggggttgtaggcgatgaacggatcgcgcacgccggtggtggattcgttactcaccagaatcggctcgccgccgttgagcgtatcccactgggtggcgtcatcgccgcgcgagatgtcgaggtagatcttctcggcgtagcccttgttgttttcgatgaagtggaccatcacgtagccgtaggcgtcatcggccttgacctcggtgacggtgaccttgagctcggcggtcttggcggcgtcagcttcggaagccgctgtaatggtggcggtgccggccttcacgccggtgaccttgccgttggcatccacagtagccacagccggattattggattcccatgtcaccgtaggctcagcgccttcaggggtgacggttgcggacagggatgcggagttgccttccttgagactcagcttgccgtccttcacattggaaccggagatctcgattgcagtaggcgatgcgatgccgagatcggccgcggaaagtgcggagccataaatcgtgagattgtcgagcaaaccggtgaagtattcaccgttgccccagttgcctttgccgatttgcagcacgccgcctgagccgccaagaatgctcttgagatcctcgccgttcacgttgctcgccacgaacttcttatcgacatagagcttcgcggtcttgccggagatgacgagatcgacatgcttccaagcatccttcgtaccggtgttcttgtcgatggtggcgatgtcggatgcgcggccgttgagatagcgttccacgcgggtcttgtcggtgcggtcgagcacaccgacgtaggtgggggcgctgccgttcaccgcaccggcggtcggcgcggcaaacacagtccactggccaccggtcgcagccgccttactgtcatagctgatcgtcacatcatcaagaccgttgagcagtgcactgccatcggacttggtcacgttcagccagaaaccgctgccgagctgggcggccttgccgttgtcgtcatcttttccgttgatgagattcgccgtgccttgtacggtggccttagcgtcaccctgagcactggcgaatgcaccatcgtccgggtcgctattgaaatcgaagccggcaagcgggtctacagccgcagcagcctgagcatcgctcgtctgaacggattgctgcacctgaggtgtcgtatcgtcagccaacgcggtgaccggcgtaaccagtcccacgctcagcgttgataccgcagccaagcaggccgtcaatcgagtaactctcctcatcgagtttccttcctcgcatccttgctagattgttatcaaattgttatcgctatggcgcttggccactcctttatcggccacttttgcgtctccttgtacgaatcagcacttcctcgtttgctgattcgcattacatttgactgcgcttgcccaccaatccgcccctacgaacaacaccgttttccggggacaacatcgatgcgctatagcacgcccaaatgtaagcacttataagtttagtgttagcgttcactggtacggtacacaggttctacagcacatacatttagcatgaccacaccaatgcaataaaaaaaatgacgcatgtgctgttatacattaaaacgcacagaaaatcacacatatactgtgcgattttctgtgcgttgcagtgagcagctactcagttatgcgcggcgcttgcgccagatggacagcgcaatgccggcagcggcgagcagcaccatggcaccgttcacgccatatacggcggcaccggtggccggcaacttgccgtcagacttggtgtcatcggtcttgttgtcggtcttgtcgcctgcgttatcgcccttgttgtcaccatcgccggtatccggcttggtgggcgtttccgccttctgcaatgctgcgatggcggcgctcagatcagcggcggccttgtcaaccacagcctggtcggaggaagcgagcgcagccttggcggcctgcagtgccttggcgagcgcagcccaggaatcagccgtgtaatcggattccttgagcgcttcggcagcggcgatctgcttgttgagctcagccaaatcgaccttgccctgctcgatgccggccacctcggtcgaggaggggtttaccaagccatcggtgtagccgtcgtaggcgaccgcaacagtgccagagatggtgaccgggagagtcaccgtgaccttgccttcggcgtcgagcttcacggtcttggaccagtcgccagcagagaatttcaccgagccggcgagcgtgcccttgtcagcggcggtcaccgtggcggtgagttcgcgggtttcggcgttgtactcggccttggtagcggagtcaacagcgggcagcgtggtcggggtggaggtattccacttgtgcatgttctccgcgatggcagcggacacgttcacgaacgcgccgtggcgggtcggagtcggcatgttggtcggggtcaccttacccgtgacattcggcccccactgcttctcggtaccccagccgtcggtggaggacagacggttggtccagctggacgccgcgatggcggactcggaggtcatgtacggcttgtatccgccggagtcggccatgatgatcatcgcatcgccagcctcattctggttcgggtcgccagcattgagtttgatggactccgggccttcgaacggcaggatgttctggtcaacgagctgccaggtcttggtcgtatcggcgttcggatcagcggcggcggtggtgcaagtcaggcactgggaacgctcaaggaacgtggacttgccgttggtgatgtaatcgccggccttgccgctttcctcgttcttggtcaggcgatagtacatatcgccaatcttgaacacggtggaatcaatgcgggagtactgggtatcctgccacttctcggccggagtgaacgtcttgaagtcgcgggtggtggccatcacaaggatgttgtatgcgccgttggtcttcgagctcttcactgcggtggcacgggtgtcatcggtgtattcacgcgaggaccagaacaccacataggagttcagcgcgtcatcccagaaagcttccggtgcccaagtcatgcccatgttgtcggcgttgaccttgataccggtgtcgccgtcctcggcgttggtgcgagtccagttcaccatatcggtggactcccatgcttcaagcttcagagagccatactgttggttctggccccagccctgcgaggagaccttgaggtcggtggcgatcatgtagaacttgtcgccatccttggacttgagcacatacgggtcacgcaggcccttggtatcggtgttggagacgataaccgggttgccgctgttaatctcgctgaacgagaagaagttgttgccgtcggtggcggactcgtacagcgcctcaccgatcttgccgttggtggtggccgcatcggaaaggaaggtcacggccgcataagcgccgtccggaacggagcgggtttgctccttgacagtgacttccacggtcttggtcacgacctcgccaccgttgtaggaggcagtggcggtcagtgtgacaggcttggaatcaccgtcgccgtaagccgggcgagtcaccacgccggcacccttatacggatcggccataccgttcttcggagcctcgtacttggcgtcagtgccggtaatgagcttttcatcagaggacttccacgtaatcgcagaaccattcttggtgccttcggcaactagcggcaggttctcggtggtggtggtcttcaacgcggaaatcgcggcgttgaggtcggcttcggcagcgttcttggcgttcatcggctcaacggtgacgggcagttcggccttcacaccacccagctcagtggtggcggtgatggtggcagtaccagccttaacgccggttacagtaccgtctgcggcgaccttggccacggactcatcggaggaggaccaggtgacgttcttgctcacggcgtcgtccggggtgacggtggcggtgagcttggtggagtccttctcaatcagggtgagcttgttgttcaccacaccggtgccggaaatcgcaacggcggtcggcatggtcaggtcagcgcccctgtagaccttgatgtcatccattgcaccattccagtactcatcgacggagtagaacgacttgccgatgtaggcggtggtcgcgccgagatcgctcatcttgatgccggtgttggccttgaaaataatcagggcattgttgcggaacacggcaaggttggtgccgtccacgacaatcttgtaatcggcccagctgttgccgttgccggaaacggtgaccttggatccctgttcgttaccccagttgttgttggagataacgcccttgatggcggtcttgctgttgtagaacatcaggtacttgttggcgttggactgatcggtggtgttggcgtcgttcgagccgtccttgccgacgatgaacgagaagaacttgccgctgtcgtcgtgacgagtcttggacgcgaactccagagtgaaggagtcgccggcgtccttgaacagctggtcatcgatctgggcgtactggccatcgccgcgcagtgagagcgcctcgttgttgctgcggtcaccgtactgttcgatcttggcgttgtctttcagcgtcaggttgtacttgccggtcgaatcggcaatcatgctgttcgtggtgccgtttttgcccgtgaagtcccagctggcgagcagcgtcggttcagcagccttagtagtctgcactgtcgcggtatcggttgtctgtggttgggaatcttccgattccatggcatacgtcgtcggaactactgccaccatcgttgatattgcaatcaacgatgctgccatcttcttccaatgcttcaccgcatctctccttgtcctttgcctcgacccacttgtcgagtgtctcgttcgcctctacgtgaacgcaaacattatttgcgatgataccattacggcactgagactcagtgtgccagattccttatgtatataagcacttacgggggggcaaccgcccagcccgaacactccccgtatgccaaaagcccccttccaagccaatcactaatacccctcaatcggcaccccgctccgccagccgccccaaactgttattaatttgttatctttaccgcgcttgcgtggacagagaacgctcagacctcgaagatcgccgcatattcgtgagaacccgcctagtcaatgagatatggcttgaagacacgctcggcgacggggatatggagcatcagcatggtgccgtaaccaaggatcaccagcaggaacagtccaccgggcatgtggaaccagctggccaccagcagcgccacgaacacggcatccacgatgaccagggccacggtcatcgcgatgtgggagatgccgaagatgaaggcgttcttcaaggtgccggccacggtgttctcgaagcgtgcctgaagcgcgaacacccattcgaagccgataagccagaggatggtcagcgcgaatttgatgatgagcagcggcgtgatctgcaggacgatccatgaccagaccagtgcaatcagcaccaccaagaacggcagccacagcagtgtggctttgatgaagttggctttgaatgacttgaagtagttggaggttacgcctttgccctcgccctcgatggagcggcggcaagcatcatggccggcagtcagggccgcaccgatggtgatgatcggaatcgaagtgaccagcatcagaatgttgatccatacgccgtcaacaagattgctccacgcgcgcatgaatttcgagtccggtgccagccagttcatcaactactccttgtacagcttttggctcccctcagggaggggagccaaattgtcgggctcaacccttgaccgcgcccgccatgacaccagagactatatacttctggcataccaagtagaagacgatgatggggatgatggccagcaccaggcaggccatcatggctcccatatccacggaaccgtagccgcccttgaggtattgcacggcgaccgagatggtcttgtacttgccgaggtcgagcgtcaggtacggcagcaggtaatcgttccagatccacatggcttcgaggatggccaccgagacgatcgacggcttcatgatcggcaccacgatctggaagaagatgcgcggcactgacgcgccgtcgatcatggcggactcctcaagctcctgcgggatgcccttgatcacgccggtgaagatgaacacggccagaccggccccgaaaccgaggtacacgatgcacaggccccacggggtattgagcttcagcatgtcggcgatcttggagagggtgaacatcaccatctggaacggcacgatcatattgaacaggaacagggtgtagagcagcttcgcggcccagttgttcacgcgcacgatccaccatgcgcacatcgcggtgcacaccagaatcagcgccaccgagccgacggtgataagcagcgtccagccgaaggaagcgaagaactgcgtggtctcgatgccgcgcacatagttctcaagtcctacaaacgctttgccggtcggcagggagaaggcgttcttggagatgtacgccttctgcttgaaggagttgatcagcaccaggacgatcgggaaaatccagaacagggagacaacggcaaacagcacggtccataatgcgccatgcttcacaggcttgttctcgttcatcaggctgccacctccttgctcgtggtgagcttgttctgaatcagggcgatgaccgcgaccaggatgaagaacagcacggccttcgcctggccgacgccttcccagcccatacggccgtagaaggtgcgggtgatgttcagcgccagaccttcagacatgttgctcggcgcaccgttggtcaatgcgaggttctggtcgtagagcttgaaaccgttggtcacggtcaggaaggagcacacggtgatggacggcatcatcagcgggatgatgatgcggaacatggtctgccgtccgttggcgccgtccacggccgcggcctccagcacatcggtgggcagggcctgcaggccggcgatgtagatgatcatcatgtagccgatctgctgccagcacaccaggatgaccaagccccagaacccgtaggacgccttataggtcagggcgcggccccagtgggccagtacgccgttcaggagcagcagccagatgtagcccaggatgatgccgccgataaggttcggcatgaagaataccgagcggaacagcgtggagcccttgatcgccttggtcagcatgtaggcgatggcgaaggcgatcacgttgatcacgatggtggtcacgatggtaaacgcggtggagaagccgagcgcgtgcaggaattccttgtctttcaacgctttgccgtagttcttaagccccacccattcaccgtcggtaacggtggtgaattcgcagaagcttaagtagacgcccatgatgaagggcaccaggaacccgatgatgaatgcggcgaatgtggggagcgcgaacagcgcccaccacctgcgtatcgccttgcccgccatgctgatcatgacttttcctcctccttgagtccgctgcgttgtgacactgcatcgtgcgccggctgcggagttcaactcaatgcgagcttgccgatcgagaaccgcatgcacggcctgttctcgttcaagcctatgttcatagtaaacgtcgaatcattatatgtcaaacgttgtcattttaggcgtttcaagttcgagcacactccggctccagcaatcttctttcacctaagataatggccatataaagccaatctaacgccgacatagacactttgcaaacgtttgtaatacaatcgttgtcatcgccgcagatcaatcaatcagcatgtacactggagtcagttgtgcatgtgtattgcgattttccattcaacgcaagggggctgcaatggctacgagcattcaggatgtcgcccgcgaggccggcgtctccatctccaccgtctcacgttccttcaccaggccggatctggtgtcggccaagacccgcgagcgcgtgctcgccatcgccgacaaactcaatttctcactctcccgctcggctgcggccctgaaatccggccgctccctgcgcatcgcagtactgatgagcggccatatccgcctgtggttcaccgcctcggtcatcgaggggctcaacgaggtgctgcacacgcagggctacgatatttcggtattccagatttccagcatcgaggagcgcaaggaattcttcgagatgttgccggtacgccgtaacgccgatgccgtgattgtggcgtctttcgatatcgacaacaacgaaatcgcgcaactggcttcggtcggcgtgccgatcgtcggcatcaattcagtcgaacccgaagcccgcggctttaccgccgccgtcaatatcgacgacgtgcagggctccacgctggccgcccgccatcttatcaatctcggacatcgccgcatcacctacatcagcaccaatcgcgaggtgtcgctgagcttctccgtgcaaagccgattcgactcattcaccgcctgctgccgcagggaaggcatcgagccgcaggttatcgtctgcaaggtcgatgacgatggacgttatgaaatcagcgacgtggtcaaccaactcataagccaagacgagatgcccaccgccatcgcatgccaagaggatggcattgctttgccgcttatgttccagctggagcgcaatggattctccgtgcccggcgacgtctcgttgatcggctacgacgatagtttctacaccggcgatatcggcctgaccaccatccgccaggatccggtggaaatggcccgcgtggcagcccgcatgacgctcgatctcattgacgaaaagccgattgagcaaccctacatcgtgttcccggcccagctgaaggtccgctcctccacctcccgcgttaagtaggctcacacaacaaagcccaccatggaaaaagtgtgaggcaaccgcacagtaacgctcaatcgcacattgtggagaatggcgaaaaatcgccgattcatggccccacagcgtgcgattgagcgggtgcgtgcctcacacttttctgcggcggacgattttgtgcgagactcagcaatacaaagcggcgcccctggagaaggaaaggcaggggcgccgcggattgttgcttatcggctatgggactctatgagactcagtgcgaggcctcgtattcggaagcccaaccgtccacgaaggcggtcttgacggcatcccacttgccggtgccctgcgcgtactcgagcagtgcctggccgaccttgttcttccactcttcggacggcatcatggtgaagttccaagaaacctgggtcatgccggacttctggtcttccacggcggcttcggtcagcgggttgtcaaacttgacgtcatcgaaggtcttgaacggggtggtgaagcccatgtcctgagagatggccttcttgccggtgtcggaggtgatcacccaggagaggaagtcctcggtggccttcttgtcggcgtcggaggccttgtcgttgatgcaccagtagttctcggaaccagtggccaagccctgcttctcttcacccttgacaccggtgtagattggcatcatgcccacggattcggccttcatgccggccttctgcaggtcggtccaagcccaggtgccgttctggtagaaggcggcctcgccgagcgcgaactcggagttcgcatcatcgccggtcttggcgctcagctgggtggggtcggtggtggagtcggtgatgtacaggtcgaagatcttcttgtagttcggcagataagtgcccttgatggtggccggctgctcggtgacgttgtcgtccttgaactcatagtagagcggcaggttggccagatgggtcttgaatcgccagtcggagctggagtcgaagccggcggaggtgaacgcgcccttgatgccgagctcgtccttgcgggcctgcatgtcgtcggccacggccttcagggtgtcgaagttgtcgatttcgtccatggacgtggctttggcaccatccagcgcgaagtatttgttaaggatgtccttgttgtagatcaggccgtaggtttccatcacgtacggcacaccgaccaccttgtcgccgtctttcagggccacgtcctggttggtgagttccttatacacatccgtgttggacatgtcggcggtgtacttcttccagttctggtagccgaccgggccgttcacctggaacagggtcggggcctcggtcttggcaatctcggacttcagggtctgctcgtaggtgccggaggccgcggtctggaccttgacatcaacgcccttctccttggtgtactccttggccagagcggcccactgatcagccgcttccggcttgaagttcaggtagtagaccttgcccttggcgtcatcgccggaggtcgagcttccgcaggccgccaaagtgccgagggacattgcagcgatggccgccactgcgaccgctgacttcactgtacgattcatcatcgaacctttctctttcatcgtcgacccggccatccccggtcaggacaggtacgctaacacgcacctttatgactatcgacatgcactattgtgcaacggtttgcttctttttgcaaacgatagcaatatcggcgcgtcataaatcatcattttcaggccattgtcaacaaatatcccattgattcggtcattttttcctcattatcgcaatgcaagcgttcgcaattatgagagcgctaacatatctttcatggcaatcgattgtcacttatgcccatcaaaaaaaacacggcgacgctatcgtttgcaaatcatttatcgacataccgcaattcccaccacaaacaataaaggcccgcccgcagcagcgggcaggccagcgtaatcacagcgcaaccggggctaggcgttccaccgttcgatgacgttatctcccttatagacgctgagcaccgagtagtgcgccgtatccaaacgcagcaaccgcgcgaaatgcgggtccacgcccagccattgcgaggtgaggatgcgcaggatgtgcgcatgagccaccaacagcacattatggccgtctttcagcagcggcgtaatctcatcgatggcgctcttggcgcgtaccgctgcttcttccagcgtctcgccaggcccggcatggaccggcacctgctcgcccgaaggtaaggtctcgacccaatcgccctccagcgtgggcgtcagcgagcgcggcccgtcacgccacacatcccattcaaaaccgctggcctcactcacctgctggcgcgtacgcccctcggctcggccataatcccattcagcgatgccgtccaacacaccgtggtccgcaaaaccggccagttcagcggtttggcacgcccgcttcagcggactggaaaacacacagccctgactgaatccttcggggaaagcttcgcgcaggcgccttccggcatccgctgcctgctgctcgccgaccgcggtcaacgggatgttcgtgcgcccggtatgctgcccggattcgctccacacggtctggccgtggcgcagcaacaccaaaaatccgttgccgccacgagagttctcgacggcaacggtgccgttcacgttctgttcgctcatgcctccactctagtctgcgctcgttcatgactccaccattaacgcccatcttttgcgctgagatgattgagatgctattagactgagagtcatgagcgacgaaacgaacaccgacttcccctccagcgccgaccgtgcggtcgacagcctgcaccgcatcgacgagaaggtcaacaggctgcgcgaggaccggctcaacgaccctgattctctgggcgacaagctcatcaagtcggtagtcccagcgctggcaggcttggttgccggcaaagcattccagatgatatgggacaagggcacgagcaaacgcaatctgcgcaagggactggcggcagacgcgccgcaaggtctggcaatgagtctggcattcgccgccgtttcggccgcactcggcgcagtggtttcgcagctgtcggatcggggctccaaggcgttcgtcgaccaccgccatcgcaagtccagccgctaatcccccggttggatgatggtttctgttggttgactgatggctcatcgctggaatttcgtcaaggaaccatcagccaatcgacaggaaccatcagtccagcacagttccgccacacaatatcggcatttcactgtgaggtaatccaccgtggcgtccggcgtctgccgtgcgacaataaaaccatggttaccaacgcaacaatcgaggctcttctgggccgccgctccatccgtaagttcaaggacgaggccatcgacgacgatacccgcgccacgctcgaaaccgtcgcccagcatgccgcgtccagccagttccttaacgactggtccgccatccgcctcaccgatccggccatcaaagccaagctcgccgaattcggccatcagccgtatattgccactgcgccgctgctgtacgtgttcgttatcgacgagcaccgcaacgcgcgcatcgccgaacgcaagggcatcgatcccgcttccgacgaattccatctcaagtacagctatcgcttcacccaagctcagaacgacgcagtgctggccttgcacgccatggagaccgccgcctattcgctgggactgggctgcgtgattctcggctctctgctcaacaacatccccggccttatcgacgtgctgaatctgccggaatacacgtatccggtgctgggtctggccatcggcaagcccgatcagaacccgaccgtcaagccgcgcatgccgcgcacgatgcagttcttcgagaacacctacccggctgacgccgatggcgtactcgaccagctgcccgccttcgacgaggaagttcaccggtactacgatctgcgccaagccgaccgtccggtggacgccttcagcgatcaggtcgccacgatcagccagcaggatgtcagccatcagacactgctcgacaaggccgccgctcagggcttccgtctggatcagtaagaccagaaccaacgaaataggctcggatgggctcgtcactgagtcgtctcagtctcagcactgcgacgactcagtcccaacacctcaacatttcatcaccggataccggcaaaattgcacaaccatcccgccggtgtcgcaccatcaataaacgtccacatatcagtcccactatgcggacaaccaacggccagttttgcaagagaacccgcaaaaccagcagtatccgcaccagtggtaggaatagactgcatgtggccgcaatgactacgaaccggaaaagagggactggatgcggaaggtttggcaagtctttctgcgcgattgcagacgtatcttacgcaatcccgttgccgttgtggtgacgctcggcgtagcaatactgccctcgctgtacgcatggttcaacattctcgccaactgggatccctattcagccaccggcaatctgcaagtggccgtagccaatgaagaccaaggcaccaccaacgatctggtcggccatctcgatgcgggccggcaggtcgtcaagaaactcaagcagaacgacgaactcggctggcgcttcgtagacaatgaggaacaggccgtacacggcgtggagaccggcgaatactatgcagccatcgtgctgcccaaggatttcagcaccagcctggtcgaatcggtgaccggaacctccaaacagccgaaaatcaagtattacgtcaacgagaagaagaacgcgatcgcgccgaaaatcaccgacaccggtgccaccaccatcgacgagcagatcaactccgccttcgtcaccacggtagccaccaccgttgcctcggccgtttccgaagcgggaggcgatctcgaccaagccaccggcaaagtccagcacgatacgatcaatgatctcaatacggtgatgtccacgctgaacaccgttcaggattcactcaccgacttacaggacacgctggcccaatcagacacgattctcgccgacgccaaacagaccaccgcctcactcaggcagaccgtcgcggccgcgcagaaggcctcccgccagtccggcacactgttggcggaaacacaggccgggtcacaagccttctccaccacactggtcggcgcgctcgacaccagttcagcacaactctccggactggccgttcacgtcaacaacgccgccggcagcatcaccggctccttcaacagcgcgcagaactccgttgacaccatcaccaacacactttcggccccactgaatgccacccaaacgtcaatcagcgatctgaaagacgcgctgaccaaagccggcatcggcaaagacaccaccgacccggtcggccagaacatctggaaacaaatcgatgcgctcgactcattgatcagcaaacagcagacacagctcaacaccttccataccgacaccacacagttcatcaactccggtaaagacgccaccacgaatctttccggagccatgaccaacaccaccaccggcggcatcgcggcgctgaataccgcgcgcggctcgctgaccggcaccgtaatgccgtcgctcacctcatcattgaacagtttcgccgccctgaatggcacactggatggcacgttgacttcgttatccggcaccttggatcaggccgacggactgttcgaccagcttgtcgataccctgaaccaaacaaaaaccaccatcagcagcacgcaggattcgctgcgccaggtggccagcgatgtcgccaccgtacgcaccgatatcgccacgctcgatagttccgccgcttaccagaaaatccgggatacgctgcatctggatgacaagggattcggcgacttcatgggcaatcccgtcaccctgaccacgaaagtcgtgtatgccaccgacaattacgggtccgcagtcaccccgttctacacgaatctggcactgtgggtaggcggtttcgtgctaatcgccatctacaagcttgaggtcgaccgcgagggcattcgccgtatcaccgctacgcaagcatatcttggccgctggctgctgctggtcaccatcggattcctgcaagccgtcatcgccaccatcggcgatctggtgcttggcatccaatgcgagcatccgctgctgttcatcttggccggaatcttctgttcgttcgtatacatcaacattatttacgcactggccgtggcgttccgccatatcggcaaagccatcgccgtaattctggtcattgtgcagatacccggcgcctccggcctgtatccgattgaaatgatgccgaacttcttccgcgaactgcacccgtggctgccctttacctacggcatcaacgcgatgcgcggcccgattgccggcctgtacgcgaaccattactggctcgacatgctgcacctgttctggtatctgccggcggcactcttcgtgggacttgtcatacgccggtatgcgatgaacctgaacgcgctgttcgaccgtcgtttgggagataccgacctgatgatcaccgagcacaacagcatggtgaacgaacaggtgagcttgaactccgtattccgcacggtgtccgacagcaaggaactgcgcgatatcatcgcccatcgcgcgcaccggttcttcgcacggtatccaaagatgatcgttgccggtctggcattgctgaccgtactcccgttcgtattcctggtgctgctgttcgtcacccaagagaaaatcgccatgctgacctcttggattctgtcgattattcttatcgacgcctatctcattgtggttgaatacgcacgcgaagcctacgccatgcagcttggcgtcagcgccatgagtgccgacgagttccgcaatgtgatgctcaacggatatgtgtggcggcgtttccacggccacggacgtcacgaagcggcgatgggcagcaatccggatatcggcgaaaccactgaacgactcgcaccgttcagtgatcaggtcaccgagccgactgcgcacaccgcacagtccggtcagtccggtcagtctgggcggggaggcgcacgatgaagcttatctggaaaatattcgtacgtgacgtgcgccaagccacccgcaatgtgatcgccgtaatcgtggctatgggattggcgattgtgccggcactgtacgcctggtacaacatcgccgccagctgggacccgtacggcaataccaaggccttgaaggtcgctgtggcgaacgtggatgagggctataagtccgatctgatgccgatcaccatcaacgtcggcgaaaccgtgaccaatacgctcagggccaatcatgaccttgactggcagtttgtggatcgtgctaaggccatcgatggcgtgaactcaggcgaatactatgccgcgctgattattccaaagagcttcagctccgatatgatgacgctgttttcaccgaagatcaagcacgccaagctcgaatactatctcaatgagaaaatcaatccgatcgctccgcatatcaccgaccagggtgctaccaccgtggccacgaccatcgaccagacattcgtgaagaccttggcgagcgtggcgctggatttggtttccaacgtggccgattacgcgcaaagcccgcaaatggagcagtacgtcaacaacgccaccagtcatattgccaccatgtcgtctcgtttgaccggcactgcgtcgcagatggattcctatgccaatctgctcggggccgccaacagcatcattgattccaccgataagctgctggggtcaacaggctcagctgcggccacaaccaaaaaggcgttgaaacagacccgcaacggcgtctccagcctcgacaaggcattgtccggagccaccgatggcgtcggtacggcattgcagcaggccggttcatcctacgacaccattgccaagcaaatcgatgccgcttttgccgatgtgggctcacaatcctcacagatatcaaacaagctaaccgatatgcaattcaaagtggaggctcaggctgacagctttggaaagtatgccgccgctttacgagatctcgccaaacaagcggcttcactgcccgtgggcggagataccgttgccgctcaactgaacgcggctgcagaccaagccacaaaggcgcagcagagcatgcagcaagccgccaccgcgttgggcgatgcggccacgcacatagcaaacggtactgccgatgccgatacagcgcgtcgagatctgaaatcacaaatcgctgccgccaaacaatcgattactcaggcttcagacacgtacaagagcacgctgaaaccgcaactgaacaatctgacctcgtccatggacgaagtggccacgcaggcaagttccgtaatcgacgggcttgcatcgaccgtcagcagcgtgtcaggcctttctggcggcgtttcagacagcctgacggacatccagtcggccttgactgacgcagctagcgctttgacccgttcggcgaagaaactcgacaacttgtcttcccaactcgcctctatcaccaatggcggcaccatcgacctgtctgtgatttcctctgcgaaacccgatgtcattgcttccatgctggcggcacccgtagcggtcgaccgcatcgcgctctatcccgttgccaactatggttccgcgatggctccgttctacacgattttgtctatttgggtcggtgcgatcattctggtcgccatgttgaaagtatcgatttccgaccatgagaaggctcgtatcttagggttgggcaatgatctgccgctcggttcggaagtgggtcttcgcgaggccatgattgccgggcggattgccggaccggccgccgcgttggatgtgctgaagaagccgcgtgccgaggctcccggcaatgcgcggcagttcggtttacgcttgcaccacgaatatttcggccgatacatgattttcggtttccttgctttgctgcaaggtacgctggtgtgcctgggcgatatgttctatctcggcgtgcagtgtgagcatccgattcagttcttgatggtcgggtggttgtctgcactggtgttctcgaatattgtgtatacgctgaccctgtcgttcggtgatatcggcaaagccattgccgtagtactgctggttatgcaggtagccggttccggcggcacattccccattgaaacactgccgacgttcttccaggtcgtttctaaatggctactgttcccctatgcggtggatgcgatgcattcggccatggcaggctcattcggcatggaatactgggtttccatgggcaaactggcactgttccttgtcccctcattgctgttgggacttatgttgcgcaagccggtaattcgcttcaacgattgggttatccgcaaccttgaaaacaccaaggtgatgtaagtgttggacgaagtgtgtccgagcgccctgaacgcttagcagcctacgacctgacgtgtttggaccgtaacctgtctcagacacggcgttggcgaggcctgtggagcttctgacgctaacgtctacgtggcttgtagccctttttacgactgtgtggcttgagttgctggttcagcggtacatgccggtaactggattgcggatcgcgatgcgtgagatgccagcatccgcaaaattcgcaacggtacacccatagctcaactccgcgctcgattaggctttgatcagcggcacgctgaacctgcgccttatcgtgatacatgattttattcgacgtagcgcaacgtttaggggtgaagtaatgcatagcagaagccagtgtagagcgaccccataaccaagccagtttctggctcccctcaggggggccgtccgcacagcagaccggggggggaggaggcccgggcgtcgggattccacggtcacggacgtgccgttttccggatttcctgcggaaatgggaacgcgccgcgccgtctctcttcggccccgacggcggggctggccgggaatggtcccggacgtgggtctcatgagtgcgagaagccccgggtgtttttgtgggggtgtgtgggtttgggtcgtgagtgtttcgggtatgcgaaagccccttggggcgtgtgctccgaggggcttcctgtacgtgtgatgcggcggcgtgctactctcccacaccctgtcgggtgcagtaccatcgccgtgccaggccttagcttccgggttcggaatgggaccgggcgtctcacctgggccatggccgccgcaaatcttctctt

SEQ ID NO: 32 - DNA, 32165 bp, Bifidobacterium longum
cctttccggtcctttctggcggagatacaagcaccatccagttaagaccattccgtggtcggcatgctctgcctaaacccgaaaaatcatcgtgactaaacccgcaacaactaattgaacacaaacaacagcatctgagcattcggcgaaccgcggagaggatcggccgggacaagtccacggtgtcacgcgagctgaggcgcggcctgtggttcgcgtccaacgagaacgggtcgtaccgtccctaccggccgaaacggctgaagaccgggccgtggacctcgggtccgttctattcggcgctggccgcgcagaggaaggcggacctgcgccggcgcggatcccgcaagccgcgtcgcatggactcggaccggcttcgcgcctgggtgctggactcgctgcgcagggggtggagcccggaactgatcgagggacggttgaaggcccggtacgccggcgacccgtcgatgcggatcagccacgagtgcctttaccagtggatctacgccaagccgcagcgggcgctggacctgcgccagtacctggcgcgcggcaggaaacgccggacgaggaaaaagggcaggaaggcgaaagggccgcgcatcccgatgcgcgtgcccatcgcggaccggcccgaggcggtcggatccaggaaggggttcggccatttcgagtcggacacggtggtcggcgccgcgccgtcgaggcgctgcatgaacacgcaggtggagcgcaggagccgcaggctgttcgcccggctcgtcgacgacaagagcgcgtccgccacggccagggccgaatacgagatcttcaaggacatcccgccggccgcgcgcgtcgaccgcacgtgggacaacggcacggaggcgagcctgcacatgctggtggacgaggcgctgggcatgctcacgtacttcgccgacccgtacagttcctggcagcgtggcagcaacgagaacaggaacggcaggatccgccgctatctgcccaaaggaaccgggttcggggacttggcccaggaggacctcgacgcgatcgtcggtgagatcaacgacaccccgatgaagctcctcggctacaaaacgcccaacgaggtatgggacgaggagatcgccaagctacaatcgaaggcagccagcccgaacacaagcgttgcgcttacaaattgaatccggcccgccgaggcattcgccgacgaactgctataattgcaggaccaacagggggtgttgcacctctaaatagacatcgggcacacggtttgcgcggcggtgagcagtgagcggtgagtactgagcgacgtacggcgactcacgtgcgctcacacagtggtgagcaatccgccaaacaacaccacgagcagagcgatggtttcaatcacgaagtacagaatgaaactcgcccagcttttggtcagtacgttcagcggcgaggtcttccggataatcaccagcagaccaacaaacaccagggcgtatacggcgatgccgatcgccgcccccataatgcccagattcgcggcatttgccagaccggcctgcttgccgtagaccacgtacgtggaataccagaaattgagattgagcatactgagtcccgcgatgaactgctcacaggccagcccgagcacgaacacgatcaaccacggccaggacggcgagacgaccaccgccatcgccaatccgacgtacgtgatcaccacggccacccaaccgaccagtgcgataccttgcggagacactcccccgagcacggccacaatggagtcagtattattcaccgccagcgagcgaccgaaccagtatggcgcgatgatggcgcacagtacggcaagaataatcaacgcccaacgcaacggatgggagcgacggcgctcgatatcagccaaagacaaatcggtctcgggtatggaagcctcggggtgcctggaaacctcgacggtctctactttgccgcctacgatttccgtcgcctcgttaggttcttgctcgttggattcctgctccatgcaccgcctcgccgattacctgcttattgccatgtattgccatgccgattattgcgatgcctatcttagcgtgcgtgttgggcaagtacctgatgttccctgtggtttcgcgcactgattggatacagacaggctactgctgttgcccgtctgtatccggcgacttgtccgccgctgtatccgtctgttcctcaggcaacgtattggcagcctgttccttacgccgcctgccgtgcagcagggcctcgagcatgtcgacctgacgctccagttcgtcgatacgacgtacctgctgcgaaatcagcaagtcgcgtaggtcattgttctgctctttgcgggagacggggaagatgatggcgcgacgttcgggcgatacgtggaaatcggattcgctgccggtaccagccggaagtgacgattccgccgagtcgcgccaagctctcgctgctcgcgcactctccggaatgtttggtgcgcccgcggctcccgagcggaaaagctccgaatctgaagcccccccccccagcttattttccacgccggctttggcattgccggagttcaggatttcgtcttgcgattcacgccagcgggcaaggcaacgttcgatgcgcttgtacccgattagagccggatccaatccggcttcacggaacatgcgcacgggtgaggcaccttcgttgtagtggactacacagtaacgcttgaaatcatcggtataggtgatgcgcttcgccgtggcttccgccactgccgacaacgacttcagatacttgatctcctcggggctaaaagtccctccaccactggtcatcctcatcccttacactcgttggaaagctcattgcacaccccccttgattatggggtgaatgccatagttcgggatagtaatacttataattcggacatgcctaacccctagtagggtcgtttttatccccgtttaagtggagcctgagtagtggctggacggcaactgaacgataatcagcccacgaatggggtatacagacccatccttcacccccctatgattgtgtccgcttggcgattgttaccgagcctgcgtgaaacgtttgttgtggcgaaacacaagttattttcgatgcccggccccattacattcaaatcaaaatgccatacattgcccataagattcggagatggcctacaagtcatccgtatgaaatgccgccaatatgacaaatggccgatctgaataatcagatcggccattgttatagctgctcagtcataagcagcagtcaagctcacgcgttgagagcgcgcttggtggaacgggacttgacgaacacggtcaccgcggcgcccgcgatcagcaggccgatcacggagaacagcgcggtgccagcggcaccggtgagcggcagctgggtgatgttcttgacgttggtgacctggaaggtgcccttgttgtccttggacaggttccaggcatccttaccagcgaaggtggcagcagcatctgcggttgcaccggtagtgatcgtgaacttgccaacgaaggtgccgttgtagccagtcgggaccttcgtctcaatcacggtgtaggtggtgttgagcttaagaccgttcagagtgtacttaccctcagcgttggattgcagtgtgtccgtggcgccttcagggtaagtgccatcagcattggcggtcggcagagaatacgcaccgttagagccattgaacttaagcggagtcttcgctttgagctcgtcagcggacagaccgctaacatcgccttcgtacacttggaactcagcaccagtcagagcagcagcgttcttgtcgactttctgccaagtcacggcaccagccttggtggtttcttccttgctgctcttcaggtcgacaacgccggcagcggcgagaacgccagtggcgttgttcacggacggcgcggcgcccgtgatagcagtgccagcgagaatcggagcattgccattccacacgagcttgtgagtgtcattatcttcgacgaccagctttccactctggtcgacaatcaagtacagaccaccctcagcgaaggtgaaggtctgggtcttgccaccgttagaagccgtcggggtaatgtccgtgacagccagatccttaagcgcgttcacaaaagcggtggtctgcgcggcggtcagggtagtgttgcccagccaggcccactcgttcagggaatcacccttggtctggtcgttgtaaccagcagcagcgaaagcagcatccactgcctcaccggagaccaaaccctccagctcaacgccagtgttgccatcagacacatacttggcgagctcaacgtacttgaacatgcgcaggttagcctgcaggtcagcggtgtcaaccggcttggtgtagaactggtttgcatccgtggcgttgactgtgatagtcgtgctggagatgttggcctcagccgcgttggcggtggtggcgccgaaggccatgccaccgagcagggtggccgcagcagcgacacccgcgaaaagcttcctcaacttcatgagaaaccctctcttccttattgtgattgattttcttgcaatcgcggaggctgcagacccacagcagggcctccgtgatccgcaaatccttattgttttttcgggagggaagccttcattgccccccctcagtccgccttcggcggccagctcccctcagcgagaggagccaaaaccacctcaagtttcttgaaatcagaccagctgacgcttacgccaaaccgtgtagcccgcagcagccagcagggccagcaggcccaggccaccgccgaacaccatccagtcacgaccagtcgtgccaccggtcagcggcagactggagatagccacatacttgttcgtgaactgtgccgactccgtattcgttcggtcggaatcgttctcgccgtactcgtaagagacaacggcatccgtcctggagaccgtgaccttgacggtcaccttatcgttgtcatacttccaaccggcagcaggcttttcggtgtcctccgaagcctcgaacgtgtagaccaaattgtcagcaccggtcggaaccctgaacttcaggtccccattgccgaagccaaccgtcgcgctcgcgccgctagcagtcaattcgtccttggacacagtcgtagtcagtccattgttggccaagccggtaacgtcagcgcacttaccagcattcgcatccgtgctatccacgcacttcaggttgaagccgaagtccgaattagcagcatgtccctgcacaaccttcgtcaccttgacatccgaagcgggcaaggtcacgtaagaaggcgtgttggttaccgtgaaggcaccggattgtgcggtcaaaccttgtagcttgaggtcagtcttatcaaccttggagtcatagccttcaaccttgacctcggaaaccgagtatgtgtgcccctcagggccggcaggcaccgtgaactcgtgagtccagttgccggcggcattcagagttgctgaaccgttggcataatcctcgccgtcctgcttgagctggacctgcacggaatcattcgcgtgattctcgttgtcgtcggaccaagtcttcgtcaccgtaatcttggagaccggaagggtgatggtcggcttctgcaggtaggcggcggtctgcggatcgctcgtcgtcgtgccgccctgcgaggaggtcaccacggtcttgtagtcgacagtggcgctggagttgtcgttcgtgtagaagttgttgtcgccggaggcattggcatcgtccttgtggttcttaacagcctcgtcgaacgcagcctgcgtcggcttgacattgaagctcaccgtgtaggtgacgccgtcctcaagcgtgtcgtcgttggacgtgaccggccaagacacggtgccatcagccgcaaccgtcgcctccggggcgtcagcccacgccgtggtctggcctttccgggtcttcgtgtacgtgaagcccgcgggctctccattctcggaggcgctgtcggagctcacgacccagctggacagcctgtcgtgaatcgtcacgtcggcatactcagccgtcttggtgatctcctgataaatggactcgaagatgttgttcagctggccggcatccgtggcggccttgtagtagctgctggtctcggcgcggtcaccgaggttggcgttccaagactttccccacaaatgctcactgctcgttgcagtggcatccgggtagttgctggagatgccgtgcatgtacttgttcaggttgctcgaggtgtcgccggggttggcaccgctgacgacgccgatcgagtagatggtcgtcccggcgtccttcaggctcttcgccttgttcaccgcggtggcggcgacggtggggtcaaacccgctgccgtggttcggctcgccgtcggtgaagaagatgacgaccttcttcgcgttggcgcgaggctgatacgttagcgccgcctgggcgcggtggcggaggtcgcgccggacgcgctcaggccgttaaccgtgctcgtcagtccggagacgtcgtacgtcaggttgctgacgatctgcgtgtagttgtaggaggaccagccttcgcggtaaaagtcattgccgacgctggtcttctcggtgccggcgaacttcaccagggcgatgcggttccgctggctctggtcggtaatcttcgcgttctctgcagccgtcgcattgatgaatttattgaccgcggtcttgagcgagtcaatcttcgtaggctggttccaaccgctagcgatcttttcggccatcgaaccggacacatccaacaccagcacgatgtcgagtggctggttcgtcacgatctcgcccgtacccgcgctcttcgcaccggtgacgttcaacgccaccgtgtacgtgccgtcttcattggcggtaacggtcttctcgcgggccggagcagacaacgtcggatcatccggcacgccgtttgttccctcggtggaaagaggagcaggcgcgctggcggccgccttctcatcggtggtctgcgattgtgtcgtggaggcattcccatcgtccgccatggcggtcgcgctcacaccggcgacgccaccgagcatcgccacggcggcaacgatcgccactaaccgtttgcctttcctgcccgccgcggcccctaccgctgcgaaccattctgcaattctcttcataaccttgcctgtctcttacgatcacgtacgccaaaacccggcgttacgcttataaggcgttgcggtattaagcaaaaagcacgaatgcgtacacccgggtagagggaattttttacccgacattgaaaagaaccttggaatttttgaaaagtggcaccctcgtcatccaccctgcgataacgcacttttcttctcgacggggcgtgccggtcccaccatctgggaactgaggcggatttgccgccgctgcgcgggggccggagttactgacgaccgtcagtatgccactgctccgcatgtgtgcagtatcacataccgctacgcatacacggagacatactacatgcaatttctgtgaacgcaaacatacgactcaccaaggccgtgttctgttgcgggcggtggtgttacgggcaatgttgtgggtagtaccctagccacaaacctatatagtggagcggatgacgggaatcgaacccgcgtaatcagtttggaagactgaggctctaccattgagctacatccgcgttaagcgtcgcttttggcgacttgagttattatacatatttcttcggggatggcaaacgcgtgtggctgcagcaggaccagccaatctagttgatggattgcggctttgccgaggactcccctcagtcacctacggcgacagctcccctcaaagaggggagctagaaaccgtcgaaatcacaaatggatgagctgggactcgtatggttggaggtcgacgtccatcgcgttcagaatgccgttgcaggcgttgaggtgggcgtgctgcgggtcgggcgagaagttgaacaggccgaccagcgtcttgccttcgtgctgacgaatcacagcgagcaccgaatcattgaacgtatcccacgtggacacccaagcgtcaggcgcgaagcagggatcgttgcgcatcgcgcgcaaatcctccatgcccttccacagctggttctgcaacgtaccggacttcttgcgcagagcggccttggtccagtcgaacttactacggtgcagattgcggctgtcttccacgcgatccgggtcttccttgtaatcccagccgttgagctgggcgatttcgtcgccgcagttgagcatcgggaaaccgcgcaggaagctcatggcgtggtgcatcatgaggtcgcgatccaccgaggtctctagcagtggcttgtcgtgcgtgatgatggccttttcgatgccgcacaggctggcggtggtgccgcaactgcgggcgtcgcgcgtggcttcgtcgtagttgtagagttcgcccatcgaccagctgccgggggttgcgccctcgtagaagtggtacaggaattccttgtgcttgagcgggtcgatgtcgaggtaacgctccacgtcttcgtccaagccccagccgatgtcgtcatggcagcgcaaataattcacgaaccagcagttttcgggcagcgagttgagcttgtcgatctggttcttgagcagacgcacgtcgcggctggcgagcgcgctccacaggttgaccatgatggagacgttgtacagcatgtggcactcgggggcctcgggcgtaccgaagtaggcggcgagctccttgggggccatgaccacctcgcccttaagcaccacggccgggcagacgcattccaaaatgatgcgcagcatgcgcacgatggtgtggacctgcggcaggttgcggcaattggtgccaagctgcttccagatgtacggcacggcgtcgatgcggaacacctcgacaccgaggttggccaggcgcatcacgctgcccatcatggctacgagcaccttcgggttgcggtagttgaggtcccactggaacgggtagaactgggtcatcacccacttgttcatcttctcattccaagtgaagttgccgggcgcggtgttcgggaagacctgcggcacatcccggtcgtagcggtcggggatggtgcggtccgggtagcagaagtaatagtcctgatactcgggatcgccggcttcggctgccttggcccagcggtgggtggaggcggtgtggttcatcacgaagtcgatgcacagactgatgccggcgcggcgcagcttcttggccagcgcggcgaggtcttcgttggtgccgagcttcgggtccacggtgtcgaagtcctggaccgcatagccaccgtcgttgttcgggtgcggcatgtcaagcagcggcatcaagtgcaggtaggtgagcttctgctccttcaagtacggaatcttgtcggcaagtttcttgaggtcgccggcgaacaggtcggtgtacatggtcatgccgaacatatcgccgcgcttgtaccagcccgggtcctgctcgcgggttttgtcgagacgcttcaaatcggcgggacggtcagcgtaggctgcggccatgcttgcgacgagtgcgtcgaaggcgtcgtgatcgttatataggctcatgaagagctgttcgagttcgtcttgatgagcagcaaggcgagcgttgaacacggcgctcgaagcgggacgcttggcggttgcggacttggtcgccgctgccttggaggtacgggccgaacggacggcagtcgtcgccttagtcgctgtggttctggccgtacgagacgtcgtgcgcttggttgcggttgtcttggttgccgtggaagtcgtagcggttttggccgctcgggttgatgctgtcttggcagccttcttcgccacctcggtcttctcgaccgattccactgcctgtgccgactggttgctttgagccaccggaaactcctttgtctctatccgttgcccgcgtcaatcgtttgacgctttgtattacacaagatcaaaccggttcgacaatcgcaacccaagactcgccgagccaccggcgctattccacagaaatcgtcaccaccgcggaggcaatcggaccatcgtggctcagggaaatatggatatgcggcatcgaccccgcaccgaaagccgagcgctgcgccgaacgcgcattccgccgctcctgcatcactgcataaggcccgttatcggaagcaggggaataagcagaggaatagcgagcgcctgcagccgaattcgcgtaatcagtttggaagactgacgccgtccccttacccagagacacatgcggcacaccacgggaatcatccaagatctcgatttcaggccacgggaaattatcaagcgtgaacggatagggggcatcgccaagataatcgcaccacgctttgaggaacgcctccttgcctgcccacttggcggacagatgcacggcctcgtcatcgttcttcagccgtgcacgatccgccgcctgacgtacctcacgaacggaaaacagcgagcgcatgcgcgagccgggttcagacagctgctcggcgaatgcggcgacgtcaaccacgtcatgacctaaaccaaatgtgcccatagcacctattatcagccattcaacacgttgacaacacatccagaataacgaggttcacacggaacgcggcatccacaaacggaaaccctcggccgctccgcaagccgaatcctgaaagtcaacaccaagtcaaactgttgactaacggtggacacggcgtaaaatgtcgatattccacccgacactccaatacgtaaatcgattgacgtcaaacgtttgactttttaacgcggttaacacaatgatccaatgaaggataacttcacaacaaccaaccacaaccagccaatgaagccagcaaggaggtagaaccgtggtcacgatgaagcaaatcgccaaccgcgccggcgtttccatctccaccgtctctctggtgctcaacaaccgcgatatcggccgcgtcagccccgatgtcgccgagcgagtccgcgacatcgccgccgaactcggttacctgaccaaccgtctggccagcgggctgcgcaccagcagtacccgcaccatcggattcctcagcgacgaagtggccaccacgccgtttgccggccgcatgattgagggcgcgcaagacgccgcccgcatgcccgcgttcttcgacaagcacccggatgtcgacggcttcttctgcttcaacgacacccgcgcttgggccatctacaccgaggccacccgtcgcgggctgattatcggcaaagatatcgcggtggttggcgtcgacaaccaccaggttgtggccgaagcgctggatccgccgctttccactgtggaactgccgcattacgagatgggctactgggcagtcggtaagctggtctcgctcatcgaaggcgaggcacccgatccctttcctcgtgccggatacccggtcgagaaggttcagccgccgccactgagcgagcagtcaccccagcttgaatgccagctgcgcatcaagcaatcctgggtccggccccgctcccagcgatagcctgcccaaaaatcacgcatctatcctacttgacccggtttcgactgtatatcgaaggcgctattgctgttttcgtgggtggtggttcgttgttgaaccgttgcgggagtaagagacgacgaaccgacatccacgaaaacagcaatagcgtcaaaaaacaatagggtcgggaagaacaccgtaaatgacgttcttcccgaccctaatcgcgagacactcccctcagccggcattcaccgaccgggggagccagaggggcatcaggcctcgtagtagccgtcggcgtcgaggcgggcgtccgggttgaggagcatagccttttcgacctcgtggtggtcgtagccacggtgatcctcgcggaagcgacggttgtcgatcggctcgtagagcgcggcgcgacccatcatgccttcctcaaggtgacgctggccggcggccaggcgggcgttggcacgctcacgccaagcttccagtgcggcctcaccatcggacttggccacggccgcctcgaaggcacccggatggaccagagccacgaagccggaaacatgtccgaagccgagcgaggtggccagaccggccttgaccgggcgaccagcggtctcgcgaccgaactcgtcctcaccaccgccgatgcgcaggggcttcctaacccagaccatgtggtcgtcgcgctggagcttcggatccacgcagtcgagcgccgcgttcgccggaatcacgccggacttgaacagctgcgtcagaccgttgacctggaagatgcaggcaccacccttggcgtggccggtaagcgtcttctgcgagatcacgaacagcgggttgccgtcggtgcggccgatggcgtgggccagcgtgttgtgcagctcggattcgttcgggtcgttggcgttggtggacgtgtcgtgcttggagaccacggcgatgtcgtcggctgagacgccgagcttagccaggtcgtgcacgagcttggagtccttgccaccgaggccggcagccagggcaccgaggcccggagccgggatcgaggtgtgagcaccatccgcgtaggagtggatgaagccgaccacggccgcaaccggcaggccgagcttttcggcgatgtcaccgcgggtcacgaggatcgtgccgccgccctgggattccaggaagccgccacggcgacgatcgttcgcgcggctgaagaagcgcgcgtcgatacccttgccatacatttcctccgagttggcggtggcgttcatgttgccgaaaccgatcacggattccacgccgatgtcgtcgatcgcaccggtgaccacgaagtcggccttgccgagggcgatcttgtcgacgccctcttcaagggagacggctgcggtggcgcaggcggagaccggctgaatcatgttgccgtagccgccgatgtaggactgcatcacgtgagccgcgaccacgttcggcagggcttcctgcaggatgtcggtcgggatctcgtggttgaggaagcggtcgaggtacagcttgcgcatcgacatcatgccaccgaagccggtgccctgggtcgaagccaccagcgaggggtggatggactcgaggatttcggccggggtgaagccggcgcccaggtaggcgtccacagtggtgacgatgttccacagggcgatcttgtcgacgtcgccgaccatcgaggcgggaatgccccatcgggtcgggtcgaagcccttcgggaactggccgccgactgtgcgggtcatggtggcgcggcgcggcacgcggatcatcgagccggcgtggcgggtcacgttccattcgccggattcctcatccggggcgatggtggtgtgagcctcgtccaacttgacgtattcggcggcgacttcgcgggtgggcacagagaaggtgacgtcgtggtcgaggaagacctcggcttcctcttcgtcagcaccgtccttgtagtcgttgcccatgccttcctcgaacgggcggatgccggagcgggccacgacctcgtcgtggtagcgctcggcgatgtcctcttcgggcacgaggttgccgtcggtgtcgtaccagccgggcttcgggctgtcggcccaagtcagcaggcccatgttccacgcgagttcgagcactgcgccggcgctgaggtcgacggtgccgtccgagtggatgccgagctcggcctgggcgcgcgtacgaccggagccccacgggcccagctcaccgacggaaacgatgacgatttcgtcttccggcttggcagtgacgttggtccaatcgttcaagtcgaccggagcctgcttggtgacgatcggtgtgggcagcgccttgatttgctgcccacgcgaggagtcggacagtccagtggactttccggcgacggagccatccgtttcctgagacgaggccgcagcagcttccttctcggcgtcggccatggcctccgcacgcagggccttgatgtcgatgggctcggagccgaggccaccggtcaggtccacatcgagcggggccttgagggcctgctcgcgcgattcggcagtgcacaggtcgagcagcttggccgcaatctgtgcggtggagtaggtgcggatgccgtgacgctcaacgacggcgaccagcgggtcgttaccgaccatcaggccggtgccacgcacccagccgatcttcgggtgagcgaaggtgacgcggctcgaccacaccttttcagcgcgggcacggttgacgatggcgtcaaaggcgctcttgacttcgccgtaggcaccgtcgccgccgaatacgccgcggttcggggaaccgggcagcaccacgtggagcttgtgctgcacgttggtgtcggcaccgatgtggctgaagccggcgatggcgcgttccacgccccacagcatcagtcgggcctgcgattcgaacaggtcgccggagtcggcgagcgtgccatggaccggcggagcggcgaacgggaagaacagagtcggctcccacgcgggcttcagaatcgtggtggtagcaccggaggtcttcttctgctcgtggcccacccagtcgaccagtgcgtcgacgtcgcggtagctggagaggttggccggaaccagccacagcttggcgttgccggtagcgtgctcgcggtaggcctgcttagcccaagccttaatggacggcttgaagctgtgcgaggtggccaccacagtggcaccgcctgcgagcaggccttcgaccacctgagcggcaatcgagttcgggctcacgccggtgacgatggcgatatcattcgcgtaacgggaggcgttcttgttggacgcaacctgttcgagggcctcggagccggccttctggaaggcggccttgagttcttcgctctccgactcgttggcgaaccactgggcttcggcggcgatggtcttgccaaggccgatgaagctgccgttcaaggcggcgggatcgttgtcgtagtaggcgcgggcgaggtcttcacgggcggaggcccaccgatcatcgaagaggatggccttgttggcgtcgaagcgcggagcgacctgcttgggccagtcggagccaagttcggcttcaaccgcggccacgacggcggcgttctcgtcctcggattcttccggagccggagcggccacgccgagctcgttcagcacgaagcgggcggtggcggcgagcacgccgttggaaccggtgaccttctcggcgaaggcgtcgagcgcggcggaatcgaccacagcgccaccagcggcaccaccggcggacggcagggccacggcaacacccttgagctgggcgacgacctcaacggccgcatcaatcagcttgtcggcttccggcttgttctgcacggcggcggtgggcagcttggccaggtcgccgccacgggagctggcaccctcgcgagtgtcgagcagcagtgtggcgagcacgctggccacccaaccttcaccgagctgccatacgttggtcacgcggtcgcggatgtactgctgcttgacgccggcggcaccgaacagcgagcgcaggcggtcgcgcagcgcctcggatagcacggcaccgaacggcttgtagttcggggcggccttgttgacgatttgggcgagcttgtcgagcgtcgcttcagcagcaccgtccacgctggcgactcccagctcggaactgatgtccatgagcagctggttgcggcgagaagagacaccgttagtcagggtgtcggtggtgtcgttgctgccgatctggtcgatgcgcaccttggcggagtaggccatgagcacgccgatggcatcggaagccttgaagggcaggtcggcgacggcggcaccggacggcgcgccggccgcggcctgccctgattgcaggccgcgtgaggagtcggacagtccagtggactgtccggcgacggagccatccgttgtctgagcagcctcagtcacggcatttgccggagcggcaccggaaccgagctcggcaacggcggaaccaccggcaggagcggtttcgaccggggccgaggccgcagcctcttccggctcatcgtcgggaaccagcgaatcggtgtcggtcatgtagacgcggccttcatcgcggccgacgttgtagacgaccgtatcgttgccggcgaactcgggcagatgcagggtcttggcaccgaggttggccagggtcggggcgttgccgaggccgacttcgacgtattcttccacgccgaggccgccctgttcgcgctgaccgaagagcagcgcctgggtttcaatccaacgcaccggggaggcgaactgccaggagagcagttcggtcaagagcagacggccgagcttctggtcgtcatcggcgtaggaatcccacacggccgggtcgtcgagcgcggccttgatacgctcggacggcacgacttcgaggatcttggcggcgaattccttggtcatctcgaacggggtggccaccaggttcgggatgtagcggtccaccagacggccacggtagtcgatgtaagcgggaagcagcgcgtcgagcttgtcgcggaattccggcacgcccttgcgcagcagtgtggagtggaacggcacatcgatgccgggcaccagcatgaacgcgggcttgccaccgaatgcggccacgcggcgggcggaatcggccttcagagccttgagtccggcgatcgtaccggcgatggcgtactgctggccggcgaggttgtagttcacgatctccaggaattcgccggacgccttggccacggattccacgtattccttgacgtgcgcgtcgtccacaccgaactggttcgggcgcagggcacccatgcggtagttggagcgaccctgtgcgtcacgctcgatgaggtggtgcatggtggaaccacggtggaacacgagctccagcacggtttccagcggaatcacgtcggcgaacgcggacaacgcgttgtattcgccgagcgagtggccagcgaagtatgcaggccagatatcggcgccggcttcgcgcagacgggcggtctgggcaaaagcaaccgtcgcgagcgccacctgcgtgaactgcgtcaggttgagcaggccttcggggtgacggtaggtcacgccgttggcggtgagctccttcgggttatcgcgcacgaggcccaggatcgagaagccgagcttggagcgggtgagcttgtcggcgcgctcccacacgtcgcgggcggcggcggacttggcacgctcgtccagaaccatgccctgcttctggatgccctggccggggtagacgaaggcggcgcgcggtgcgcggaccagtgcggtgccgcgggagacgagctggccgtcgatacggcaggtgacttcgagggtcatgccgccgtggcgcaccttgccgacgcgctcgacggagatttcgacggtgtcgtcaagctgaaccatgccgtacatgttgtaggtccagccggcaatctcgtagtgggcatccttctcgtccagcgcctgcacggcgtgctgggcggtggcggacagccacatgccgtgcacaagcggagcggccaaaccggagatgcgagcgccacgagtggaggtgtggatcgggttgaagtcgccggaagtgcgggcgaaggcggtcatgtcgtgtggggcgacgaccttcacgcggcgcagcagacggcgcggcgtgggcgcgatctcctcgtgctcggcgtcgccgaactcgggggcgtctgccggcaaagcatcggagtagacgcggccgcggatcgcgaaacgctcggtttcgcgggcaagcagcgtgccgtcggcagcggtgtgggtcacgtggatggtgaccacgcggccggaggcggactcgaagtaatcctcagcccaagacttcagggtgatggtttcaccggtgtgcttaagcaggtcctcctcgttcacctcaagttcgatgaggtggtcgaggtggacggcgttgagcaggccttcaatcaccgggtagcccttgacgtacacggagccgagcgccgtgtaaatcgccggccaggccgggccgaccagcgcatcgggagcgatgcggctgggctgcagggtcgtcggcagagcggcgccggtggccgcttcgtggtcgaagccgaggttggcggagagggtgtaggcggcggtggcggtagcaaacggacgctcgtcagaggtcttgccgtcaagctgcggcatctcggtgagcttgtcgccggtgatggcggtgttgccgatgcctgcggtggcggcgagcatcgcgtagacgtccggaatcaggcgttcgcggtccacgaccggcacacggccgggctcggtgccttccacggtgagcgggatgacgatatcgcgcacggcgtgcttggaggtgccgccgtccgggtcgttgtcccagtaggtgtcgaggtggatgtccagatcgtacttgccggccgcggcgtcaaacgcgcggatctcgtagtactggtcgcccagggcggtgccgtaggcggggttgtcggtgatgtggccgacccaggagatgttcggggacttgcggatgaagtcctcggcgctggtggcctcgccgagtgcggcgaaatcgtcgttctcagcggcatcggcggcctgctgttcgtcctgcacgcgcttgatggcggcggtttcgaagcggccgaggatgtcggcgatcggctcgtcgatggtggtgatgccggccacggagatcgggccggggatggcacgcacggaatcggcggagtagcgctggtcttcggactgccagagctggtcctgaccccaccaacgcagcaggtcgttgtcgatgacgggcacgaacggcatgggcttggggtattcgcgcacgagcaccgggaaccaagccacgtcggccggaaccaccttgagttcggcggtctgcgggtaggccagtgcgagcttttcgagtgcgggggccggatcggcgagaatgtcgtcgtgggtcagcaggtcagcggcagctgcctcttcagcagaaacgccatcagcggtgaacagcttggaggtgaattcgccggagtccgtgtcgttcacacgggcttcgatgcgctgcagtaggtgctggaagcggtcggcgtaagtcgggtcgacccacgggaaggcgagttcggcgaagcgctgcgcccactcaaggtaggtcatggaggccaggtctccgaagtaaggcttggcggtcttgttcagggcttcgatgatttccttgcggcgggagtcgagctcttcggggtgcttcatgacgcgcacgagcagacggccgcattcggcggagtcgttctcgagctcgtaaatgtcggcgtgcaggtggctcaggccggaggacatgccgccgacggacttgccggacggcacccagtgggcggcctgcggggcgaacacgtcgtcggacttggcgtcggccggaatgccgggcgtcttgacgagcagctgcttgacttcggggctggtgtgagcctccttggcggtcatcgcggcggtgccgataagcacaccgtcgaccggcatgtcgggcaggccgtaggcgtgggcccactggccggaaatgtagtcggcagcgcgttcaggggtgccgatgccgccgccggcgaccagcacgaggttgtcgcaggcgcgcacttcggcgtaggtggcggctagcaggtcatccagcgcttcccagctgtggtggccgccggcttcaccgccctcaacctgaatcatgatggtggtgggggccacggccttggcgatacgcacaacctggcgaatctggtcaacggtgccgggcttgaagctcacgtacggcaggccgtcagcctgcaggttcttgatgagctccacggcttcgtccagctcagggatgccggcggagacgaccacgccgtcgatcggcgcgccggatgcgcgcttcttgggcacgatgcgggaggagccgaactgcaggttccacaggtaacggtccatgaacatcgcgttgaattcgaccgtgcggccttcctccagctcgtcttcgagggcagcgatgtggcggtcgaatacttcggcggtcacctggccgccgccggcgagctcggcccagtagccggcgttggccgctgcggccacgatttccggttccacggtggtgggggtcatgccgggcagcagcaccggcggcttgccggtgagcttggagaacttggtgaccagcttggcgccggccggggtgttgatgacgcgcggggcgaacgccttccagttctgggtgcgctcaggctcgctttccagcatggagagcgtggagcgctcggccagcgtggtggcttcgaccacgccgatgccggtgccctgcaccacgttgccgatcagcttgccgagcgtgttgccggggccgaggtccacgatccacagcttggacgggtcggcgtcgtcgaacagcgccttgacgcgggcgttccagtccacgtggttcaggagcacttcctcggcgagtgcacgggtgcgcttctggtcgaagccgcaggcgccggcccaggccacggtctgttcgacggcgtcggccatgagcggcgagtggaagggcagggtgacctcaaggtattcgagggtcgggttgaacacggtgccgccgtggagcttctgctcgcgcagcttggcctgatgctggtgttcgcgctcggcttcgagggcgaaagcggccaggtcttccgggtagccggacagcacgtggtggttgtcggagttggtgacggcgatggagatcgggccgcgagcgttgttgacgcgggccaccagcgcctcgacctgggcgcgggtggcgcccttgacggagagcatcgggctggcttcgccgtacttggggttcaggcccagttcgcgcacgcggcgggttccggcggcgccgatcagggcggccacggccagaatctcgtcaagcgtggtgccggcggcctcgatggagccggcggcctcgatggcgcgggtcatgtgcacggcgagcacgccctgggagtggccgagcacggcgagcggcttggcctgggccacgctgtagccgaggtgttcgaggtcgagcagggcgccgagctgggtcagcgccacgccttccacggacgcggtggcgtcggctgcggcgccgaggcgtgccgggttcggggcgaagccgaacaggtcgaccggacggccggtggtggccagcaggtcggcggcgaccggggtgagcagtcggccggctgcggcgacgtggccgcgcagggcctcgtcaaggctgggatcggtggtctggtctgccagggctaccggccacggggtggactggccggcgaaggcgagcgcatggggctcggcggctaggcgattgaggaagaaggtggtcattgctttccttacttgtgtttggttgacgtcttcaaaaatcagaggggctggttgccgtggtgtttggtggtgcgcttgacgcgccgcttggtggcgagcgtggccagcgattcgacaatcacctcacgggtctgttcggggtcgatcatgccgtcgatctgcccgatttccagtgacaggttcgcgttgacggtgctggtctcgtactccttgatgtacttggcccgcagcgcatcgacgtcctgtccagaggccttggccttggccaggtcgtggcggtggatgatgttcaccgcgccggccgcaccgagcaccgcgatctgggaggagggccacgcgaagttcaggtccgcgccgatggccttggatcccatcacgatgtacgcgccgccgaacgccttgcgcaacaccacggtcaccatcggtacctgtgcgttggcgtaggcgtaaatcaccttggcgccgcggcggatgatgccggcgtgttcctggtcggagccgggcttgtagccgggcacatccacgagggtgaccacgggcaggttgaacgcgtcacacagacgtacgaatcgggcgactttctcggacgagtcgacgtccaggatgccggcgagcacgttcggctggttcgccacgatgccaaccggcttgccgtcgatgcaggcgaagccgacgagcgcggaggcgccgaacagttcctgcacctgcacgaattcgccgtaatcgacgatgcaacgaatcacttcgagcatgtcgtaaggctgacgttcgttggtgggcacgatggtggcaagtcgcttggcggtctcgcgttcggcgcgggtgacggcgtatgcgtagaccggcggcttgctttcgctgttggacggcaggtaggcgagcacggtgcgcgcatagtcgatggcgtcggattcgtcctcgccgaggtagtgggccacgccggacacccggttgtgcacttcgccgccgccgaggtcggccatggagatggtctcgccggtcgaggccttgaccacgtccggtccggtgacgaacatgttcgagttctcacgggtcatgatgatgaggtccgtcagggccgggcagtagacggcaccgccggcgcaggggccgagaatcaggctcagctggggcacgaagccgctggcctcgcaagtcttgcggaagatgcgaccgtactgggtcagggcggccacgccctcctggatgcgggcgccgccggagtccacgatggccacgatcggcactttgaggtcgatggccatgtccatcagtcggcagatcttctcgccttcggcggtgccgagggtgccgcccttgacggagaagtcctgggcgtagacggccactttgcggccgtagacctggccgaagccggtgatgacggccgcaccggcgttgccgccggcgatattgccgccctggaagcggccgatctcctcgaacgtgccggtgtcgaagagcaggtcgaggcgttcgcgcgcggttttcttgcctttggcgtgctgcttgtcgcgggcgcgctcttcggcggcgcgggccagttcggcggccttgaccacagcggtgcgcagcggctggtgggccgaaggctgggcggcgttggcggccgaggccgcagccgcggccttcacggcctgcgaatccatgatgtcagtcattgccaccctccttcttggcgtcggtggccttatcggctccttctgacgagggagctgtcgacgcagccgcctgagggagagatcccggcgcagccgcagcagccttggccttgccggcgttcacgtccagcgtgaccagcgtgtcgccggcctccacgccgtcggccgggccaacgaaaatcttcttcacttcgccggcggccggcgcgtacacgtagttctccatcttcatggattcgagcaccaccagaaggtcgcccttggccacctgctggccttcggacacgttgatgcgcgtgaccacggcctgcatcggggaggcgatgacgccggatttggcgccgtcgttggccgcggcggcactggaggccacgttgtgcagtcccgcaccgcgcaacggctgggtgggtcgcttggcaccacgggcgcgggccgagccggtgatgttctccacgatgtcgagtggcacggtgagcttgacgcggcggttgttcatctcgatgacgaacgtctccgacttggacttgtcgggcgcggccggggcagcggcacccggggcggcggccaaggaggccggctggccggaggcggcggaagccggtgtgcggttcaggtacgtgcgctccagccacttggtggacacagcgaacgggtggccatgctcggcggtgaagtcgtcgttgcggaagatttccttgaacagcggaatcggcgtgggcacgccttcgatcacaagctcatcgagcacgcggcgcacacgggccacggcgtcgagacggttctgggcggtgacgatgaccttgcccatcatcgaatcgaacttcggggagatggtgtcgccctgttccacaccggtatcgatgcgcacgccggggccggccggccactggatcttctccaaggtgccggagccgggggtcaggttggtggccgggtcttcgctggtgatgcgcagttcgaagctgtggccgcgcagttcgggggcgcgggtgagctcgccaccggcggcgatattgagctgttcgcgcaccaggtcgaggccgctgacctcttcggagacggtgtgctccacctgcaagcgcgggttgacttccaggaagtacaccttgccgttcggggtcaccatgaattcgcaggtgcccaggcccacgtagccgaccgtggtgaacaggcggcgggagtattcctcgagcgtgctgatgatttcctcggacaggaagggcgcgggtgcctcttccacgagtttctggttgcggcgctgcagcgagcagtcacgggtggagtacacggtgaagttgccgtgcgagtcgcgcccggactgggtctcgacgtggcgtgccttgtccacgaacttctcgatgaagtattccttcagatcgccgccttgcagcgcgtcgtggttcatgtagaagcggcgcagctcctcgtcgtcatgcaccacggtgatgccgtggccgccaccgccatcagtgcgcttcatcatgatcgggtagccgtgggtgtgtgcgaagtcgagcagcgtgcgcacgtcggtcaccggttcggacaggccgggcactggcggcactttggcgcgtagggccacgcggcgggcggtaatcttgtcgcccaaatccaccagcgcggtgtggtgcgggcccacccagatggcaccggcatcctcgaccttctgcgcgaagctcggcacttcggaaaggaatccgtagccggggtgcacggcatccgcaccggtcttgtgcaggatgtcaatcagcagatcttcgttgaggtacgtgtccttgtaggtgtcgccggagagcaggtatgcctcgtcggccatgtccacatagcggctattgcgatcctgttcggagtagacggccacggtggagatacccatctccttggccgtgcgcaccacgcgaagcgcaatctcgcctcggttcgcaatcagcagttttttgacgatagaagccatagtgtcaaattgtgctctccatatagaggagagggcaagccgcgttcacacaaaagctttcacgcccttttgtaggctacgaacaaacgcgcgcgtaggttccggcaacgtaaccgttggcgccggccatcaaaaacgttgcaaatccgccgattgcacatccttgcgcgccggctcaagaagttgacgttacggttgcgttcgtcaacttatgacaaatcgaaatcgacaattttgtaaattggtacgaaaccgcacgaaatcgaacacctctacgatggcaaccgtaagttcgggggaaggctcatctgcgggcgaacggaaggtgaccggaccggcatcggtccatcgccgcacgattcgcccgcacagggtcggattcatttgggaccgtccaccatatggacggttcggactgtcggggataccgcacgacccgccggaacctcccctcatccatcgcataccgcccgccgttcacggcgatatcacgcaacataggggtcattgatatgcagacttcacacaccaccgcatccgctgcggccaccacatcgctcgcccgtcgtatcgtcgccgcatcctggaagccggtgctgttcgccgtgctgatgtggctgtccgcggccgccggcgagattccgattccgggcacgccggtgccgatcacgctgcagacgttcgtggtgatgctcgccggtcttatgctgccgtggcgtcaggccggcgccgccgtcgccacctatctggcggccggtgcggtcggcctgccggtgttcgccggcggcacctccacgctggccctggtcggcccgagcgccggcttcctcttcggcttcctgccgggtgtggtggccatcgccctgctgcgcggcaagtccgacacttcgtccttcgcggccgccgcgcgcaccgcgggccgctacctgctggccgcgctggtcggcggcgtcgtggtggtgtacgccttcggcttcgtcatccagtccgcgctgaccggtgcgccgctcgccgccgtggccctggcctccatgggcttcgtggttggcgacgccatcaaggccgtggtggcctctctggccgccgccggcctgtccaagctcggtcgctgacctgagctactagctagctactggccggctattacagcactcccacatcggcggtgcggaccgtatggtccgtgccgtcttgtgttctcaggatcagtgaggcgtcttcgttgaggccgatggcttcgccggtcagcgtggtgccgtccgtgaagtgcgcctcgacctgacggccgcgcgcccagcacaccgccttcacctcctcgcgcaacgactcggcctggcccttcgggtcggcgatgaacttcaccaaccgctcgcggaagccctcgacctgacgttcggccaccgcatcgcgcatctcgccgaacgacggcagcccggagacatgcagctgcagcgaggtcgattgcggcgtgggcagccgacaggcgcccaaggccaggttcaggccgacgccgaacacgatgacgacgtcgtcatcggcatcagcatcagtaccggtaccggacgacggcggaatcaccagttccgagagcagcccgcccagcttgagcccgtggcagaacacgtcgttcggccatttgagttccagcgagcagtccggctggttcggcgcggcaccgtattcctcgatcatgccgttcagggcgtccagcgtgaccagtccggcgatcatctgcagccagccattgacggattcgtcggtggcgatcgcgcgcggaatgcgcacggcataggacatcgtcgagcaacggccgggctgactgacccacttgtgaccattgcgcccacggccggcggtctgccggtcggcggccaccacggccaccgccagttcgccatcctggtggtcgggcaacgtcaacgacccgtcgccaatcatctgtacggccagcgcgttggtcgaatcggtttcgtccacggcgaccacatgatctgcgacggctgtagttctgggtagctgcggcgttgcagctttcaacgcaatcatcatgggcactacgttacctcgattttggcgcgatatgcccgcgttattccatggaaaagcgcgcaaaatcaactattttcacccacatagcccatgttaacgttcacaacttcggaaattccgcattcgccgaccccacgcatgcacccggccgtcatattggcttgcgaacaatggcgatgcccggcagacatcgaatatcaaccgttgacctgtgcggctaccatatattgtcatgacgtcaccagccaccgcgaagcttgccgccgtatccagccgccagtcccacccgcatcttgcgcgcgcgggcgctgccgcgcgctggacactggccgtgctggccggcctgtggcttgcactgtgcacggcggtcggcccgctgtactgggacgaggagaacggcaccctcgcccattggaactgggccaataccgcaatattcgtcgtgtcattcctgatatatctcggaatcatcacgctgatggtgcgattcgcagcaggccagcgcatactgccgagggctatcggcgagcgactacgtcaacatcagcggattagcgaaacatcacggcccgccgccgatcagcaggccagccaaccagccaagacccgtcgtaccgttcgcgctatcgtcacgtccaccgtcactgttctggaccgctggatcacacgcggcacgaaccggttctggaagcttatgctggtgttttttgtcggctggctctgggtgccgaccactctgctggccgcattcggtgcggacctccgctcacagatccgtgaattcagctgggcctggaaccagtggaccggcctgaaacagccctatatcggcttcttctccttcgtgccgatggacatctaccccactgcgcactacatgtggccgtccgatcccacgtatctgaccgaccagcacaatgtggtactcactgtgttctatggcgcgatggtcacgtttgcgaggcatctgaccggctcaaacgatgccggtatcgtgacgttggctgccctgcagacgctgttcgccgtgttctgctgcgctgccgccgccaatcgattcctgaaccggccttggataggaaaaacggcaacggattccgccgctcccccacaggccggaggattggctcgattcctgattctgctgttctttatggtctgcccgctggccgtgttttccactatctccatcaccaaatcgccgctgttcgcgttctcgttcgtctggtggttcagcgtctggtatgaactcgtccagacctggcaccccgccggcacccgcaaacatcctcagacccctgccatcgccacgcccgtccacttgccgcgtcacagtttcatcgcctttatcctggccacgtcggtaatgctgatttccgcgaaatatgcgtggtacatcatcgccctacaaatcgtgctggctctgatcgccgaccgcaagcgctgggcgacttacgtcgtggcgctgctcatccccaccgtactgattcacggcggcatctccttcgccatctcctctggcgcgatcatcggcggcgacccaatcgaaagccgcggcgtacagctgcaaatgatcgcccgcgtggcccagcgcaatccggacggcatttcagacgaagccaaaaagaacctcgcgcccgtcttcaatctcgatcagatggccgacgcttactcccagcaggacgccgacccggtgaaatcctccggcattcaggccaagaaggtcagctacaagtggcgcacggtgacgcccgaggatatgaccaatttcaacaaggcatggttcgaaatcgtcaaggacaatccaatcatcgcgctggatgcgttgctggccaaatgcttcggatacttcaatgtgaacgatcagccgtacgtatcgatggattattacgtgaccagcgattacgtgcagaaaaactccacatggatcaaggattacaaccatgactggcgtgagcacatcgccggcttcactcgcgtatggggcggtattcccgtactcggctggcctacgcacggcaatttctacgtggtgatgacattgctgatcggcgcggccgaggtgattcgccgacgttggctcaccctcatgacccatattccgctgctactgctgatgggcgtgatgatcaccgcgccggccaataatttcgagcggcacatgttgccggttgcgtttgtattcggattcgtggtgctgacgtattggcgagagtctttggctgaaaggcaacgccaatcagcgacgctacactagtgactatgtcagattttctcgaacttcttgctgccgacgttgccgattcgtccgcacccggcatcgccgcgaccaaccgcgtacgcaccgtgctgttcgagtgcctgttcaatcatctggccgacgaacgagtggagtccctgttcaccatcctcggcttcgagcatgacttcgattgttacgccatcgccggataccctgcccggtccgccgcacgtacggccaaggaaatcgagaaaatcgtagccgatttcggcggtgtgtgtctgaccgccaagcgcccgatcggcaacagcaccgccgtagtggcgttgattcgtccggtcggtgcggccacgccggaaatcatctgcaataccatcgacccgtcgttcgccgccgatcggccaatcgccttgggtccgcagcgtaccggtgccgatggcgcgatgcgttcgattcaggccacgctttactgtcttcaggccgcgccggctctggccgccaccgtgcagccatcgccgcgcccgttacgcaccgacgacgccctgcccgaacgtgcgttgatcggcgacgcggacgcccgtgacgaactggtccgcgtggtctacggaagcctggcagcagcaggcccggatgatccgacgctgctcaccgtctccacattcctgaagttcggcggttcgctcgagaccacggccaaggagctcaacgtacatcccaatacgatccgctaccgtttgaagcgcgccgccgaatccaccggctgggatgccaccgacccgcgcgaggcgtacgtgctgatcaccgccatcgcgctgggtcgtgtggccgaagcgcagcggaccgcagcgtagtcgggcagaagcataaccagcagaaccgtagccggcaaaggccatagctgaccgggcataaccgtccagcccgacagcctagcgggccgaatcaggctgcctgaatctcgtgtacgccatcgtgcagtaacgcggccaaggattcttgagtggctaacacttcgtccacgaatccaccggcggacaggctggcgatcacgcgaccggactcgttgtccacaatcggtacaccaacggcaccgacacccaacgtcacatcctcatccgacagtgcatatccacgttcgcgagtcaagcgaatatcctcgcgcaactgttccacactgaccagcgtgttctcgttatatgccgggaacggcgctcctgcaagatagcgttcggcatcggcatcctcgaaatacgccaaggccacgcggccggccgcgccagcatgcagaggcagcacgcggcccgggcgcaggatcagcgaatcgatggcatgaccttgcgcgcattccacgcataccaattcagtgcaggagaccacactgaggaatgaggtcatgccggtttgcgcggtgatggcatgcatgaccgcaatcgcaggctgccattcggtacgagacgtgcgagcggcatcagccaatcgcagccagtccagtgataatgagtagttgccatccgtatccgttacggcccaccccacatcgaccagtccatccagcacgcggtatacggaggatcgcgggatatcacaggcgtcggcgatatctgccggagacaggccattctccgccgccaatgcgtccatcacacgactcgccttgtctaaagcgcgggtcggttcacgtttgtcttccgccatcgccgacgttccttccccccctgacttatccctgactcatcgtattcaactgttcaggccaagataatcaccactgtatccaaggcctcgcgacacctcgcggccggcagtctgcaccaattgcaccatgtcttgagccgatgccgttgccggtttcccatctaccagacaggccagctcaggttccaaggagcgggaaaggctactcagggcgattgccgcttgaatctctccggcgtgattgaataccggtacgctgatagtcacggagccggccatggtctggccgacgtcataggtgaagccgcattcgcgtatatgacgagcctgtcccattgctgtggcacgcatcgtggagaatgtgccgccgagctcgttgttataggcatagtgttccaacagctgctcgtagcgagccgggggaagccaggccgtcagtacatgagagggagcgctcatgctcagaggcaagctattgcccaccagctgtgcatagctttgcaatgcctcacgggtgcgtgtctcgatacacaccgtgcgcaatcgcctccgaacgaacagaccccagatgccgaactggccacgatgggcgcggaaggtacggcgagcgatctgctgaatgtccagtctgctttcgatttggccgccgatacgtacgcaatcgatgccaagccgatactcgccacgattgatgccgcgttccacccaaccgactgcggcgagattatccagcaaacgatacgttgagcttacgggttcaccagtacgttcgcttatggtttttgcagtgcttggtcccagttccgccaatacatcaagtactgccttggatttcaccaatgcatctacgctacggtcatcacggcttggcgccaccatgcgcgtcacctcctggcctgtatgttgatacctcagccatcttaccgggtattcagcgggttgccgcccaaaacgcactgggtcccggcaggagtatcccgtcggggcccaagaggtttctggctcccctctttgagggggagccgtccgcgcggcggaccgggggaggtccgagacgctaaggcccaaggacgcgagaaacaccccgacgcgcgggtgtcctgatatggggaaagccccttggggcgtgtgctccgaggggcttcctgtacgtgtggtgcggcggcgtgctactctcccacaccctgtcgggtgcagtaccatcgccgtgccaggccttagcttccgggttcggaat

SEQ ID NO: 33 - DNA, 30289 bp, Bifidobacterium longum
atgagtacatacgctggtacaaccacgagcgcatcaaacagtcgcttggttggatgagcccggtacaataccgtcaaagccaaggaatggctgcgtgattatctccaagaaaatgtccgcagccccttatccattgccgttctgggacaggctgtaacggatcgccacctaggtcacgctctcatcgtccgcgtcggtcatgccattcgctgtaggaaatccctaacgattgaatcccactgcgcgtcggtcagaatgctttcgcccgcgcgtcatatgagccattaggccgatatactctgagtataccaattccatgaagtagcgaggagaacaggtcatgccgactttggaatggatgggaaagaacaaggtggtcgcctaccaccgtcaggtgccgtaccgtgttcttgaccgcgttcctgaaaaaagcgtcctggattcacgtggatccgattgcggtatattgttttttggtatttactgatttcagtatttccgtattccggtattgcttatttgtctacatttttttggtaaacgtagacttcgtcattaactggaatgtatcccttcaggattttatccttacgaatttccttcccgattatcttgggcgaataggccagtagataatcaagagtcgcctgatacggttcgagtatgaagatgcatcggctcagcgactccaagtaatgaagctgctttctgcattccctcttattgaaccaatggcgccatcttatcgagaacttcttttgctcactctgtgaagagtcatagataagcggaaatggtaatggtttcaaacctggttcagccattccgttgcgaaaatacttatgccacttgcgcgacaatgaggggaatctgattttaatccatgctctttgtgcccaggttggggatacgcgtgctgccggaagcgttataaaacattcatcgtagaatatggaattcttatatatggcttcccatatcggcatacgtccttcagcgtctttcatggtctgattaactcggtcagcccatttgcggaatttctcatatacagaagaggccaacccgaggaagaaaccaaacagtgcgctgaagaaattctggaaaaccggattcgaatcatctggaatcaagaaaatggcaatcaggcaaatggcactcagcccgacggcaatcgcggccgtcctaatgcggcggatccgtcgtctatagaaatccggattcatattcagcaacttgcccaagtcgttaatcaaacatcccgaagcggactcaggatacacctttatatcgctggctgaatccgcggtttggtttcctccatcggtgtcatgtctatcgaaaccgtccatgccgaatactgtcttgtatgggatgggattctccttaccgagataaataagcgaaaccatcatacataactttctgattgacgctcattccgtccaaaacgatataagcagtctcaaagcgcgatcaccatcggttcgcgggtcttctcgttcatcggtttctccttgtctcggttttccagtgtttccatatcccggtttttcggtatgtagttctttcggtatttcggtttttaggtaaaacggtttcccggttttcaccggttccggtatcccgctccagcaggatcttcctgagcctttccacctcgtcccggagcttgccgatctgatgctccttctgggcgatgacggtgcggtggcgtgcctgacgtgtcatgcgtggcatctggcgaaaggattgcgactggaatgaaggactttaggagcggaatcaggcgcggctccgtctaagggccgtcggttttgctagaatctaaagagaaaaggaggtgcaatgttcggaacgatatctgaatccgagatgcgccgccgcacggagaacgtcggactgtcggtgcagtccgtgcggctggaaggcggtgacgtgacgagggccttcatacgcgatgccggagaatatgcgcgggggagcatcggcagcgccgagcttctttcccgcacccgtcgccgttacggattggagtgacgatggagcgtgtcttcgatccctacctgattccaggaacgaacgtgctgcggaactttgtgggcgccacggacgaggatgcgttggcggctgcggagaacgatctctgctccgcccgtgccgccattctgagagaggatctccctcctgcggaggggacgctggaacagcttcgccgcatacaccggttcctctttcaggacgtgtacgactgggcgggggagatacgaaccatcgacatgggcaagggcgagggacttcccttccagccattggagctgttcagcatgggggttcgctactccgaggaggtgcttcgcgccgacgatcttctcaagggtctcggccatgacgaattcgtaaagcgtctgagcgtcagctacaacaacttcaacatccttcacccgttccgtgagggcaacggacggacgcaacgcattttctgggagatcatcgcgcgcgaggccggctggcatttcgactggggactcatcgacaaaaggacgaacgatcaagcctcgatcgcggggatgcagcgaaacgatctgcgtcctctcgaggatatgttcagaagaatcgtcaagccgttgtcagaaccgttaaccatgtcgaatgatctggcccatcttggtgaatatgcgcaaccggcgaacacggcatacgacatgtctcccgcacagagacaacatgtgtgcgagcattactcctatcagcgtgccatcgttcctccagggcaggaaaagccgaaactcaggcacaggtcgagatgattttcggataacgcctcacgtatctaagtgttgcgacggcagatgccgcaacgcttagatgcgtgggcctgttccgtttgatgccggtctccaccggttttggtttttcattatttcggtttttcggtttttcggttttgggtatgcttatccggactggctccgcccgtctccgtcgtcttcgagctcttccagtcttcttcggagtccggcgacggtctgtcgcagctggtcgatttcctcttccttctgggctatctgcgccttgatgccggccggatccccggcggggagatattcgagcgccagtcgttcggcgacgtcgcgcctgtgtctcggcaccacgcgttggtagcatcggacggccacgtcgacgtccacatggccgagctcgtccatggtctcgcgcagtgtgccgccctggatcatgaacatcgtcgcgtgtgtcgcgcgcagggagtggaacgtcacgtcctcgcggttgattcttttcctcgcggtgcggaactgccgttggatcgtcgtcgggttcaggacccgttccgggtgcctgatcgcgtggaagagcatcgtgtcgggatccctgtcgggacagaacctgtcgatatgttccctgatgagacggcagaccggtgcggggatgggtacgactcggtggctttccggggtcttcgtctcgtcgagccggtattcgcccagatcgtccggaccttgcgtcacggaatgccgcacgtacagcagtctgtggtcgaggtcgatgtccctgagttgcagtccgcagacctctccgatgcgcagcccgcccaccagcagcgcgagatggatcgacaggcggtagtattccgggaagccctcgaccagcgtgtcgatctcctgcctggtcatcggcgcctgctcgcgtcttttggacggtctcttcctcgtgacgagattgcatggattcgaggacaatagcggcggacctccgtccggctgccgctcggtcgcggccctcatcaggcgcttgagcagccagaccgcgtgctcgagcgcggagggacgcacctcgtcgcatgccttcgcgtaccattcgttgacgaattcctcggtgatgtcgcacatgggcgtctcgccgaaccaggggagcagtttgtccaacgccgccttctggatccgcttgcttctgccgctcagctccgacccgtccttcttccgcaggttggcgacgaaacgcgtcgcgtatgaggagaacaggaccctgccgtgcatcgtccttgcagacgggtgcgtccacctgcggattccctttttatggtcgatgacgagcgcgtgctcctcgtcgagccagcggtacgcctcggtctggaattccaatccgaatcggcggtagattctttgcctgggattgacgggactctggtatcgggcctgccaggagacgatccttccgtccgcgtccttgcaggcgacgacgcatccccatttccgtcttttcctgtctccattggacatcggttgttttgtctttctctacttcttgaaaaaccattagaagaaagagtaattgcctacgccggtgattttgaataaggtgctatccttcgaccgtggggattctatctttcgggaaaatcgggattgttcagggctcttggagtggttttgactggaatttcaacaatcttcagtgatctgtttcctgatgtcacatcccaaagaagaagcatcatgcgcatgtcaccttcggacatgcgcatgatgatggtagtcatggctccaagtgtctcatgggcttgagaccgggcggtgggtgcatgagctatgctccttgtgggacctgcccggttgtgaggactactctcgggagagacatgatgttcggagcggttatttccagttgaatgtgtagctttggtccggctgttcctcaccatgggtggtgacggtcgggatgttgccgtgccaggtgacggtgaagttgcccgagcctaatgatttgccgtcgttgtgcagatccgttttgatttccgtgacgttctcggaaccgataacaccgggatcggtgtcccaagagactttgaccgtgatgctgcttggaccgaagaatatgggcgagccgagttcgctgatggtcacttcgcaggtgccgtcagcggatttcgcgttcacgatgcgatgcgacatatccgtttgcatccatatgagagtgcagcctccagcccagatcagcgcgattgcgagaatgatatgctcaacgatgtgtgccgctttatgtgagtatccttcggtcataaattcccacgctcgtgtcatcatgccatagccttcaaccggagccttttcatcggtcgttgaaaagatggttggcgatatcgccccgaccgccgaagccggacggcacgtcacccaaagagttcttagcgaagtcgaacaatcccatggtcatgcctctttacctttgggaaaccaatatgactaccgtatcagttgtcggcgtcatcgccgaggcttgcgatttgcggaagtggcccatatccatgcatcgcgtcatgaaacgggacgccgtctcgcgcgtaattcgtgcctgtagaatctttaaagaccaagtttggagggagcggaatcatgccacgcaagctgatcatgtgcggggaccatccggtccttgcgttcgaatacgatcccgagtccggtcgcgcgtgctcctctggcgaggtccttgaccatgatcgtctgcccctggagttcaccacgcacggcaagagcgcgctgtatgccaagaggatcgacgaatggtggaggtcccgcgccatcccctccacccgcgacggcatccgccgcgtgctcgaatcgcttggcgcggcatcgaccgacgaactgctcgacaggacctacgggctgagcctgtcggaccagtactgggtcagacgcgaggacgacccggccgaatggaaggacgtcaacttcttcgacaattccttcgacgaggctctgggcgagatcctgctcacctcgtactcgtcgtcccatgacatcagcctcaacgtccccgacgtgtccactggcggcgatcttcccaaacgctggacgatcgacagggccaccggcaggagactgctcgtcaagtcgggccgtactggccaagagccgatgaacgaggtcatcgcctcgaggctctgcatgcgattgggcgttccggccgtccggtattccctggcacgcaacggcaaccgtctggtgtccacatgcgcggacatgctctccaatcatgaggagctggtctccgcctggcaggtgctccaatccgtcaaggccgtcaacggcctcaactcgcatgaccagtggatccgcgccgccgtcggcttcggcgcagacgaacgggcggttcgtgacgccacggacgattggctcgtggtcgactacctcatgcgcaatacagataggcattacagcaacttcggtctgatccggaacatcgagacccttgcggtccgtccggccccgatctacgacactggcgcgagcctgtggagcggcgagctcgacgtggacggccgcgactggttcgccaagccgttctacaccgcgaccggcaagccctcggctttgcggcagctcagactggtggaggattggagccggttcgacctggatgctctgtcggactggcccgacgaggtggcgtacgagttgtcgcgcatgcgcatgttcgcgcccgaacgcctcgacgccatccgggtacagttggtaaagcgtatcgggatgctccgcagaatcagcgaaggtgaggtccttcgtgtttctgacccgattcgcaataaaacggatttgatggacagattcggcgagacgttgcggaagaaccttggacaacgggacggggatgccagaagcgtcggaaccggaccggatgcgttgagccgtcatctgaaccgctagcgcaacgaatcactactggaataatggactttgcaaccggaacacgaaaagaggagcatgatggccaatcccgagctgtcacggcacatccaggcccttcccgacgagctgaacgcccttgaagggggacgggagatttccgaacacctgcggagggtcgacgcgctgaaggaccgggcccgctcgctggagccgttggacggtgtcgaggacatggcgttggcggattacgaccgcgactggctggtgcgctacacctacaactcgaacgccattgagggatccacgctgaccctggaggacacgtcgctggtgttggagggcgagttcgtcccatcggactcgccggccagatacgtgttcgcagcgcgaggggtcgctgacggcatggcctacgtgcgcgaatatgccaaggaggggcggaagctgaacgaggagctgatccgtcgtctacacgaggtgaccgcattggatctccagccgttcgcccgcggcacgttccgtccttatggctatttggcgcggatcaccgccacccgagtcaagaccgcggacccgctggagatccgcgacgacctgcgatccttgatcgacgggttggatggctgcgcagcgcatccgctgctcagggccgccggtttccacgcgatgttcgagaacatccatccattcatggacggcaacgggcggaccggccgccagctgctcaacttcgtgctgctgcggaacggataccgtcccgtggccatcaaatacgatgcgggtcggtcatacgcgcgaggcctggaggcatggcaggtggacggcaagccggattcgttctgctccattttcctagactgcgtggaacaggaggaacaggcgctcgtcgatctgatcgagcggcttcgccatctgagataggtcgcaggaacactcgcatgcttctttcgtcgtcggtaagccgctgatatgcacagaagaatgagattattcttgggtgcctgtaggtgcctcgtggaaaacgagcgtaaccggcaggtttcccaaaaatcgaaaaccttggaataaagcaaaaaacagttggctaggattatcatgcggggtgcgcatgatgatggtagtcatggctccaagtgtctcatgggcttgagaccggggaagagacgtgattgcgggaatggcgcggagagctgggaatgggcgtgggcaatagccgggacaacatgccgcagcgtgaagcgtcatacgagttgtctcgcgatggccaacgcgccggcaacgaccatgagcgccgagaagacacgcagaagagtccttttgcgttctcttcccggtttttggatccgatcacgacggatatcaggactaatccgacggccagcggcaccaaggccagcggaaacagcggtttttccatggcatctcatctcgaacgctgtggctcagatttttcgatgttcggtttttctgcgcttgctgacaagagccatggagcagcatgtcgatacgcacagattcactatgcaggtcgctgctggcagtagccgtatgaacggctgactgtagaaatcgaggacatctggatccatagatcctgagtatatttcaaaaaccggatatgatgcgagagccggcgccgaactcacgaggaacagtatccaaatgacgggcaatctcaggatggatactgttcggcctttccgatggacttctttcgagaacatgaaaagagcccaagaggtcactgcgattaatgcacccgcgcaatacaacagaccagggaactcgctacgcatgattccgtcctcacttcagtcgcaggtaatttggcttatcgatcttctggctggttcgagattaccatacctgacatggcagtcgaattgcccgttgtctattggcagagcatccgactgttaatcggacggtcgctggttcaagcccagccgcaggagccagacaaaaacccggaacttcggttccgggtttttgttacccgccccccgaaactcctttatcaaggaatcatccataagggatgccgcagcagacggtctccaaggcgtactacaccgtgctcatccccatggacgacggcaactggcacgtcaccgtgtactgtcccgcctcgctggacggcccactgctcgacaaggattccaacgaattcgacacggacgacgtgaaacccggcgacaagtcgtacaccgttgccaatccattccacctggatcacgcacccggaacagacggtttcatcttcggccctgacaccctccgacgatagcgatggactaaccattcaaccgcacgcgtaggaggagcgcattccaaccatgaatgaatgacatatagacgtcaagggcttgcggacatcgtgtccgcaagcccttgacgtctcaatccaacgaaatatcgacttttacccgtttgtcggattcaggctttcgcgcaagtccggcgatgaggagggccaccagcagggggatcgtcgtcagtgtaccccaggaaatcgagaacgtgtcggcgatgtagccgcacagcggggtgacgaccgcggtgaaggccatcaatacgagcgatcccacggagaacgcggtcgcgcggatcgaatcgtcaatgctctcgtgcaagctgctggagatcgtgttcgccacgtacatctgcgcgcaggagaacacgaagaacgccaggatcctcaccgccggcatcggcgtggccgcaagcaccaccgccgacacgatgagcacgaggatcgcaatgtcgccggaacgtggatgcagccgcagcatacccagacgactgccgacgatctgcgcgatattagtgaacactaggccggcgaactgccaccagaccccggtctggtggcccatcagcagcagctgccagaacgtcagcaccgacaacgtacccagattgaacaccaccatattccatatctccggcttccgcagcagcacggccgcggccgccacggtctgcctgacatgatccaacaccgtcagcgaggtcccggactcgcccggctcggcggatccatcggattcgacggacgcctcggcctgccgttccgtcgtcccgctcccatccgtcgctgcggccttggtgcgcgacccggccctcatcagaccgagaagcgggatgatcgccaatacgtagaacaccgtcgcgcccagccagatcagctgggagtcaagcaggaacagcacggcaccgaccgcaccgccgcatatcgtgcacacaccgatcatcgccgacagtcttgacaccaaggtcttcatacccagcgagggatcgtgcttgctggcgtattcgatgtacagcgaggacgccgcgccgctttcgaccgcggccccgatgccggccagcacgttggccaggcacagcacggcgaagttcgtggaccagaacagcatcaatatgaatcccgcgacgcggcacaacacgccgatgatcagcgtccgttcccgggaccaccggtcgaacagcacggacgtgggcagctcgctggccgattcgctgacgtcgaacaccacattgacgatggagatcagcagcaccgacaggcccacatcatgataggccaccatatagtagaccgaaaaacatccggcaccaagataaataagcgcattatacaaacaggcaaaccgaaccatcaatcattcccttacataaacaaagaaccggtatacgtgggactgtctctcgaagtgtgtaactggccttaactggccggtcgtgtggccggtcggaaaggctggtggacgatgtgtgctgggacaaggggaaacatgacaccgacgaagaagccggacgcggaaaaacgcaacgccgagcgggaggcggcgctcacattcgtgcgcatggccaaggaaaaaggactggacctgacagggcccgacggactgctcaaacagttcaccaaaagcgtgctggagacggccctggacgaggagatgaccgagcacctgggccgcgccaagcacaagaaatccaaggacggcagggccgcgaacacgcgcaacggcaccaccgccaagaccgtggtcaccgattcggtaggtccggtcgggatcgaggtgccgcgagaccgcgatggctcgttcgagccggtcgtcgtcaggaaacggcagcggcggctgcccggggtgggcgaggtggtgctgtccctgtatgccaggggcctgaccaccggcgagatcagcgcccacttccaggagatctacggggcggacgtgtccagggagaccgtcagtcgcatcaccgagcgggtcgtggccgagaaggacgaatggtgctcgcgtcccctggatcgtgtgtacgcggccgtgttcatcgacgcgaccgtcgtcaaggtgcgcgacgggcaggtcgccaaccgcgcgttctacgtggccgttggcgtggatctggagggcggccgcgacgtgctgggcatctggacgtcgcccgccgccgcggcggcggcccgcgacgcgatgctggacaagtgggaggcgagatatcccgcgatccgcaggctgtggatggacgcgtgggaacggttcataccgttcctggactatgacgtggagatccggcgcgtgatctgcacgaccaacgccatcgaatcgctcaacgcgagattcaagcgctccatccgcgcccgcggccacttccccgacgagcaggccgcgctcaagtgcatgtacctgaccgtccgctcgctggaccccaccggcaagggacggatacgatggagcgcgcgctggaagcccgcgctcaacgcctttgccatcaccttcgccgaccgctggccaagcgagggaacacaacaatgaaaacgccagttacacacttaacgagacaggcccgcgtctgggccggtggccggcgatccgctggtgccgctggtgccggtactggttgaagtcgatcccgatggatctttttgcgtcgagccggtgccggtgccgttcgaaccggtctggctgccgccgacgccttggctggtcgggtcttcggtggtcggattctttgaggtgccggtgccgttcgaaccgttggcggtgccgtcggttttcgaatccgaggcgccggcgccggtcgaacccgaggtgccgttggcgtcgaggtcggtggagggggcgtcggttttcgaatccttgctggttcccttcgaatcatcgccggtgcccgtctggggcagagcgttgttctgatcgggggtgcccgttcgcgtgccggtgtcgttgcgcgcgggcgtggtcgtggtgggggatacgagattgtccgtgccgcgtccctgcgtggccagcatcacgacgccggccgtcaccgccacggcgagcaggccggacaccaaggtgacgatcatggcggtgtgcttcgaagcgcggaagcgggacttgcgcagctcatcgaccgagtacgtcctgccgttcgcccggctgaacacgatttcacgcggtctgcgtgtggaggaagcatcatcggcggtcacgcccgtcgccgtatcgggctcgtcccgaacgtcggtccggctgccggccgttcggggggtgccgccatcggcatcgccgttctcggcgtccttcgtgatcccgttgccggaggacgaggccgattggagtttttcgccggaggcggtgagcacgttctggtagatcttggtggccacggcggagacgacgtaactggccgccgctccgatcaccgaaccgccgatgccgatcttcgatgcgagcaggaacgaggtgacggcggcaagggtgcccgccacgatggatgagagggagattccttcaaaaaacttcttcacaatgcacgaccgtagggtgtcgggctgacaggttgcctgagactcgatggaagcggggcgaggcctacacgagaccttcaaaatcggccttcgtacaggtcggacacgccctgcggcgcacacacgtgcgtttcgcgtcgccgcaggccgcgggacatcgtcaattacgatgcagcgactgcccggtcggtctgattaccgacatcagcacggcgacgaagatcagcgcaaagcccaccagcgaagtccacatgattgtctcgccccagaacagcgcggagaacgtgacagcgaacagactttccgtacacatgatgattgacgcctgcgaggcaggcacgtgagccagaccgatgttctgcatgatctgggcactcatcgtggcgccgaggaacagatagagcacgctggccactactgagggtgccagccagctggcgttcggcatgggttcggtgaacaacgcgccgatgatgaacaatacgccggcaacgccgaactgcacaaaagtgacggcgatagggtcgaagcgtttggtgtagacaccaaggcaggtcagattgaacgagaagatgaccgcggtggcgatggtcagccagtcgccggcactcagcgacagcgaaccgcccggcttcagcgagacgaagccgacgccgatcagacagatcacgccggcgacaagattgatggccttcggacgggtttttgaaataatccacgtggcgaacggggtgagtacgcagtaggcggccgtcaggaacgcgctgcggcccggttcaatggtctgcaggccgatggtctgggtgaccatcgttccccagtaggtcaggcccaccacgagcgccggcacaatgattttcggcgtcagatacggcacgatgtgcttatggaacaaggccagcatgcacaggcaggcgccgatcatgcgcagacccatcagccattggggcggaatcgcctccatggcgaatttggcgagcagatagctgccaccccataatgcagcgcagcccagcaacatgagtcgggcgagattcgggggaaagctgcgggaccagcggctgcgcagcttgttgaaacgttcgatcaaacccatggtgcacctcaggacagttaggaaaacttgtggctctctcggctcacagattacgggaactaccggccaaaatcgaccggtcgatgggcgtcgggtgtgtgacaggtgcgcggccggggcgcggccggggcgcggcatcgccaagcagataagaaccggatgaaagctgtgcgaaggtgaggttactcacagcgaacatccgggctagtcgcgctcgaaaccggtactctggaaagagtaaaaatacgttgtccatagcaatcatgaaaggattcgacatggcagtcattactccggaaatcaaggaattcatcaagaacaacctcggttggatcaccaccgtctccaaggacggcgaactggatctcggcccgaagatgtccctgttcgtgctggacgacacgcacatcgcctaccacgagcgcaccgccggccagcactacgagaacctcaagaacggttccccgctggtcatcgctttcgccaacctcgagaagaagcagggctaccgcttccgcggcaacgtggtgctgcacgttgacgacgacatctacaacgagcaggtgaaggtcgccgaggaaaagggcaccaagaagccggccgtgattccggttctcgaagtcaccgagatccaggaccttgcctccggtccgaccgccggcaagaccatcgccaaggactgattagctgacgtattggtggcttcctcgtcagagggagccattttttcgctttttagtgcgcagtactaggtgacggccttgggcgtcggtggtggcgaagaggtaggtgttgccgccgtccttgagtttgagttttttgcgtagctgggccacggttagggggaaattgcgtacggcgatgttggcgtgcgtgaggccggccaatagttgcttcagttctttcttgttcatggtggcgatggattcgatggcgaatgacctgcctggaaaatcggcaataggttcggccgccacgaacaggtggctattcgggctgatgtgatgcacggcgaagcgctgttcgagaacatcaaagcatccggccttcatgattgaggcgttgggctcgtaaaggtacttccaatgcgaggaatcgaagtcgttcgcgctttcctcagacggggagtcttcggtattgcaagtattgcgtgcagccaaggcagaatcgctgatagtggtgtgattgtcgctgttatcgccggccttgtacgacagcacctgcccgtcattgacgcataccacgagcggtgaggcgcaacggccgcgccccaacaccaacaacaattccttgcattcattcccggtggagacgatatgcacctcatgcaccgcgccggcgaaatcggcgacggtcttatgccagtcgagcatgggggagagcttgaccatgaccgtcggtgccttggccagcagcgtatccttcagggtcagcacatccggcgtgcaatcggcaatcgcgtaggtacgcgagccatgatcgtcacggcgggccggatcgaggaagatcatggagactcggccaagcgtatcaagcactgctgttgaatcatcattgatgacttcggcgtggccaaggccgagtatcgggaaattatggcgagcgataccacataaaatggattgttgttccacatatatggcatggtcaaacactcgggacatgtaagaaaagtcgacgccgaaaccgccggtcagatcgactagggatgtcggggaatcgtcggcgtcgtcgactgcttccccgtccaacaatcgctgtgctaaccgggctttgtattgagccgtgaactggctggaacattgttccattgggacttgcggcgggaaaatcagcccatcatgggacgcccagtcgggtagcttgagtgaagcgcgctgccagccggcaatttgctccagcgcgaacggcacatccacgtcgccatcatgcttggcgtgcaaggccacatcacgcacatcttcacggcggtgtttggcgatgaacgcccaagtcgactcagaaatctccatgccgccattctaggggttgtgctgagatgagtatggcaaaccgcaagagaacgaggtggcgaaaaccgatgatcgatgaagtgatgatgctgcgtcatggccgtacgcaatacaatctcgaacatcgcttgcaaggccagatcgatgtgccgctcgacatcgtaggccaatggcaggtcgaccagaccggattcgcgctcgcttcacggtattactgggccaaggtgaaccgacttgccgaacatcccgaagccatcgcccagcccggtcctgacgccgccgaacgcactgatacgcgccagttcgaggaggctcccgccgccggccggcgcatggtggtgatgacctccgacctgttccgtgcccaacagaccgcacacgccttcgccgatattttgggattgccagtcacctgtgaccaacgactgcgtgaacgcagcttcggcgagtgggaaggcatgacccgcgccgaaatcaaagccgtggcagccgacgactacgcctcttggaaacagcacactgggggcgaaaccaagcatggtgtggaaagccgtgccgccgtgggccagcgaggtgccgatgccgtgcgcgcactggtcatcgactccgcctattcagacagcacgcccaccacgctgatgctcgtcacccatggctcatggattaccgccgccatctccaacctgctcgaactcgacccggacggcatgaacgcactcggcggcatgcgcaacgcctgttggtgccggcttaaagtgcgccacagcgtcaacggcacccccaccgaacagccactgtgggagttggaggaatacaacaaggctcccgccatcgccgacagcgccgactgggagaacgggccgaccgatctgcgaggaccgcacatgccaagttggcagccaatcgtctggtgatggtcgttatgcgaaaccccgctcgcaaattcgaacggtgggtctagactaatctcggtttggaaccgtacagcgatagaacagtaagaaagcgcggaaggcgggtgagacgacatgctgagaatcttcagctcaatcaatggccaagtggagcagatcgagaaaccggaaaacggctcctggttatgtttgagcgaacccactgatgtggagctcgccaccgtcgcctcgcaaaccggcatcgacctggccgacctgcgtgcccctttggatgacgaggaacgttcacgtgtagacgtcgaagacgattacacgatgatcatcgtcgacattcccaccgtggaagagcgtggcggacgcgactggtacgagaccatcccgctgtcgatcatcgtcaccgaaaacctcatcatcaccgtctgcatgcaggacacgcccgtgctccacccattcatggaaggcacgatccgaggcttcaacaccttcatgcgttcgcgcttcatcctgcagatcctgtaccgcaacgccacgatgtacctgcgttacctgcgcatcatcgaccgcgaaagcgacaagcttgaactgaagctgcgccactccatgcagaaccgcgagatcgtgatgctcatggagctgagcaagactttggtgtatttcaccacatcgctgaaatcgaacgaaatcgtgatggagaagctcaccaccctgcaacgcatcaagcaatacccggacgacgaggacctgctcgacgacgtcatcaccgaaaacaagcaggctatcgagatggccaacatttacagcggcgttcttgcgaacatgaccgacgctttcgcctcgatcgtgtccaacaacctgaacaacgtgatgcgcatcttcaccatcatctccatcacactgtccatcccgaccctgatcttctcgatgtacggcatgaacttcgatggcggcatgatgggtatgccgttcactgacaagccgtggggtttcatgctcattatcgtgatttccatggtgctctccggtgcggttgcctggttcctcacgcgttcgcgcatgttcaagtaaggcgtttgacggttatgcaccactggtcatcgttcgccagccgtagcatgctccgcgctcgccgtccgatgcggcgcggatttcgctcccgactgatggcaggattcgccgcggcctttggcgtgatattgccattatccggtctggccggttgcggccaaattcaagtcaccaccgtctccggagcgccggaggggcccaccatcgccattggggtcgcagccgacgagccatcggtgggagcatggcatgacggcacataccagggcttcgacatcaccatcgccaaatacgtggccgccaaactcggctatgcgaacaagcagatcgtcttcaaacaggttcgccccgaaaaccggcgctccatgctggacaatggacaggtcgacatggtcgtcgcctcttggcctatcaccgatgagtccagcgcgatcgttgattttgccggaccatacctcacgaccagcgtcggtttgctggtcaggtcggatgagcgtggccgattcaccaatgacgcaggttcggtgggtgacgtaggcgacggcacggtgtgcgcagtgaaaggtgacgagacagtcggcatcttccgcggcaaccacccgcaggcccggattcaggagcgcagcagttatgcgcagtgcgtcacggccgtgcaagtagggtcggcggatgccatagcctccgatatggcggtgctttccggtcttcaagcggccaacgggccccagtatatggacgtgattgcggacaagggcgaggtcggttatggcatcgccgtgagtcaaggcaccagccaattggcgcagaaaatcgcggaagcattggaagacatggttgaggatggcagctggacggccgccaaggatacgttcacaagccaaacaaagctcacggtttcgctgaacggcgaccccaaagccatcgtctcggatgctgaataacgattgacgacgtgtccagttgcgaggctaccttgctgatttatgagtgacaacgagaagagcacgcaaaccgaagagcccaacttccgctacaacgccgcactggcgcaggacatcgaaaacaagtggcagaagatttgggacgagcaaggcaccttctgggccgccaacgtcaacggcgatttgaaggacggcaagggccgtaacgccgaaggccgcaccgcctacttcgccatggacatgtttccctacccgtccggcaagggcctgcacgtcggccacccgctgggctacctggcctccgacgtggtgagccgctaccaccgcatgaagggcgagaacgtcctgcacgccatgggttacgacgccttcggcctgcctgccgaacagtacgcagtccagaccggccagcacccgcgcgtgaccactgaggcgaacatcgccaacatgagccgccagctgcaccgtatgggcctgagcttcgacaaccgtcgtacgttcgccaccatcgaccccggctacgtgcgctggacccaatggatcttctcgcgcatctacgattcctggtacgacgaggacgccaccaacccgtccggctccaagggctccgcacgcccgatcgccgagctcgtggccaagttcgaatccggcgaaaaggccattccgggccacgagtccgatggcaagcagtggtccgacctcactgacgccgagcagcaggatatcttgaacgacttccgcctggcctacatctccaagtccccggtcaactggtgcccgggtctgggcaccgtgctggccaacgaggaggtcaccgccgaaggtaagtccgagcgtggcaacttcccggtcttccagcgtgagctacgccagtggtccatgcgcatcaccaagtacggccaccgcctcatcgccgatcttgacggcatcaactggcctgagaaggtcaagctcatgcagcgcaactggatcggtgaatcccatggtgcctccgtgcacttcatcgtggccactgccgacggtgacaaggacatggaaatctacaccacccgtcccgacacgctgttcggcaccacgttcgccgtggtttccccggaacatcacctgctggagaacgtgcccgccgaatggccggccgatgtacccgaagactggaagggcggctatgccaacccggtcgaggcggtgaaggcctaccgtctggccgccgaagccaagaccgccaaggaccgcgtgaacgaggccggtgagaagaccggtctgttcaccggcctgtacgccaccaacccgatcaccggcgcgaagctcccgctgtttactgccgactacgtgctgatggactacggcaccggtgccattatggccgtgcctggtggcgaccagcgcgattacgactttgccgtgaagttcggtctgcctgtcatctacaccgtcacgcctctgccggattccggcgacgacttggccaactacgagggcaaggcgccgttcgtctcccatgacggcatcgtgatcaactcctccgtcgaggccaccgaagccaagggcgacgcgctgagccttaacggcctgcgcgtggacgacgccatcgccaaggtcaacgcctggctcgaatccgccggcgtgggcaagggcaccgtaagctaccgtctgcgcgactggctgttctcccgccagcgctactggggcgagcccttcccgatcgtctacggcgaagacggcaccccgcacctgctgccggattccgcattgccgatcaacctgcccgacgtgcccgactatgagccgcgcaccttcgatccgatggacgcagagtccaacccggaggcaccgttgagccgcaacgaggactgggtcaaggtcgagctcgacttgggcgacggcaagaagacctactaccgcgacaccaacaccatgccgaactgggccggctcctgctggtactacatgcgttacatcgacccgaccgacaccaagcacatggtggagaaggacgagttcgactactggatgggcccgaaccacaacaagtactcgggtgatgaaggcggtgtggacctgtacatcggcggcgtcgaacacgctgtgctccacctgctctactcccgcttctggcacaaggtgctcttcgacctcggctacgtggactcggccgaaccgttccacaagctgttcaaccagggcatgatccaggcctacgcctacaccgacgaccgcggccagtacgtgccggccgacgaggtcgtggaaggcccggccgacgcctccggcgagccgaccttcacctggaacggcgaacatgccaaccgcgagttcggcaagatgggcaagtccctcaagaacatcgtgaccccggactacatgtacgagaactacggtgccgacaccttccgcctgtacgaaatgagcatgggcccgctggacgagtctcgcccgtggaacacccgcaacgtggtcggtggcatgcgcttcctgcagcgtctgtggcgcaatgtggtcgatgagaccaccggccaggcccatgtgactgaggacacgccggacgaaaagaccctgaagctgctcaacaacacgattgccgaagtgaccgcggaaatggaaggcatgcgcccgaacaccgccatcgccaagctcatcgtgctcaacaaccacctgaccggtctgaaggctgtgccgcgtgccgccgtggagccgctgatcctgatgctcgcgccgattgccccgcacatctgcgaggagatgtggagcaagctcggtcacgccgaatccctgtccgccgagccgtggccggtggccgacgaacgctacgtgggccacgacaccgtgaccgccgtggtgcagatcaagggcaaggtgcgcgccaagctcgaagtgccggtcgacatcgatccggccgatctcgagaagcaggcgcttgccgccgtcgccgaccgtcttggcggcaaggagccgcgcaaggtgatcgtcaaggccccgaagatcgtctccatcgttcccgcggagtgacttgttgcgagccagctcccctctttgaggggagctggctcgcgtagcgagactgaggggagcgtcaaccgcccacctcaattgtggataacttcataagctagaaccacataccccgtttcagctggacaaacgcccatgaatccatcagcgtggatgcatgggcgtttctcataaccatcgcgcagaccatgccgccaaccgtttgcgcgcattcagcaggcagagcgcagccatgccccaaccgcgagtggaacggcccacgacgcctccgccgcctcccggccatgcacggatccgtccggccggccacccgccccaaagggcgcagagcggcctgcggcaggcgacccgtgacaaacgtgcgttatcggatctgattggcgtacgttccgccgatgccgtcggcgaatcagccagactcacccgggatcagccgcgattgtcgttcaccattgggcatgccttggccgtgatattgctgctgatcgtcgcccttggcatcagcttggcattgctggtccaacagtcgatgaatatggccatgctgtctcaaccgaccgccatgcagaccacgggcggctccgctggagatcagacgatgccatcgcagaacaccacggacgagaaacgcacggatccgcagcagtcggagcattccgatgccacagcgaaccccgaatcggataccacgcaatctccgcacatgcagacggacggcagcgatgccggcgcttccacgcatggtctcatcaacctcaacacggctaccgctgaggaattgcaatccatcaaaggtattgggccggttaccgctcagcggatcattgatcatcgcacggcgattggcgggtatacatcagtcgatcagctgctggatgtcaaaggcatcggctccaagacgttggagatcatgcgagggcaggtgacggtcggatgagcagggattggatactgcgcgagcaggggagccgcgattggaggatgctgccgatcgccatagtgatgtgggcggcgagtctgggagcgcacgcattattcgcatggaggatgtctgatggactcggcactggtcaggcaaaggccgatgccggagctggcattgacgtcaccataatcggcatggaatggcctgtcacacgaatattgcctataacagtggcgtcatgtgctgccgtggcggcgatgatcgtggtgtctttccgcctgcggatccggtggacgggaacattgaccgtatgcgttgcggtggcgtgcatcggcagtatgacggcaatcgcgtcggacaccattgcctggcatgatcctgcctccgcacaagctcgccaatccagttcataccacgaagtcatggccacggtgacgacgcccgtgatcgcttcggaccaacgcacatacgattgtcagacggacatacggctgagcggcatcactgtggatggtacggatgtacgttccacggtcgctgtgcgtgtatacgccgacgaatcgtattgtgggcagttgcgtcgaggcgcggtctatctgctgacaggcgtattgcagcaagcgcgatatggacgcataccactatggctgctcttggaaggaaaacagccggtagcacaggtgcgggctccgccgtggcatctcgccgcgattgcgcatgtgcaggaggcgtttttcaccgtgaccgaacaattgtccgatcaggggcgtgtgttggtgccgggattgacgatgggtgtgcttggccaggattatatcggcggcgagaccggtccgatgccggtcaacagcacgtatgcgcaaacgttggagaatcagttccgccagtccggcatcatgcacctcatggccgtatccggtggccactttgtactggtggcgggattggtgcgccggttatgcatgtggatgctgcttgatcggcggctgacggcgttgctggtctctggagtatatgtgctgctggcattggcgatgttccccagtgattcggtcacccgcgcgttcatcatgggattgataggtgcgttgacgtatgcgatggggcggcgtacgcaagcgttgagcgccctgtgctggacggtaatcggtgtattggcggtgaatccggatatgtcggccagctacggattcgccttgtcttcggccgccgtactgggtatcgtgctgtttgcggagcggctggccggtgcctttgagcgagcgatgccgcacggcatcgccgaaatgatggcgatgaccgtggccgcgcagttgttcaccctgccgattcaggtgttgatggaaccggagttgccgttgctgtccgtgccggcgaacctgttggtgtcgccgtttgtgggattggccacgatggcgggattgatggcattggcctgcgcatggtgcgagccatggctggccggcgtattcgcgtggatatcgtcatggggcacgctggtgatggaacgggtggcgttgtggctgggtggcagcacgatggccgtcatcccatggaaagacggcgttacgggtgccgtgctgattgtggcggtggaaatcggtatcggcatgctactggtgttcgtcagccgttgcctccagcatgtccgtcgttatgaggccggaatgcctggcgtgcgcttcggttccgcttggcgtgtccgcctcagtctctggtgcgaggagacgagacgtctctttacgcggcggcaagccgaatagccaatgcggtattcggtgcagcaaccatcgcaatagccagccgaacctatgcgataggccgcgcggcataaaccatcagccggcaaaactgcgatacagttgagaccagttcaaccagctgcatgaaggagtgccggcgatgatgttgtctcataatccgatagtcgaaccattcgcattggcccacgccaccatcgtcaccggagataaagccggaaccatactgcgtaacatgacgatcgtggtcggagccgacggacgtatcgaacaggttgcacccagcatcgaaaccagtatcccagccgaataccactatcttgacggcaccggcaaaatcgtgatgccggggctgatcaatgcgcatacccatctgttctcccaaggcaagccgctcaatccgaagctggcgacgcccaaaggccaacgtatggtcgccacattcgcgcattcgccattgggcaagccgtacatggccgcaaccgtaaaacacaacgccacaacattgctggagtccggcgttacgacgatccgcacgcttggcgacgtgggatatgaagtcgtgacattacgcgatcagattgatgcaggccaaatcctcggaccgcgtatcttggcgtccggaccgctgatggcgattcccgaaggccatggcgccccgcttatcgcactgaccagcggcaccccggaagaggcgcgtaccgcagtcgcgcagaatctcaaggctggcgtcaacgccatcaaaatcgccgcgaccggcggcgtaaccgatgcacaggaaatcggcgaggccggcagcccgcagatgaacgtggaacagatgcgggcgatttgcgatgaggcgcatcagtacggtgttattgtcggcgcgcacgcgcaaagcccggaaggcgtgcggcgttcgctgctggccggcgtcgataccatcgaacacggcagcgtgctcgacgacgaattgatcggcatgttccggcacaatccgaatgcgttgcgcggatactcggcattgattccgacactgtccgccggcctgccattgaccttgcttggacaggacgcgaccggcatcaccgacatccaattggagaattccaaaaacgtggtcggcggcatggtttcaggtgcccgtcaagcgcacgaggccggattgatgataggcgtcggcaccgatacaggcatgacattcgtgccgcagtacgccacatggcgtgagctggagctgctggtcgcatacgccggtttcagcccggctgaggccctgcacgcagccactgccgtcaacgcctccattctcggcgtcgatgccgagaccggttctttggaagtcggcaaatccgctgatttgcttgtgctgaatgccaatccgctggacgacctgcgcgcgttggaacacccggcactggtcatcgcggccggtcacccggtatggcgtcccgctcccaagcgtttcgcggatatcgacgccctgttggatgaggcatacgcctaatcgcggagtgctgccgggccgttatgccggcaggtcattgtccaacctgtgtggcgagatgggggcatggcgaaaacagcagcgaacgtaccggtaaccgtggtgcccggaggcgactcgtatttgaacgacgcgcgcaccaaggcactgtgcgcacaagcgttgaaggcgcgacccgacgccgaactcatcgagctcgacgccacatcggccgaccaatatgccttcgatgaagccgtcagcccatcgttgctttccgacgttgccgtggtcaaactcgtcaacctgcagaatgccgacgaaaagctcgccgaagctctggtgacgtacaccaagcaggccgccaaggatccgaacggctccagcgtggtgatctgccagcacgagggcggcgtcaaagggcgcaagatcatcgaccaactggtgaaagccggcgctcgcaaagaggacgtgccggatttgaagaaaccggatgcccaactcaatttcgtactcggagaattcgagaaacgcggtcgtagagtcgaaccgatggccgcgcagcagctggtatccgtgctcggcggcaaaaccggcgaactcgccgccatgtgcgagcaattgtgtttcgactttgacgataatccgatggggctcgaccgtgtcaaccagtatttgaccgccaatccgcaggtcaccggttttgccgtggcagacaaggccgtggaaggcaaaaccgcagaagccatcgtcatgatgcgtgcagctgtggaacaagggaccgatcccatcgcgctgatcggcgcgttggccatgaagctccgtaccattgccaaagcctcggcggtccgggccggcacgatttcacaggccgaagcgaaaaccaatccgtgggtgctgaagaatgcgatgcgccaacttggcggctggacttcggcaggactcgcgcattgcatccgtatgctcgcctgggcggatgagcaaagcaaaacgaacggcggcgacccggtatatgcgctggaacgctgcattgaagacatcagtcataaaggtcggtaaaagtcgataaaggggtatttatgagcgaacacactattgcggctcccaccagcgaggccatgcaggagctcggccgccgcgtggccggaatggtacacggcggcgatgtattgctgctctcaggccctcttggtgccggcaaaaccacattcgcccaaggcttcggcgcggggctggacattaccgaacccatcgtgtctcctacattcaccattgcccgcgaacttgacgggcatttcgccgacggcactccggctcatctggtgcatgtggatgcctaccgtctgggcggctcagcctatgcgccggggcaggacgccatcgggcgtttgttggacgagctggaatcgctgggattggacgaagaacttgaagaccccggcgagaacacggtggtgcttatggagtggggcgaacaaatggccaccgccttggcaccagaacgacttgaaatccatatcgatcgacctctcgattcctccgatgtcgcatccgctggatcagacggcgaactcaccagcaacggcactcgtaccgtcgcattcgtcccagtcggcaagcgatgggccgcgttcgacctgcaataagccatgcgcccatagactcctcgatgtacactctctagaggctttacgactaggaggattcatgggttgcacgttggtgattgacacctcattcggctcgacggtcggcattgtggggcgcgagcccattgtagagaccgattcgcgcacccatgtggagaaactgcaggtcaatatcgcgcgcgcggtcgaggaggccggcctgactcctgccgatatcgaggagatcgtcgtgggcatcggcccggcgccattcaccggcctgcgcgccggcatcgtggccgccaaggcgttggccttcgccaccggggccaagctcgtcggacagaacgtactcgacccgcaaggcgagatgatgaacttcgtgctgggtgacagcgccatgttcgacggcatcgatttcctggccgacgtgccgcgcttgagttcgcgccaatcggatggtgacgtcccggacgccgaggccaaggaacacgaactcgaccgccacgtcacgctgtgcgtcaacgatgcgcgccgcaagcagctgtacttctcgctcaaccacggcagcgtcagcctgccggacgaggacgccgccgaacgacgctggatcgagatggatatcgactacccggagcatatcgtcgaacggatgaacgcggcgctcgcggaacacggcgaacgcgacggcgtcagctatgtggtggatgtggccggccacggcgcggccaaatacgcgtccgtctggcagggactgcgtgcgctgggctccgtggtggacggatcggtattggatgccgggaaagccgggctcgccgtctttgcgaccaccgcgttgagccgcgaactgcgcggcgaccaggtcgtgccgatcgaaccgttgtacctgcgccggccggacgccgaagtaccgaacccactgaagcacgtgctcggccatgccggtgccgataaagcgtgaggcgggttgtgtccgatgattgttgacatcactgccgtaagtcgtgatcttgcggttcgttccatcgcacagttggaaggcgaactgttcggccgcggcgcatggaatgcgaacatggtgcgagaggaactggacgcaccggcccgcacgtatctgctggatgtgctgggagaggcggaacaggcggttgtccgcggctacgccggcttctggtacgacggcgaggacgccgagctcatgaccatcggcgtgggcaaggcataccagcggcaaggcatcgccgctgcgttgcttcaggcactggtcgacgaggcgaaacgtcagggcgcctcgcgcatgctgctcgaagtgcgtgtggataacgaccctgcgctggccctatatcagcggttcggattcgaacgcatgggattgcgcaaacgctactaccagcccgaaggcatcgacgcatacaccatgagcttggacctgaaacctagggtcgtgggctttgccgccccgcagacggcatcggcggacattgaagacatcaccagcaagcaaacggagaagaacggagaagcacgatgagcgaaccggttgtactgggtattgaatccacctgcgacgaaaccgcagccgccatcgtacgcggccgcgaactgctctccaacgtcgtggcctcatccatggaggaacacgcgcgatacggcggcgtgatccccgaaatcgcctcccgtgcgcacgccgaggccttcgtgccatgcgtgtccaaggcgctcgccgacgcgaacatgacgttggcggatgtggacgccatcgccgtgtccgccggtcccggactggccggttgcctggccgtgggcgtgtccggcgccaaggcgctggcctgggctgcgaacaagccgatctacggcatcaaccatgtgatcgggcacatcgccgtcactcagctgcagttcggcccgttccccaaggacacgctggcgctgatcgtctccggcggccacacctcgctgctgcacgtggaagacatgccgcgcaaaatcgacgtggttggtaccacgctggatgacgcggcgggggagtgcttcgacaaggtcgcccgcctgctcggcttcccgtatccgggcggcccgcacatcgaccgccacggccagaacggcgacccgcacgccatcaaggtgccgatgggcctgacacaaggcaaggccggtgccgcgcacccgtatgatttcagtttctccggtgtcaagaccgccgtggctcgctgggtggaaagcgagcaggccgccggccatgagattccggtggacgacgtgtgcgcctccctggccgattccgtggccaccgtgctggcccgtaaggccatgcgcggctgccggcagtacgattccaacacgctgatcgtgggcggcggcttctccgccaactcgcagctgcgcgccaaactgctcgaattcggcgagaagtacggcgtcgacgtccgtatcccgcaaatcaagctctgcaccgacaacggtgccatggtcgccatgctcggcgtgaacctggtcgaagccggcgtggcccccagcgcccccgacttcccgattgactccgccatgcccctgaccaaggtttcgatgtaagatttgcgcggtattcccaaactgatactgggaataccgtgcctctcatcggtgaattgacagtgacctgtctgcctgatgtgagtagtggtgaggtcttcgccatggatttcccggttgatgatggggtgtcgtgtctggtcaccaatgcgatgaaaataaaaaagcctcggagaaccgaggctttcgatggctcctgcggctgggcttgaaccagcgaccgtccgattaacagtcggatgctctgccaactgagctacgcaggaatattcaattttcatcccgtccggagttacccgttcaggtgagctcctgcggctgggcttgaaccagcgaccgtccgattaacagtcggatgctctgccaactgagctacgcaggaat

SEQ ID NO: 34 - DNA, 29843 bp, Bifidobacterium longum
tgctccaccacctgggccgtcgtcatcggcgtggtgaaatacaactccaccgcacgctctcgttcctcaagactgaacatacgaaaatccttccgttcggtctccaagaaaacgtccgcagccccttatcaacgtgcgcaaccggcaatatccttgcggagtatctctgcataattcgtggctgtaacgatgctgccttcgaataatccgtcagaccgggtgtcgagcaacgcatccgcagcatcttcgccctgcgtcgcggccgtcatgcaagcgcgcaacgcttccgcctttgcactgagcatgtccattttctcagtatggtcaggatttaccgaatatccttgatttgcgtatgccttcagccgttttcgatacatgacagcggataaaggcacggtcacgtcgatgtaatcatagacacgaacctcggtcttgccatcattctcgcgatgaagtcgccctacatattgcgagagagtaccctcaaacgagaccggagcggcaagcagaagcgtgtcgaaacgcttctgatcgaatccttctccgatatagctacccgtagccactacagtcaggctctcattattcggcgccaaggatagatcatgctttttttggttattcgctgtttgcggtggggcgggcatgggttagtgtttcgggttcgatttcctgtcagaaaaaataatcgagtgcgggattacggccggtaaggctcctgctgtggatgcggatgcgcgtcagccttacggtgatgcttttccaaaacgcggattgtacgaggtgtgggacggcacgcggattcggccgttttccgcccgccgtcccacagcgctcgctatgaacggttgtgcataatcatggagctgcagcgagaatcggcgttattccgcggtttctacagtcgtcggtgtgggacgctacggacgttaaacggttgacttgtctgccatcccgcgctcttgagggacggcgcggacgacaaacgattgactcgtctgccgtcccacagatattgggatgtgtgcggctgcctgctgcctatagcgggtgtcggtcacccccaccgatcgcccccaccggttaccaccctgcttggcggaaatacgcaactcgactttctgtaggcatcatggcggcatggcgacggcggacagtcgaagagatccccatgatgcctcaacagccatcgcccacacacatcacagctatcaaccgcaaatatcaagaggccgaaaatctatgagacaagcaaccccggaaagcctcagaccctacaaatggctttattgcaagggtatatgccggtccaaactccactaatagaactaatagaacaaatagaacagccagcttaggcacggcgcggcaaatggcgcaaaccggccgcgatagtagtagcgtggtgcataccagtacaaccatgcgaggagaacagccatgatcaatgaggaatacaaggccatgcttggcggcaagtccgtgattcgcgagctgagcgagtacgccacgagccgcggtgccgaaatcggctaccagaacgtgttcgattacagccttggcaatccctcggtgccggctccgaaatccttcaccgacgccatggtcgacctctacgaaaacggcgatccggtggccatccacggctactctccctcgctcggtatcccatccgtcaaggacgcgatcgccgaaaacctcaacgaacgtttcggcatggcatacaccggcaaccacatcttcccgaccacgggcgcggcgggcgcgctgtcccacgcgatgcgtgcggtgaccaagccgggcgatgagatcatcaccttcgccccctacttccccgaataccagccgtacgtcaagggcgccggcgccaagctgaccatcgtgccggccgacaccgagaacttccaaatcaacttcgacgcattcgaggctgcacttaacccgaacgtgcaggtcgtgcttatcaacaccccgaacaacccgtccggcgcggtgtattcagcggacacgctcaagcgtctggccgcgatcctgaccgccaagcaggtcgaatacggccacgatatcttcctgatcagcgacgaaccgtaccgcgaaatcgtgttcgacggcgccacccagccctacccggccagcttctacgcgaactcgctgacctgctactcgtggtcgaagtcgctgagcctgcctggcgaacgcatcggctatgtcgcggtgaatcccacagccaccgacgccgacctgctcgtgcccatgatgggccagatctcgcgcggcaccggccacaactgcccgccgagctcgattcagctgggcgtggccaaggtcatcgaccagaccgccgatctcaacgtctacgagacgaacatgaacctgctctacgatgcgctgaccggcatcggcttcgacgtggtacgccccggcggcacgttctacatcttccccaaggcgctggaggacgacgccgtggcgttctgcatgaaggccaaggaatacgacctgattcttgtgccgtccgacagcttcggcgtgcccggatacttccgcatggcctactgcatcgacacggagaaggtcaagcgctcgatccccgtgttcgaaaagttcgcccacgaggtgtacggcctgtaaacacggaccgcaagtaacaaacacaagaaaggggttgccatggaatacaccgaagacgccgatcgtcgcgaactgctgctgcacagcgcctatgactccgatacggtccgggccatggagcgacccctgctggacaaaggcgtgccgctgatgcgcatggccgcccaggccgcggcccacatggcggccggtatgctggacgacgaggatctggcgctggaggacacgtcgatcgtgctgctggccggggccggagacaatggtggcgatggtctgttcgcggccgccgcgctggcccaggagggcgcgaacgtcaccgccatcgccgtgggccggtcgttgcatgaggccggattcgcctcattcgtgcgcgccggaggcaaggtgctggtgcttgatcccgcggctgatattcccggttgcgcgtccgggttttccgccggtgaggccggcgagcgattgcagaccgccatcgccatggccaggaaatcgcatctgatcatcgacgcgatgaccggcatcggcatccaaggctcgctacgcggcatccccgccgcactcgcctccgcccttggtctcgacggcgaggctcccgatgagcccgccctgccaaaccgtgagtcgtcaggcgattttccgctggtacttgccgtggatacgccatccggcgtcggtgtgaacgatggttctctgcccggcccgtacattccggccacggtcacggtcacgttcggcgcgatgaagccgtgcgcggtgctgccgcccgccacgttcgcctgcggccgtatcgagttgctcgatttcggattcgatatcgacgacaaggatccggacgtcgaggtggtggataattcgttcgcgtccgacgcggtccgtctccccaggttcgaggattccaaatactcccggggcgtggttggtctggtgaccggctcgcagcgctaccccggtgccgccgtgctcaccgccagcgccgccgcccgcgcgaacaccggcatggtccggtatctgggcccggagcgcgcacagaacatggtgctcgccgcactgccggaagccgtgatcggcaagggacatgtgcagtcctgggtcgtggggtccggcgtgcccgaggctagcgtcgagggcaccgacggcgatatgcagcgggacaccatcgccgcattgctcaagcattacgcgctcggcagcgaggatgagaacaaggacgcctacgacatgccgccaatcgtggtggatgccggcgcactcgacctgctgccggagcgtgtgcccggccaggtggtgatcacgccacatgccggcgagatggcgaaactgctcaaccggttcgaaaccgccgccagcaccgcggagcatgccgattcgcacgagccgtacaccgccgacgacgtgcggttgaacccgttggccagcgcgaagcgtgcccacgagctcaccggcgccaccgtattgttgaagggcgcggtgaccatcgtggtggatgaggaccacgtctatgcgtcgggtagcgcaccggcctggctgggcaccgccggcgcgggcgacgtgctggccggtctaaccggcgccctgctcgcccagcaggatgacgtggccaccacgggcgagaccgtggcctcggccgcctacctgcatggcctggcggcggcgatcgcctccgaatccgagcaacaaggctggcaggagccggaactgatcggccgcgagcatcgccagcgcttcatgacgctcggccacccgattgtggccggcgacgtggcccacgccatccccgaagccatcgccgacgtcatcgcatgattccgtacgttggctcccctcagagaggggagccaacgtatgaaaccccctatactaaatcgcagaccccactcaacggccccaacaacacaaggagcatcatggccaactcccccatcaccgacgtgattttcgacttctgcggcgtgctgctggactggaacacccgcgcatgcctggaaggccgattccccgatgagatcgtggaacgcatctgcgccgacgacgacccctgcggcttcttccgctacgaggaccgcatggacaccggcgaggatttcgcggacatctacccggatgtggtacgcgaacaaggccaggaactcgccgacatcttcaagttctacatcggccactacgcggacgcgctgccccgcacgcttccgggcatggtcgagctgctggcggatttgaaggcccacggctacggcgtatggggtctgaccaactggtcgcatgagaccttccacctggccttcgagaagtacccgcgccttgaacagctgttgcagggcaccgtggtctccggcgtggagaagatgcataagccgaacgccgacatctacgagctggccctgacccgtttcggcctcacggccgagcgctgcgtgttcttcgacgacaccgccaagaacatcgtcggcgccaacgaggtcggcatccacggcatcctcttcgagaacgcgttgcaggcacgcgaatcgctcgcagaactcggcgtacgtctgtaagtcgccaaacgttgcatcgcggcagttgaagtctatggacccgtccttgacgacggtgaccggccgtgtggcgaccatccctagcgatataaatagactttatgacactgctgcagctgaaatacatcgtcaaaatcgtcgagtgcggctcgatgaacgaggcctcccatgccctgtacgtctcccagccggccctgagctcgtcggtcaaggaattggagaacgagctgggcatcgagatcttcacccgctcctcgcagggcatcgccctgaccgtggacggcgcggaattcctgacctacgcccgccaagtgctcgaccaggccgacctgctcgaagagcgctacaagcacgccaaaccgcgcaagcagctgtgccaggtctccacccagcactacatgttcgccgtcgaggcgttcgtggagatgatcaactccatcaagtccgacgaatacgagttcaccatccgcgagacccgtacacgtgacatcatcaaccaggtggcgaacatgcagtccgaaatcggcatcatctacctgtccgacttcaataaggacgtgatcggcaaactcctgcgcgagaaacaccttgaattccatccgctcttccgcgcccccctgcacgtgttcatctcacgggacaacccattggccgccaagaagatcatcaccatggaggacctgaaaccctatccgttcatccagtacgaacagggcgaggaaggctcgttctacttctatgaggaagcggtctggccggaatactcccccaagcagatcaacgtgaccgaccgcgccacgatcctgaacttcatcatcggcctcaacggctacacggtgtgcaccggcatcgacaacggcgacctcaacaacgagaagatcgtcaccgtgccgctcgacaccgacgaaacgatgttggtcggctggatcacgaacgagcgttccaagctctccaaggccgccgaaacctacctcaccaagctcaagtccgtagtctccgaccacggctacaagctcattgattaggagtaagtaaaacaggcatggtcagcagtgagatatactgcgattaagccaaccccgctggggaaatggaagcaagagccggcccctgagtatctcaggggccggctcttgcgctattgagactgactggcaaaaccagtttgatggcctccgactacttggccaagattaccgacgcggcggctgtcgcggcgaagcctttgagcacctcaatcatcacgtcgcgatcttcgacatcaatgctgcgggccgcggcgagcattaccggcaacgactgcgtcacgtgcgacgtgagttcgccgaacgtgacgtacccgccggcctcgaagatggcgaacaggttttcgatgaacctgcggcgatgctcatcatcgtatttcgccatccatccgttgatcgtgcgcgccagatactgcgcactgttggcgagcccatcggcctgtacgaatcggccatgatcgacctgccagtgcagggcaaaatgctgcatgatgctggcaccgtcgctgctgaccaccgtatagccgtcttccacatgctcacgagtctcaaacagcatgccgatgatcgacgagcccggtaccgatttatgaatcttcgacgcaatgcgcgcgtacccatcctcatcgaagaacgcctcatcgaatccaggcccatcgtgcgaatatacgaccgtgatacgttcctgaatctcgctaggcacattggccgccgcatacaccgccagattgccgcctttggaatggccgccgaccataatcggcccggcccaatggccagccagctcggtcagataacgcgcggcggcctcctgcgaggcgaccgggcggcggaacgccatcatgaagtcctctttccacccgacgattgagctgtcggtaccgcgaaaagccacatagagcgtgccgttacccagttcgaacacgcaggccgagaactgcttggtggttgcagcatcgaattcgtccacgtatgcgcccacgcgtaggttcctccaacgtgggctctcgctcatcgcacgtaacagatcgacattcatcgaaggcgaccacaccttgccgaacatgtcgtcatagcattcggcacgcagcaaatcgtgaatcggaaccgtggcgatcatgccgtcggcggtctctgcattctcgtgatagcgcggcacgttatccggcatgcgagcataggccaactgggacaaagcgaggctatccgcctcggtgaacggcagttcggcgaaagtgtcgaaatgttgccgaatatcgtcggtgatgttccccatagcggccttccttgttcgaatgcaacgaacctacggtaattctacgccgagcgggttttcatcacaggcgagtcggtcccagagtttagaaccctatctcgctttcaagggagctgatttggccttctggagacatttatctccgtttcaagaggctgttcatccgtcatatcccgagtatgagcggcgtcaccccaacgtcattccgccattttcatgctgcttctacttgggcatcagcatctcggcggtcttcttcattaccttgcgacaacttgttcgctttgctgtccagatgatgctcgatgccgaagtaactgcatatccccacgagcgcaaacagccctatatcaactaaccagttcatagcacgctccttgccaaagcttttgccttaatatggtgctgctgttcatggaacgtaataaaaaaagcgggctcgcaagcccgcttttggtttttagattgaagacgatcaggcgccgtattcctcaaggtaggcggcggcgcgctgctggatgtcgtggctgagcagcggggtaccgtcggggttcttcatcttggcggcggcgtcgaagatctcgcgcacgttggcgatggagagcaccgggaagccgaattcggcttccacggccttcacggcggacatgtcggagtccttggtcttctccatgcggtccacggagagcacgagacccacgacctcgacgttcgcctcggccttgagtttggggatgacttcgcgcacggcggtgccggcggtcatcacgtcgtccacgagcagcaccttcatgccgtcggtcagcggggtgccaaccatccagccgccgtcgccgtggtccttcttctccttgcggtcgaaggtgtatccgacggtcatgttgtggccggcggtcagcgcgatcgcggtggacacggccagcggaatgcccttgtaggcggggccgaacacggtgtcgatgttgcggggaatcgtgttgtgcacgatggcctggctaatcttttcggcgtagaacgcgccgagcgcggcgatcttcttgccgtcgtcgaaggcgccggcgttgatgaagtacgggctcttgcggccggacttcagcgtgaagtcgccgaacttcagcgcgttggattccaacaggaattcagtgaagcgatgtgcgagtgtttctgccatgatgttccttacctccaagtctgtcctgcggccagtttagcagcgagttcgggacggctgtccaacaggtcgtcgagttcgcgggcgacgcgcagcggggccaccgggtcgaagagcgcggccgcacccacttcgacggcgttcgcgccggcgtacaggtattcgagcgccttctcgccgctgtcgatgccgccgaggccgatgatcggaatctccggcagtgcggtgcgcacccgatagacggctgccaggccgaccggcagcacggccgggccggatacgccgccggtgacgttggcgatgatcggcttgccggtgcgaatgttaatgcgcatgcctttgagcgtgttgatcatgctcaacgcgtcggcgccatgttccacggccgcgcgcgccggcacggtgatgtcggtgacgttcggcgtgagtttgacgatcatcggcttgtcggtcatcgggcgcagccggtccataagattggcgagggccaccgggtcggtgcccacgctcatgccgccggcggaaacgttcgggcagctgacgttgatttccagcatgtccgcgtcggagtcggcgagcttttccacgaccgccgcgtaatcgtcatcgcaatgtccggcgacattggagatgacgaacgcgcccgcggccttgagcttgggcaggtcctcggccaagtaatggtcgatgccgggattctgcaggcccacggcgttgatgttcgcggccggcgattcggcggtgcgcggcgagggattgccttcccacggtacgggcgaggcgcccttggtgcatacggcgccgagctggctgacgtcgtagaaccagcggacggcggcgtactggaaggtgccggaggcggtgccgaccggattcttccattccagaccggccaccttggtgtggtgcttccacacgtggggctcgtacaggttgatgtggttgtcgccgccctgcgcggactggttgtttgcgctcatcgtcacttcccccatccgagctgttcgcgggtgaacacgggtccgtcggagcagaccttgaggcggccgtccacggtgtcgatggtgcacagcacgcaggtgccatagccgcagcccatgcgctgttccatgctcagctgcgcggggatgccgcgttcggcggcccagtcggccacggccttcatcataggcagcggtccgcaggacagaatgatcggcttgcgatcgtaggccttcaggtcgtcgccttgttccagtttgttgagcaggtcgaccacgttgccttcggcgtcgtcgatgctccacgaccagtccgcgtaccgggagacgtattcctcggcgaagtggtcgttgcggtaaccgaatacggcggtggcaaaggaggcgtcgtgttcggcgagcttttgcgcggcgtagattagcgggggcacgccgagtccgccgccgacaagaatgtagttggcgtcttccttgaggttgaagccgcggccgagcgggccgagcacgtcgacggtgtcgccggcctgcagtcctgccaactgttcggtgccgtgtcccacgacggcgaagatcacgctgacttcgtcgccgtcgacttcgctgacgccgaacggacgcggcatgagcatgaagtcgtcgtgcgtgaacaggttgacgaactgggcgggcttggcatgggaggcgatgaacgggtcgcggaacgtcagtcgcatcacgcggtcggtcagttccgtaacctgcgtgatttcgacgttgtggcgcggcgggaagaatccggccgcagtcgcttccgtaaccacatcatgggtgggggtgaaagttgtcatttcattcctattcagcacatcaagctccccctatcaggggagcggtcaaccgcaggttgactgagaggtagttaaacacactcggctccggtttccagcccacactcacgtatagcccacagccggacaatctacctacctatatacggcaacccgcagattatcgcgcatgtcgagcgccgcctggcgcgcgctgctcgccacaaggtccagcgcctcgtcggcggtcatggattcggagtacttgccgctcttcttccatgcgccgataatgccgcgcgacgagttgacgatggcgccgctgccctgcttgtcgaacatgcctgccacgtccgcggccgtgccgccctgcgcaccgtagcccggcacgaggaagaacgtgtgcggcatacgttcacgcaacgccttgccttcctcggggtgggtggcaccgaccaccgcgcccacgcgggagtagccgtggctgccgatggtctcggcgccccatccttccacaagatcggccacgtgctcgtagaccttcgtgccgtcggccaggtcgagcatctgcagttcgctggaggacgggttggaggtgcgcacgagcacgaagatgtccttgtcggcttcggcggcggcctcgacgaacggggtgatgccgtcggtgccgagatacgggttgacggtcaccgcatcctcatgccacgggtcgaagtcgcccacgccgttcaggtggtgggcgtaggcggctgcggtggagccgatgtcgccacgcttgatgtcgccgagcacgtagaggccctgctgggccgcgtattcgcaggtcatcgtgtagatgtccacgccggcggggccgagcgcctcgtacatggcgatctgcggtttgacggcgggcacgatgtcggcgatggcgtcaatgatcgtgcggttgtattcgaagtaggcgacggccagctgcgcggattcgacttcctccggggattcgaccgagtcacgcacctcgtcggcaaagctcgccacgacctgcggcggcaccagcgcctcagtggggtcaaggcccacgacgctggggttctgagtgttgtcaatcgcttcgatcaggcgatccatgctgctccttgtgttatctacagacggctgaacatcagctgggagccgatgattgtggcgagggggcgtccggtgacctgccagccgccgaacggggtgttacgagccttggagtggaactgttcggggtccacggtccattcctcggcggcgttgagcaccacgaggtcgacattgtcggcgtcatccacgcggctcaagtcgagcagtcggttgacgccttcacgctgcggctgagcgtcgctctcccccgcaatcacgccatccggatcatccccggtgggcgcgggttcggcgtagtcctcgaccagcgcggctacgtcggttggcacatgccccatgagttcggcaggtccaacggacatgagctcgatcagacgctcatcggaaatgaagccgccgtcgacgagcaccttgtggcacacgccgtacgcgcattccagtccgatgatgccgttgggcgcctcaaggaagccgagttccttctctgccaacgtgtgcggcgcatggtcggtggccagcagatccacggtgccgtcggcgatggccgcgatggtggctttgcggtccgcttcggagcgcagtggcggattcatcttggcgagcgtgccgtacttgagcagcgcctcgtcgctcaacgccagatagtgcggcgcggtctcgcaggtaatcggcagtccttcggccttggccctgcgaatcgcctcgaacgagatggcagtgctcacatgctggaagtgcacgtggacaccggtgcggcgggccgcttcgatatcgcgggccacgatcttgagctcggtgtcttccggaatgccgggcacgccaagctcgcgggaaacggggccttcgttcacggcacctgtatcgtgatgctcgcaatgctcgatcaggtacaggtcggaggccttgacgttctccagcacctggtccaggatctccggcgtcacagcggaaccgtcgtcgctgattgcggtgatggggtgcgtgagcatggccggcgtcttggcgtcgtcctcgaatccgggcacgtacttgagccaatcggcaacgtcgcttgcctcatgaccggcgcgatccttggacgcgcacacgcacagatcgtaacgaaccggcaattgaacgtcatgcgcagtatcgtactgctgcaggaagtcgatgacgttgtcgaagccggcatccagaacctcttttgcaccggtcgcttccgggccagacacggtctgcccatccagtgccggcaacgtgttcggcatgatgagcacgttcgtgtatccgccggatgcggacgcacggcagccggagaccatcgattccttgtaggtctggccgggatcgcggaagtggacgtgtgggtcttcgaaaccgggggccacggtcaggccggtggcgtcgatgtcggcgccgtcagccacggcggaggtgtcggcgaagtaggcggcagcggtcccgggcaccacgaggtcgatgacctcgccggtgttccagaccttgatgttgcgtagggtgatgctcacagtttggcttcctcgtcgcagtagtcgcagcggtattcgagccgctcggagtgcacgaggtggaacatctgcttgatgccgggctcggcggtggtcacgcagcgcgggttcacgcaggaaatcacgccgacgatgtgctcgggcaggttcggctgcttcttttcgacgatcttgccgccgcgcaccacgtccacggtggcttggcgggccacgaagccgagcacgtcgaggtcgatgtccttgtcatcttcgattttgatgatgtccttggagccgtaacgcttggagtcggcgttcatgatgagcgcaagcttggttttggccgggtcgattttcaggtattcgagaaccttcagcgaggttccggccggcacatggtcgataatgatgccgttctgaatgctggtgacttccatcaggcctgaacctccttggggttgagcggttcgtatccgggcagttcgtcgcccaccacggtgctttcgagggccatgcgcacgagcatgccgttcttgacctgttcgaagtaggcggcacgcgggtcgtcgtccacgtccacggcgatttcgttgacgcgcggcagcgggtgaagcacggccatggacggcttggcgagctgcagcttctcttcgtcgagaatgtaggtgtcgcgcaggcgcaggtagtcgtcttcgttgaagaagcgttccttctgtacgcgggtcatgtacagcacgtcgaggtcgccgatcacggaggccaggtcgcgcacttccacgtaggagcagctgtcggtggcgttgatgcggtcgatcacgtactgcggggtcttgagctcgtccgggctgatgagcacgaagcgcacgttgccgaagcggcacagggtctcgatcagggagtgcacggtgcggccgaaggtcaaatcgccgcacagtcccacggtcaggtcggtgatgcggccgaagcgcgactgcagcgtggccaggtcggccagcgtctgcgtggggtgcatgtggccgccgtcgccggcgttgattaccggcacggatgcggcgcgggaggccaccagcgcggcaccctccttcgggtgacggatggcgaccacgtccacgtagttggacacggtcttcaacgtgtcggcgatggattcgcccttggtcacggaggccagctgcgcgccggcgaatccgatgaccttgccgccgagacgtagcattgcggtctcaaagctcaggcgcgtacgggtggagggctcgtagaacagcgtggccagcactcgcccatcgcaggtatgggcaatctctttgcggtgggaatcgatgtattcggccttatgcagcaggtcgagaatctggtttgtagacaggccgtccagcgttacgacgcttttgccgaccattggcgtttcttcagacaaggctcaccttttcgctcgtggttttcaggtggccacccttgcgtgacctaatctaacttacgccatttttcggacagccgcattcaccgagtgtccacctgaaaatccaacgaatatgctgccttatcgctgcgcgcggcgtcgatttcgttccagtcgcggtgcgatcacgtgcatacgcgggcgaggggcggtttgcggctgctgcgttgcggcggaggccgtggcggtggttgccgcagccgcctcgccttcggtcttcccatagaacaagcgctggcatacgtcacggcatttgcgcatcacggccagcaggtcgttctcgaaatgctggccgcggtgggcaccgtagccgaggtagacggcgatgccgcccagcgaatagatgtcatcaggcagaatatcggcctggttggcgcgcccgctccacagatagctgccgttgcgggccgcggtgcacaacgtccatgccttgcgcagctgaatcgcgtcgatagcgctgatgagcttcttggcttccagcacgtccaatgcctccagcgtgccgttgacgcgcagatctttgatatcgccggcgtgctggagctgcatgagttgcacggtccattccacgtcagacaagccgcccttgccgagcttcagatgccgttcacggcgcacgccgcgcggcagacgctcggcttccatgcgggccttgagcttgcggatgttctgcaattctgcttcagtcagttccgtggtcgggtagcgcagcgggtcggcgatgttgatcaggaagtcccgcgccagttcagcgtcgccggccgcgtaccgggcgcgcagcagcgcctggcgctcccaggtcgaagcccaggattcgtagtattcctcgcaggaggcataggagcgcacgagcgggccgttcttgccttccgggcgcaggtccaggtcgagttcgatcttgggttccagcgtcgtcggtccttgcaggatgttgcgcaggtcttccacgaccttcttggcgaaggcgttggcttggccgtcgtcggcatcgtcggccggacggtagatgagaatggcatccgcatcggagctgaagttcacttcgcgcccgccgtaacggcccatggcgatgacggtgatgccggccggcgcggtttcgacgccgaactcggcgatctggtggcgcacggcccaggtcagggaggcatcgatgatcgcgtcatacacgtcggtcatggccttgagactgtcggagtcgctgatcacaccgctcatccaagacaggccgatgcgttcgatttcgtggcggcgcatggcgcgcatggaggtggcgaactcgttgatgttcgagccgaaacgttccagcgccgagccggtctgcacgtccaaggcctcgcgcgtgcgggcctgcagattgtcgtcgtcgccaagccagctgatcgattcgaccgacttgttgagcgcgtcgcccaggaatcgtgagttggacaggatgtggcacaggcgctgggcggcggaggtggagtcgcgcaggaagccgaggtagccggattcggtgccgaagttctcctccagtttgcgccagttgagcaggcccatgtccgggttctggccctcgcccagccactgcaagacggcgggcagaatgatgcggttgattttggccgcgcgccccacgccggcggtgagcgcctgcacgtggcggatggcggcgtccgggtcgccgaaaccgatggattcgaatcgttcctgtgctgcctcgacgctcaggacgatctggtcgttctccatctgggcgttgaccggcagcatcgggcgatagtagatgtcgaggtgcaggtggcgtacttcgcggcgggtgtcgtcgtacttgtcgacgagttcttccgggtgcaggccgaatgcgcgggcgagtcggcgcagctcctggttctggttgagctcgtccacgtcgatgtcgcgcttcttttcgaggcctccgaccgaggcccggccgaggtccgggaacaggtgcgtgcgcttcagggaccagatctgctggcgatgttccatcacgcgctcgaagcggtagtcctgggacatgcgcacggcctgcttgcgcgagacatagccgccttcggacaggcgctgcagcgagtcgagcgtgttgctggtgcgcagcgattcgtcggtgcggccgtgtacgagctggagcatctgcacggtgaattccacatcgcgcagaccgccgcggccgagcttaatctcgcggtccttcaggggcgcgggaatcaaatcctccacgcgcttgcgcattttctggcagtcgtagacgaagttcttgcgcttggatgcgctccacacgaacggccgggtcatgtccatataggcctgaccgaggtcggggtcgccggccaccgggcgggccttgagcagcgcttggaactcccaattctcggcccactgctcgtaatagttcttgtgcgaggagagcacgcgcaccagcgcgccgtccttgccttccgggcgcaggccgccgtcgatctgccacagcggctgctcggccacgcccatgatggcggactggcagacgcgctgtaacatggtgcccatcttggtgcccacgcgaatcagcgtctgatggtccacatccttgtcggccggttcgaccacgtagatgaggtccacgtcggagacgtagttcagttcctgtgcgccgagtttgcccatgccgatgatggtgaagcgcacgtgctcgctgccctcggtttcgtggcgggcgatggccagcgcgccttcgagcgccgcgtccgcgaggtcggacagttcgcggctgatggtcggttggatggaggtcgggtcgtccgccacggcatcctgggcgatgatggcggccagttggttccggtagctggaacgcagggccgtggccgcttcggccagatccttggaggcgacgggcatggccggttcgtccgggtccgcgccgaccgccttgagcagacgtgcacggcgttgcgcgtgattgaacagatggctgttgcagttgtcgactgctgccgcctccacaagctgcggcttgaagcgcatgaacttgcccatcgcgtcggagacgccgagcaccgtgaccagacgcttcagggcgtcgttgtcggggatgacgtgttccagatcgcgctggctggattgcatcgcgttgacgatatccacgaaattgctcaatgccatatcggggtcgcaggcgtgggccagcgcgctcagcagttcggcgcatcgctcatcgggaatgtcgtccgccttgagctggtcgaacaaggcgcgggccttgtcgaggtcttgcagacctgccctgatgaggtccatggagctgggtttgaagatcgacgattccataagattccactatatacgctcatgccctccgaatggggcatgagccgggaaggagtcatcgggcgacgctgatgagctccgaggaatccatatcgtaatcgaccatggcgtaggaacggatggcggggtcatcataggtgttcatgtaataggtgttggtcttggacgaatatccgctggtgaacagcgtgcgttcgaactggccgtcgcccatcttcgccatgccgtccatcatctgcacggagccgagggtgtggaacaggcgcgacacattggtggcttcatcgttctgctgcgggtaatgcgcgttggtgtaggccacacgaacgaagcgcgacggggagctcacgtcgcccgggatgccatgcatgcccacacccgcaccccaggcggtcaaggaggccttgccccatgaagtcggttcggccatctcgttgctgacgcacatgtagttgcgcagattttccatatggaagtcgaatgtcggctgattggtcagcacatcgacgtcatcatgatgcacgtgcatgccatcggccatctgctcgacgacgatgctgcgcttgccgtcaccgatgaaccagtgcagcagagactcctgctgtcccggcacgatctgggagacgagcgtcacgttcctgagcgcctcctcgacctcgtcgacggagtcgaaattacgcgccacccacagcggaaattcgaacgtggcgacgttttccgtgccttcgaccggttcgtggacgaacgaggcgtagccggggaaattcaagccggcgatggccagaccatgttcattggcgcagtcgaaatacatcggcctatcggccatgaccacgcccacgccgatcaccgcgttcggcttctccttgccgcccgcaccgaacaccgtgtcatagtggtagccgcgcggagtgaccaggatggtctccccatatgagaaactccagtcgagattacggccgaaataggtgttgccctcatcatcggaaaaacggacgccggtgcacataacggacttccttccatcgctttggttggcttgcacgttcatgatacccatcggccgctgggggaactctgggtttcgccagcagattaacgtgcggcgcggcgcattgagatgcgccgcgccgcgatatgcatcaaccttgcgtaccgaggaacaacggttccacattgcgccagatacggcgcgtagtggcggggtggttcatcgaatacaggtggacgccgtccacgccgtgggccacgaggtcggcgatctgctcggaagcgtagaggatgccggcggtacgcagggactggatgtcgtcctcccacttgttcagcagggtgttgagcttgtccgggatgcgcgaggcgttgcgctcggccatgcgacgcacggacttggcgccacgcaccggcatgatgcccgcctcgatcggcacggtgatgccggcggcgcgcgccttgtcgaggaagcggtagaagtcctcattgtcgtagaagagctgggaaatcaggtgagtgacgccggcatcaaccttgattttgaggttttcgatgtcctggtccagcgagtcagcctgatagtggccttccgggtagcaagcaccaaacaccttgaagtccggcttcacggagcggatgtatgacacgaggtcgctggcgtggttgaactcgccgaccagctgctcgccgtcgatgtagtcgccgcgcagcgcgagcacggcgctcacgccggcttcctcgaacatgtcgagagcctcatcgatcttggccttgtcggagtagagcgcggtcaggtgggcgactgcagggatgccgtattccttgctgatcgtgtgggcgatgcgcgcggtggcggtgcggtcggaatgggtgccgtgaccgtaggtcacggagatgaagtcggggttcagcccttcgagtccgtcgagggtgtcgtagatggtgccgacaggcgcgttgcgcttcgggggaaagacctcaagggtgaacatcggggaatgcatgctgatttccttacataaacccgagctccctcatccagagggagctcggtgatttccgctacttgtcgagcttggcgcgcacggccttggcggcggcgaccaggttctccagactcggccaggtctcggcgttaccacgggtcttcagaccgcagtcagggttgatccacaccttcttgacgtccatcttgtcaaggatctcgtagatacgatcctcgatctccttctcggaaggaatacgcggggagtgaatgtcgtagacgcccgggccggcctcggtctcgaagtgcgcgtcatgaatggcgtcgagcaccaccagatcgccacgggaggcttcgaaggagatcacgtcggcatccatcgcgtcgatgtcgcggatgatgtcgttgaactcggagtagcacatgtgggtgtggatctgggtggtcggcttgacggcggagtgcaccagacggaaggccggaacggcccagtcgaggtacttgacgtgccagtcggacttgcgcagcggcagcttctcacgcagggcggcctcatcgatctggatgaccttgataccggcggcctcgagatcgagcacttcgtcgcggatggcgagggcgagctgcttggtctgctcctcgtgggtgatgtcctcgcgcggccaggaccagttgaggatggtcaccgggccggtgagcatgcccttcatcacatggtcggtcttggactgggcgtacgcggaccattccacggtaatcgggttggcgcgggaaacgtcgccccagacgatcgggggcttgacgcaacgggtgccgtaggactggacccaagcgttcttggtgaacaggaagccgttgaggttctggccgaaatattcgaccatgtcgttacgctcgaactcgccgtggaccagcacgtcgaggccgatctcctcctgcttcttgatgacggcgtcgatctgggctttgatgaactcgtcgtaggcttccttggtgacctcgcccttgcgcagcttggcacgctcggcgcgaatctccttggtctgggggaaggagccgatggtggtggtcggcagcagcggcaggccgagggcctcgcgctgcagggcctgacgctcctcgcgggcaggctgacgcacgtagtcggcgtcggacagcttgccgatgcgctcggcgacggccgggtcggcggccacgcgggtgccgtcgaacagagcctggttggcggcgagggcggcggatgccttcttctcgtcctcggtggcgtcggccagggcggcgacttccttgagctcgtcgagcttctggacggcgaacgcgaagtgcttgaggtcttcggccgggatgccggtctcgccttcggtgctgaacggcacgtgcagcagggaggatgcggtggagacggccacgttggcggtgacctgcttcagggcgtcgaccaggccgagggaggtggcgtagttgttgcgccagatgttgcggccgttgatcacgccggcgaagatggtggtgttggaggccacgccatacttggcgacggcttcgaggttctcctcgcgaccttcgttgaggtccaggccgatgccgtcgaagccgagcaggttgacggtctcgtacacgtcggcgatgtggccgaagtaggtgttgagcagcaccttgacattgcccttggcggacaggatcttggtgtacagggtcttgaagagttcaacgtcgcccggctccttgtcgagcacgaggtacggctcgtcgagctggacccatgcggcgccgagctcgttgaacttggcgagcacttcgacgtagacggcggccacggcgttgaccaggcccttgtcgagctcgagttcggtggcttccggggtacgggcgagcttcaggaacgtgtacgggccgatgaacacgggcttggtgtcgatgcccagcgccttggcctcgttgaactcgtcgaacggcttggtggagttgagcttgatctccgcggccgactcgacttcgggcaccagatagtggtagttggtggtgaaccacttcttcatcggcagggcggtcacgtcgcccttgtcgccctggtagccgcgggccatggcgaagagcgtgtcctcctggttgtcgaaggagagacgtgcgtaacgctgcggaatcacgttgagaaggatggcggtgtccagcatctgatcgtagtagctgaagtcgttgctgggaatgaggtcgatgccggcggcctgctgcagcttccagtgcttggcgcgcagttcggcggcggtggccttgacggcggcgaggtcgttggcacccttccagtagccttcgatgatcttcttcagttcgcggttctgcccgatgcgggggaagccggagacggaagtcagagtggacatgaatcctccaatgtatgcgttcgtaacccgacttagggtagcaaaacatccggattccggcccttataaatggccgcagagtgtcgttatagatggaatttatatccgctttagtcgaagtctttcacattgatgaccgcgagcagttcgccgctgtgcacctgccattcgtcgaacggtttgttcgatcccatgatcacgatggatgcgggcgaaagtcccaaattcagcaggtcgagtcgttcgccgtcggagtcggcggaggcgagccattgggcgctgatcgacacagtcggctcgtggcccacgatcatgaacacgcgattcttggccttgacgtgggcgagctcgtcgaacaccgcctgcactcccccgtcatacaggctgatgcggtagtcgacgatcggcttgtcgccaaaggtcttgagcatgcggtccagtgtctggcgcgtgcgggtggcggacgagcaggagatctggtcgggcaccagtcccagcgactcgatgcccttgcccacggccttcgcctgtttcagacctttgtcggtgagctcgcgctccgagtcacccttgtcgccgaacggctcggccttggcatgcctcatgatgatgaggatatggtcgtattttttcgctgctttggcgactttgctcagcttgatgcccatccgtggctcccttcacgaaccgtctgcccggtgtggcggtgtggcggtgtggtattgcttccagtatagaggtgtgtgagcgttcacaaactcatcgtttggcggttattcatgcgtgttgccgagttctcccacctgacggtcgaggtcgcgcaacaccttacgtagtttgtggtcggagatgtcgcgcagttccagttcctcgatctgcgcctcacgctgttcgtcggtgagcgagtcgatgtcggtctgcgtgtccttggtcacgcgatcgcgctttctgagcgcctcgaatccggaggccatggcgcgcgagataacaaggaaaccggtatggccgatcatctggtggtcggggcgtacggcgaggccttgggccttccatgtgcgttcgaacgattcctggatctgcggctcggtccagcaaccggccgcgcgcagggcttcggccagtcgactcatctgcgtggtggtagttacgtaactgaccaacacgccgccgggggcaatcacgcggtatgcctgctcgagtctgttccacgggtcgagcatgtcgagcatgatacggtcgaaccagtgttcgggcagttcggcggccacggagtcgaagtcgccggttttgagatcccaccagctgggggcttcaccgtaatacagcgtggcgttggcctgagccactttggcgaattcggggcgcagctcgatcgtggtcagatggccgcgctcgcccacggcgtccagcaggttcacgctcatcgcgcccgagccggcaccggactcaagcacgcgcatgccggaacggatgtcgccgagctggacaacctgggcgatgtccttcggatacatgatctgcgcgccgcgcggcatcgacagcacgtaatcggccagtcgcgggcgcatcaccgcatattcccagccgccgatggcgcgcgacgacttccacggcttgttcttgtctttctcggggtagacctgattgacctgcgcctcgcgcttggcgtgcacggtgaggatcacggtgccttcggtcttgccgatcacatcgtcatgcagaatcaggccatgctcggtctgcgtggagccgccggccacaagctgatcggtgatcttcttgcccttgcggtcggtgaactgcactttctcgcctgcggtgagaggcccgcgcctcggctccataacttgctccttgcgtgctcggtgggtcaatcgctacaagtctaatgcatgtaagctcgttggtgaggtgatgacgatgcgaatgcagatgacaagccagatcgatgccggcggcaatgaccccattttcctgatgttccacggttacggcaacgacgaaagcgagatggtgcggattctcgacgccgtatatgcgccgacgcgagccgatgcggccccgtccgcaattgccgccgtacccagctatatctcgttccgtgccacctacgcgaggccctatatgggcggcaattactggtatcccgacggctgcggcgtggacgagcgccaacgcgaatgcgcggcggtcggggatgcggtggcttcactgctggatgcctcggcattcgcccatcgcaggaagatattgatcggtttctcccaaggcggttatctgtcgtatcgtctggtcaaggcgcatccgacgttgttcgatgccgcgatcctgctcagtccttcgttcatgggcgaggaacaggcggcgcttgactcccctacccgattcttcctggcgtatggcgcgcaggaccgcacgattccgatgcccgaccagcaaacggcccatcaggtccttgaacgggccgggcatctgacctatcgcgagtattccggcatggcccatgccatctgtgatgaggaaatcgccgatatccgggatttcctacgtgccatatgatgccggaatagcttcaatatggaatatctccgttcaaagaggtaccggtccaagtagaagcggctcaacaatggcggaatggcgttggccacgcccattcatcgcgcgatggttctgcgatcagctcaattcccctgccggctgatgccgcccttatgaccggtggccttgaatggcgtggcgcgtgccgtcaccttcggccccggcagattcgtactggtattggatcgaccgcggagcccggcagccggctgggactcggagcgtcgaccagtacccgtgatgttggtatgccgtttgccgtcgtgcgcccgtttctcaccagcaccttcagcctcgtcaatatcaatgcctttggcgcgcaaagcacgcgcccaccgctcatccatcgaactcctcacacatcccattcgggtttccacgtgtactgcatgtcgtaggcgctgggcgaacggcggcaggtggttcagggtgatcggaccgaatgcggcggcgtcaaaagacatcgtttgctcccttcgatggtgtttggccaacaggttccaagggtcaggcacagcgcctttctcaacccgttcgccgccacgatgaccggcagcttgcgttcacgggttcccctgcaatgcgcctcattatggcaacacgaaccgacaggtgccggctgcgcctaggatgggaaatcattgctacacgccgaaaggggaaggcgactgtcatgaggtatttcacgaccgacacgcatttcgggcatccgctggtcacggtgttgcgagggtccacgacgttcgatccgacgcgctcgcgctatgaggaggtgctgcgcgcgcatggtcgcaagaccgccgaggattgggccaaggaggagacgttcggcgcggggctgacgtttcgtcaggtcgccgatacggatgcgcatgacaaggcgattgtggatcatatcaacgctgtggtcggcccggatgacgagctgtggattctgggtgatatcggtttccgcacatcgctgacccatctgaagaactgcctgcgagcgctcaattgcaagcatctgcatggtgtgatcggcaaccatgatgactggtggcgggaagaccgccccgcacttaacctgttcgaaagtttggagccgcacgatacggttgagattgagggactcggtacggtcaatctttcgcattacccgtatcgggaggatctgacatacagttggcccgatgatgtggcgaagttcagcggcaaggcgttgccgtttaacggccgcaaactgctgtatggtcatacgcatcagctttcgccagatggtgcacgcccggaggcactgaatgttggcttggatgcttgggatttgatgccggtgagtgaaacacaggttgtcgagtggttccgcaatcacgatgtcgactcgcccgtgaacgggaccagtaaggccgatgattcagttccctcgctcgatataccgtcgttctgatgtgattcgcggaatgttcgtgtcgttgttctcgtcgtgggtggattgacacagcattaactgccgttgagatgtatgcacgctgaacacgcgcctcaacggcagtggtctcgtcatctctcgctcacaccaacggattgccggctgcctgatacagcgaccaccagtcacggcgttcgagttcgatatcggcaccggccgccatctggcggatgcgctccggtgtcattgagccgagcaacggctggataccggcgggatgacgcagaatccaagcgacggcaatgccgttgggcgtggaaccgtatttgccggcaagacgggtcaattcggcgttcagctcggggaaatgctcgttgccgacgaacggaccgtattccgtgccggattggaatgggcaccatgcctgaatggtcatatgcttcagccgtgaataaggcaggatgccaccggtgcgatcggctgcgggatcgctcgccatattgaattggatttcagcgtcgagcatctgtgtatgcatcaggccgaactgcagttggttgatttccaatttctgacgaaggccgctttgcaatagttcgatctgccacgggcccatattgctgactccgaaatgacgcactttgccacttgattccaacgcatcgaatgcttcggcgacctcgttcaactcaaacagcgtgtcaatacggtgcagcagcacggcgtcgacgtaatccgtctgcaaagcctcaagctcgtgatcgagtgcgtcaatcagatgcttggcgctgaagtcatacccgtttgcgccgccatcgttttcgccgaaactgtagtcgatgccgaacttggtttggatgaagatggtgctgcggtcgagtcctgcgtccttccacgcttggccgaaacgcttcgaactggcgtgcgcggcatgatcatggaatccatagatgtccgccgtgtcgaaatagtcgatgccagaatcatgggccacggccacggtacgtgccgcatcggcggcatccaacgcgtccatgcgcatcacacccagcgccactcgtgacgcaatcatgccggattgtccgatttcctgagtcttcatagtgtctcatttctgttatcgtgaatcggcgaacgggcactgtccgcctcgttgccgggcagcaatctccattgccgcggcttatgtcaccttatcgcttgaagtgcacttgaaggcaactcgcaggcaggcagcgcgcgctgccgggcgcgtcttcgcgccttcatgtcttcgctgtgatcgagacatcgttgtgccgtgatcatgcctatttcttgtatgatgacctctatagcaacagagctagggggattccatgaacactaccgattcatccaaagtcagtgatgccaacgccggcgcaaacaatgtcatccatatcccgcacaatcccacgcttgccggattggccacgctgacccgcaacgtggcgtacaagaccggggccgataacctggtgatggatatcatctcaccacaatccaccggcgatgacgatgaccgccgctaccccaccgtggtattcgtgcaaggcagcgcctggaccacgccgcatcgcgactacgagatcccgcagctctcggctttggcccgcgaaggctttgtggtggctacggtgaatcatcgcgatgcctcgagcgacccccacgacatgttccccgcatatctcgaggacgtcaaagcagccatccgctatctcagggcaaacgcacgtcaatggcacgtggaccccgaccgtctcggtatctggggcacgtcgtccggcggcaacacgtcgctgctggtggggttgaccgccgacgatccgaggtatgaggatggcaccaatgccgatgaaagcgatgcggtgaagtacgtggtcagctgcttcccgcccactgacatgcttgaagctgtcgccgcattcgacgatgagaccaatccattccggctgtattatttcggcccgttcgcggccgtggtgggtgcgacccatgagaccggcatcaatgccgaggtccgtcagcgtgcggctgatatgagtccctacctgcaggtgcgggatgaccagcagtatccgccgatgctcctgttgcacggtaccgccgacaccgtggtcccctatcatcaatccgtcaagatgcgcgaccaactggtcgagcacggcgtggacgcgcagctggtgctagtcgacggcgccgaacatgagtacgatttctggagccagcaggtcttcgacgtgatcttcgatttcattcgtgagcggagctgaacacatcatgcttttgggcagatagtgcgacccaaacatcccgttgtctacttagaagtgcaacaccctttaaaaaggatgttgcacttctaagtagacaacgggccgcgtgggtcgttcgcccggctgccctacgatagagggtgtcgccgtattcccaacggcgcagtccgtgcccgggacgaggggctcggccgaatggcgcgacgatgcgccttgaagttaaggagtcatgatgaagtcatggagattcaccggcaccaatgaaccattgcagctcgccgagctgcccgagccgaccgccggaccggggcaggtcgtcgtcgacgtgaaggcggccggcatctgccacaccgatgtgggcattctcaccgatccgggctggatgacgatgctggcgcaggtgccggtcacgctcggccacgaggatgccggcgtgatcagccaagtcggcgagggcgtggacgattttcaggtgggcgaccgcgtggcgatatgcccgaccacgccggccggctgccccgggtcctccttcgacggcggattcggcccgaagatcgtggtgggcacgcaggcgctggtgcgcattcccgacgaggtggatttcgtcaacggcgccgcggccaccgatgcgggcatgacctcgtacgcggccgtggtgcgccgtggcggcgtgaaggccggcgacagggtcggcatcatcggattgggcgggttgggccagatcggcgcccgcgtggcccatctgctgggcgccgaggtgcatgtggcggagatcaaggaggatatctggccgctggccaaggaactgggtgcggtggacgcgcgccagtccatcacggactatccgaagggattcttcgatgtgatcgtcgacttcgccggattcggcgacaccaccgccgacgcggtggacgtgatcaggctgggcggcgtggtggtgctcgtcggcatgggccggttggaaaccaccatcgatgccaagtcgctcatcgtcaaccagtgcgatctgcgcggatccaacggcggcacgcccgacgacatccgaggcgtctacgagctgatgcgcaccggcaagctcacgccggtcaccacgaccgtctcgttcgacgaggtgccggaggcgatcgaacgactggagcgcggcgacgtggtcggccgtctggtcatcagctacgagtgagggatggattggcaacggtgtgttggactgtttctagagggtgtttccttgtttggtgaactccacggggctcatgtatccgagggtcgagtggagccgctggtggttgtaccaccatacgtaccggttggcgtccgagcgcagtcgttccacgctcgtgtagacgttgtcgcatatgggttccttcttgacgagcct

SEQ ID NO: 35 - DNA, 24038 bp, Bifidobacterium longum
tatacaggcggcggcaccgatgcctatcacatcaccgggaaacgatgacgacaccggggaaaaccatcagcccacactacggaaaaacactgccgaacctgtcgaacaaacattgaagcaaaacacgccgaatggaccgtggtccgtcagggtggtccgcgatgccggccctcacatgggctttcgcgtgggccgcatgatcggtccggcatgtggaccattggcccattcgcatgatgtggtccggaagcgcgcagggcatgctgatggcccacacgcatcgacgtggcccattcggcctcctggtccttggtccacggtcctggatgccggccatggcccacacggcgtgggcatgatcgtggaccgggccggattggattggatgggtccacggtcgatgccgccctccgtgcccgatcggcccgtccggccgacggcaaagggggcggagccgtcatcggactccgtcccctttatcgtgtgcgactatgccaggtccttttttattcttcttgccgctttcttgtagacggtgttgtcgtcacgaacggaaacgacgacgaccatcattcgaactccggaacatagccgtcatcgacgggcttgtagtccttgccgaacacgtcgtccatgccgagtcttgtcccgtcgtccctcttcattcgttcctcggcttcgaggtacagggcgaagtcctcttcggcctcggtgagtcggcggtaatcgtccgggctgatgacgatggcggccggcttgttgtttcgcatgaccacgatggggttgttgtcccccaccctgctgagcgtcttgctgacccctccgtggctgagttcggacacggacacgaggttgtccaatgtgatgtttcccgccattcgccctgctccaatcggttcaaaaaatagctattatcgtgatgataattgcattcacgttttgctggtcggtcaagggaggacagggcccgcccggccccgccatccccagccggtcacttggccggcgcccaagggtcgattccggcctggggcttcggtgcctggtatccggcggcggggaagtgtccggtgttgcgtacgtagttgacgaggtcggcggtcgcgatgtccgcccaggggtcgtttgcggtgttgtcgagggtcttggtgttcatcttcgttttcctttccggttggtgacgaccgctctttgccgcggtgcgcgtcggggcgtcaatgggacgcgcggggcccccgcaggggtcgcgtggaccgttgacgtcccggcgtgcgccgtggcatgctgcgtcaaggaaccgatcgggaggggaaaacgaagatggacgccgggacccgggccacgtcatcgtcccggcttggttggatggatgccgtctccatcccggttcgtggatggcgggcacgtcgatgcctgcgtcgaactgtccggattgagatggctgtatgtttccacgtccacggctttggctggcatccgtcgcctcgttgccggggttctggcgaacatggattcggcgttcggccgtctttgatggacgtcacctgttcctgtctggaatgcgaaggcggggcctccggcttatggatggccccgcctgtttgtttccctgtggttttctgatcactcgtcgtcgggtatggtgtcatggtcgtagatgccgaccatgcggatggtgcgtttcgcctcgcgtctgaagtagaccacgagcacgtcgtcgtcgaaggtgtggaactcgaagtggtttccgtccccgaacgggctacgctcgagcaggtggtcgcgccatccgctctcctccacgcgccccttggccgccagttcgcagatcgcctcccttatggatcggatgatggacgcgaactgttcgtgggtgtatttctccttgaggggcagcgcggtccgccagaagtggggcgaggccttgacgttccagttcactggcctacctcctgtgcggtgaggcctagttccccgagcacgtcgtcggggatggttcgcgcgtcggtggcgtcatcggcgatcagcccgtattcctgggcctcggcgagcagcatgtcgcggcgtacgtcctcgccgagttcgcgtgcggacggggaggagaagacgccgtcgaacggcgtgcggttctcgttggcgacctgggtgaccatcatcttcatggcggcgggcgtggtgatgccgttgcgcgcgaaggcggcgtcggcacgcgctttgacgtcgtcggggacgttgatctggatcaatgccatggtaagcctccttctccttatgtgttttccatataatatcataatctgcttggtgttgattcgggaatgataccgataccgttcgtccatgtctcggcccatgccgtttatttgaatcgttcctggatgggccgcagcgccccggtggcggcgagcaggagcgcggcctgcgcctgccgtcccgtgcggatgccgtcgagccggtatcggcttgtcgccttccatatctcgttttcgcgtttcacgtcgatcaggagcatgtcccgtcggatcacggtgccgtcgatgctgcggacgctccatgtgcacagccaggcgtggatggcgccggcctcgatggggcagccggcccgctggcatgcgtccagggtcgtcctgctgggggtgatctggcgtggctgcgcgccgatgggcgggcggatccgttcgtccatcgagtcgaacgccttcgccgctccttcctcgtcgccggtgtcgatccattcgtccatggcatgtcgccgcatgttggcctcttctccgggtgagggccggcccggcgtatgtgcgggccggccttggtcatgtgtggtcgtcgtcagatcgccggctgctgggatgccgcgggcgcgaacccgtcggtgaaggcgggctgcctggtttgggctcccgtggcgttccacgggtcgttggcgggcatcgtcggctgctggggctgcggctgggccatgggctggctcgactgtggagtgcgtcccgcgaacccgttgtcgcgcggcgccttgttgtaggcgacggtgccggcgcgcaggctgacggcgaggtcggtggcgcgcagttcgaggatgcttcgtttcgctccctgctggttcgtgtattccctttgcacgtagctgccggtgacgatgacgggcacgcctttctgcttgccgtcgggtccggtcggcagcatgctgtgctgcaggtgttcggccaggtatccgctggcggtgcaacggatccatgtggtggcgccgtcctcccattggccggtctgcgggttctgggtgcggctggtctgggcgacgtcgaacgtggcccatatgccgccgtcctgtcgggtgtggaattcgatgctgccggtgtttccgctgatggtcagcgtgacctggttgatggtcgccatgatggtgttcctttccttgcgggttatggctgttctgttttcgggagacggcccgtgccgtcttccgtgtgggtcacctgttgccggcgcgatagcgtcggcctgcccggctcattggttggtggacaggttgatggtgatgacggggttggtgatgtcgggcatggagtcggctggcggccagtcgtcgatgccggcggcctgcatgatggcggcgaggcagccgctgtgggcggcggcgatctcccattgccagcattgcctgttggacagggcgatgaggtggtcccacatggggtagccgttttcgtcgagcgcgggccggccggcgttgagcaggccgatgagttttctgacctgggcgcgcaggcgttcggcttcgcgtgcggtgacggtgtcgacttgttgccagatgcggcgggtggtctcgtcgtcgatgccgttcgcggcctgttcccatgcctggttcctgaggtcggcggcctcctgggtttcggcggggtcgagggtgaggcttttcctccaggtgatgcccatctgccatgcgccggagtcggtggcctgtgtctggctcatgatggtggccgttatcctgtactggctcatgatggtgtcctttcctgtgtcgtggatcgtctgtccggctatcccctgttttttctttttggcctttcggtcaagcgcagcgttaccggccaaagcgggttccgtccaatcgatcgcgccgggcgcagcccgtctgcgtggcgatttgacgggttccgcgacgccggtatgatcgtttcggcttcagccgaaaaggccaaaagggaaacctggggccgcgcccctttgggggcgttcctttttctgatagggcttgcccgtccatcgtgtttcccgcatgtgtgcgggaaaccgatgccggtcggggccggcggctcgggccggcgcggggaggtccgggaggggcgcgtggcccttcccggccgccggaggccgtccccgatcgcctggttggcgcgggcggggactccttggccgtgggtcagccgatggggtggacgggtatcatgaacgttttgccgtcggggagcctgcagggcgcttcggggtcggcgaacatggcggcgtagcgtccgatctgctcgtcgtcgagtccgagggggccgtcctgcgggtggggtcccgtgatgacgaacgtgccgcggatgatgatgggcttgccggcgtccgcgaggcggctgtcctggctgaggcggatggtgcggttcggcttgaggttcttgatcgctccctcttcgtcgcaccagagcgtggtccgccggtcgaggggcaatggttcggcgtatccgccgatcgtcttcccgatggccgtgatgctggggtcgatgtcgcgcagttccggacggcgcaaaggttcgatgacgagcgtcttgatggtgtccatgatggtggtcctttccttgcaggggtttgcctgtcctcccgcatgggcgggaggacgctgctgttattcgtcgatgtggccggcggggatggtcctgcgttgtgccgccctgcggcggcgttgcggggtgtcgatgctcggcggggtgcgccgtctggtcttgcggccgtatatcttccagtcgatgccggcggccgtggccatgatcgctatgacgacgacgttgccgatggcttcggcgaattccgggcttgcgaggtattggctgatgaggtccattgggactccttgtggtttgtcctgagtttgtttccggccttccttggccggcatgtcacgccgtttgcccgccgatgtaggcgtcggcctcggccatggatgcgcagtagcgtccgtagccggcgtcgacccaatggccttgggccttgtggagctggtgcacgtcgtacgggcgtgcgccgtcgcccgtctcctcgacgtcgtaccggtatccgccgcgttcgatgcttttgatgatgttgcgtgccatggtgcttgctcccgtctggtggtcccttgttttttcttttcgaccggttggtcaagcgcagcgttaccggccaaagcgggttccgtcattgagcgatcacgccgggcgcagcccgttgcgtggcgcgttgacgggttccgcgacgccggtatgatccagaggcgaagccgaccggccgaaaagaaaaaggaatgggccggcccgccccttggggcgggttccgtgcgggggaatcgtgccgtgtccgcggcgtggacgcggacgggatgcgatgatggcccctttggggggccttgcaacccgggagcggacatgccggcggcgcggctccttcgtctggtagggcttcgcccgtttcgccgtcgtcccgcctggcggggcgcggcgtctgggtggggtccggcggcgtgggccggccggggtttgcaaaggggcggcgtgagcccctttgcccgccgggggccgtccccgtccgcctgcctgatgcgggcggggactctttcggatgacgggcctgccgtcggcgttttccttctccgtcatgtgagggggtggcggctggcgtcccggttcatgaggtcgcgcaggtcgtcgagcgtgtcgaggcattggcggcgggtgttctccggtgtttcgatgccgtggttggcggcgtggtggtgccagaggacggtttgggcgaggctggaggccttgtgcgccacgtcgtcgagcatttcgtcgagcgcttcggccgtccattgctcccagtgggggtcgtcgtccggcggggcggacagcgcggcgtcgagccggtcgagcatggtttgtatggctttggcgtcttcgaggagttccgcgatggtgccgggttgtcctttcatcgggctcctgacgagggctcgcacgtgttcgtcggggtcgaattgttcggcgtgttcgtgcaccgtttcggggatgggccggcccgaaggcacgtctatgatgaggtcttccccggcggggctgctggtttcgagccattgcccgccggcgaatccggtgtggagcgtccagccctgttgattggcggtggtttcgatggtgttcgcgtgcatggtgtcgtgtcctttccgtcgtggcgtccgacggcgtgtgccgtcggacgccacggctgttttctgtcggtcagcgcaggtatgcggggtatcggccggatgcggccatggcggcgaccatgatggcgaggctggtttccgggtcgtcgtccagtgcggcgagggcggcgagggtggcggccttcccgtcgccgtcccaccatgcgaggtaggcggcgagggcgtagggttgggcgacgggcccgccgtgcttcctggcgcggtcggccatcgcgcacgcctcccgcaccgcgcgtgcgaggcggggctcgtcggggcggatgtgggggtcgtcgaacgcggcgttgagcgtttcggtcagcagcgtcttgttgttgaacgagtggggccgggcggccatgtcgatgacggtcgccgtgtcgagcttgggttcgacggcggcgatgagtgcggcgtccctgatggacaggcgggccgtcatgagcgtggcgaggtcgtcgagccgttccgggtccgcatccttgccgtcgagggcccgcatccatgtctcgagcgcggggccggcgatggtgcggacggcttcgcccgccccctgttcggttgcggcccgcttgagttcctcgatgatgttccgggttgtggcggtcatggtgttttctcctttttgcgtcttttgttttttgaccttcttcggtcagcggatgcgtaccccgcgtaaggcggttccgtcatgaggcgacgccccgccgtccggcggcgtgtgcggcggcgttgacgggttcgccgacgcgggtatgcttcgatgggccgaagaaggccaaacctctgtgtttttgccgtgcccgcccttggcgggctccatgcggcggcatggccggcgggcgcgcggcgcggtcggccgggcgcgcgggcatgggccccgtggggggccgtgcgcgtccgggcggcggcgaccgcgcggtcccgccggttccgtttcccttcgccgtcgccccgcgtcgcggggtgcggcgcctgggtgggctccggcggccgggggccggcccggtttccaaagggcggtttgagccctttggcctgccgggggccgtcgccgcccgcccggcgcgggcggcgactctcgtcagcggcgcggtggcgtgtagtcgagcgtcgtcgcgtatccgctgtcggcggtctcctcgatggctgtttcgtatccggcttcgagtccctgctggtacgcctcctcccacaggtcgtatccgatgaggccgtccgtgtcccagttggtgttgctgacttcgatggccccggtgccgcccgggatggtctcgtggtcggcggtgagccattcgagcctgccgttttggtcgatgagcgcgaacctgccttggcttccgtccgcgaggtcggcctgtccggcctgccatgcgagtatcgcgttgcggctgtcggacgcgtgtcggccgcgcgtgtacgagtgggcgatgccgttgtgggcgatgaagccggtgcggtcgcctttggagaagcggaacgggtgcgtgttcccggtgcacaccctgccgtgggtggcgaggcggaagtgcaggaggaacggggaggtttcgaggctctgccagtggtccatgatgaacgcgagcgtcttcatgttgtcctcgttgcggtagcggtggaggcgttggccgtcgtgccatgcgatgcccgccccgtcggggttggcgtcgctcatccgggcgagctgggtgaggcttggcatggtgtccgcctggctggtgacgatgacgcacatcagattcgtctccttcccgccgtcgtggcgctggcgtcgttgatggcctgtgtggcggcgacgcggctcatggcccggatgtcgcgggtcttgagcttggggacggggaacttctggaagaaccgccacatggcgtgcatgtaatggacggcggcgtcgagtcttccggcggtgtcgtggcgccacgggccgaacgtgcggaattcgatggtgtggcggtgcgtgtcgttgatggcggtgtccttgccgcagtagtcgccgtggatgagctcgcaccagcgggtgtcggtcatgtggcgcatgttcagcgcctcgcattgggtctcgtcgagcgcttccagcgcccagtaccagcgggccggggtctgccggccggtgcggctgatgtgcatgtgcccgcccgacagcgtgttgtcggtgtcggtggcgatgcgttcgacgagtcggcggatttccgtgagttggctcatggtcatgggttcgctctggtattcgagggagccgtcgtggtggaggctgccgtccgggcaccagccggcgatgagcctgtggttcctgagcatgtcggtgtcgtggttgccgtccacttcgatttccagtccgaaggtgaacggctcgcggacgggccgtccctcgtacgggtcccggtagcaggggtcctgcgtgttcgcgcaggcgtgccgttcgtagcagtaggggcagtagcgttcgtcgcactgctcgcagtattcctggcagtccgagcacaggcggtcgtcgcacatgcggcaccggtacccgcagtcctcgcacaggctgtgctcgcagtgctcgcagcagtatgtgcagtccccgcacaggctgtgctcgcagtgctcgcagcagtatgtgcagtccccgcacatccgcgaaccgcattcgttgcatgtgcgcgcgcagtcgtcgcatacagtgttgccgcacccgcattcgacggtttccgtccccgcgcagtcctcgcatagccatccgtcgcagtcgcggcaccgtacggcgcactcccccgactggcgttcgcagtgcctgcaccgacggtcgtccccttggctggcatggttgtttccggtcatttgtcacgctcctatgtcgtcttgtcttccggacggtgcgcggcgggaccggatggccgcggcgcggcgcaagccgcgtggccggtcggcccggtgccgggaccgccttcggcggcggcaccggccggcagacacgcggacgcttgcgacgcgccggacgtccggtcatgctgtgtgccggccggccggacagggtcccgccttcgatggcgggcccccttttcgacgtgctcccgccgtatggcggggcgcggcggcggatccgcgagcccttcgggggcgagctccgttttcggcggcgacccggatccggctggacagggattcccaaaacaggtatcattgtttcctatagtaggaaatcgaggtctggagggatcatggacggttcgttgtcgcggatgcgcgggaaggcggacttccgcctgatgcgggagctgctgggcctgccgcaggagtgggtcgccaagcgcgtgggcgtggacgcgcgcaccgtccgcaactgggagagcccgaggtatttctacccgccgaagcgcgaggcatgggacctggtggagggcctgtggcggcgggccgacgcgaaggcggccggcctggtggagatcgcctcgtcggcggcccgggtggcgcgggagcgcggcgtcgagccggcgccgctcatgctggcgtactggcgggacgcggcccagtgggcgaaggcacatccggaggacgaggatgcgggcatgtggcggatcgagaacgcggcggcgcgcctggccgcggaccggctgcacgccatgggcctgccggtcgcgatcgcgtacgcggagcccgaggcgtgacggacaccgtaggggttatttgacttccatgattcgactgcatggtttggaatcaaggcccgcatccgccgacaggcccccgattgacacttacgtacaaacgccgtacaattatggcatgacggaaaccaccaacaaggccagccgcttcgagatgcggctcacgccatcacagaaggaacgcctcgaccaggcggccgagatcagggggctcagcacctctcaatgggcgttgaccaacctgctcgtcgccgccgaccgggacatccgggagtctcatgtcctccatttggacgacgaggcgtgggattcgttcgtccgggcactggacgggcccatgccggaggagatggtccggctgctcgagagcgagccgatctggaaatgaccgatttcaccccgccgcggcgtctgaccgccgaggacgacgccgacggtttcgactgcggccttcccatcgtgaacaactggctccacggacagctgcggaacgcgggcaagcagcatacggcggtcgcctatgccacgttctgcgacggcgcgctggccgggttctacacgttgagcgcgtacagtatcagccatgccgaggccaatggctggctcaggaggaacagcccggatccgattccggcgattcttctgggcatgctcggcgtggacatgcgctaccagatcatgcacgtgggagcccagctgctcagggacgccgccatacgggcgatgggcgcggcggagatagtcggcgcgaaggcgttgctcgtggaaccggcctcggacagggccacgcgcttctacgagcattacgggttccgccacatcgaacgatcgggcaggatgttcatcccgctccgcccggcgtgaacggggtcgctccccatgggatgaaggaggcggggaaggccgttggaacggtcctccccgcctccttgttttctctcgagccgttttcgtcggtccgccgttcatttccttggcgggcgcgctctgccgtccgagtcgaattgggcgagctgtccgatggcgttgccggtattggccagggctccggtgagcagtcggatccgttcgccggtgtcggcggtccggagggcgagtctgagctggtcgatggccgcgttcacgtggttgcggtagacgaggtcgtcggccgtggccgaatgttccgttttcgcgggcttggggtcgttcatgcgtggttttccttccggtgtttggtccatgaggtcgagcgcctggatgccgagacctgcggcgaggtcgaggatgatgcggctgcgtttgctgccggtggcccaccggcgggtctcgatgcctccgatggtctgcgtggtctgtccggcccggatggcgagttcggcctggctgagcccttgtcgcgtccggtgccaggcgaggcgggtgccggtccatccggcgggcggatcgtccgtggcatggtccggttcgggccggccggagagcttttccatgctggtgtcgagcgcgatggcgacgcgggcgaggatcccggcggccatgttcgcggtgtcgcgttccccggagtcgtattggcgcaggctccggtatggcacgttcgcgtgttcggcgagctgtgggcagctccatccccgttccgtgcgcatcctccggatcacggtggtcccgtcctcccccgtttggggcgtctctccggtgaggcgggcggggttgatgccgagggtcttcgcccattgccggatctggtcgggttcgagcgtggtcagcggggtttcgcctttctcgatccgttcgatggtcgtcatatcgatgccggtgagccgtgcgagggtctgttcgaggacgctttcccgttccctgatcgcgcgtagttccgccgctccgatgggtatggtcctgccggtgccgctcatctgtcgcctcctgtcaggtagatgtcgaacaggggtccgggttcgacgaggccggtgcgggtgtcgatggcctggatggcctcgagggtgccgatcatgttacgtactgcgggtctgctgcgcgtggagaacgcgccgtgcccgtcgatgagttcgagtccctgttcggtgacgctgcggcgggtggatccgtgcagggcggcggcgagcacgcccggtctgacgccgtggccgagctcgcgttggatgttcgcgatgtaccggcaggcgatgcggatcgattcgcggcccatgggctcgccctgtccctcccccgtttccggtgccgtccgccgccggcggtacgggttcgacgccggttttttcacgatctccctaccgtcagcctggcagttggagcagttggagcagtcgtcgcgtctggtgccaggcgggtcgaacatggcgaggatggtccggcgcaggcatcggcgggtctcgcagtatgcgctcatggcgtcgagtcgggagtccatgagctgcgcggccctgatgcgtgaggggtcgccggattcctcggcgcggcttttcgcctcccatgcggcgtggcgcagccatcgccagtcgccggggctccagtagaggaccgcgtcggcaggcttgccgtcccggccggctcggccggcctcctgccagtaggcttcgaggcttttgcacggcccgtcgttgaggacccatctgacgtcgggcttgtcgacgcccatgccgaacgcgctggtggcgcagatgacgcgcggatggccggcgaggaacccgtcctgcacccgtttcttgtccgcgtccctcatttcggcgtggaacgccatggcgtcgatgccttcggaacgcagtgtctcggcgagccgttcgcagcctttccggttctccttgtagattatgccgctgcccttgtgccgtttcgcccaggcgatcatggcctcgaggcgttcgccgggcctggcgcggaccaccgtgaggcgcaggttcggccggtccgcgtcggtcgtgaccgtcacggggtcggccaggtgcaggagttcgcggatctccccggcctgcgtccggcttgcggtggcggtcagcgccatggtcacggggcgcggggacagggagtcgatgaattcgccgatgcgcatgtagctgggtcggaagtccgatccccagtgcagcacgcagtgcgcctcgtcgacggcgagcaggctgatgcggatgcggtggctgaagtcggcgaagtcgggcgcgtgcaggcgttcgggtgcgacgtagaggatgcgcagttcgccggacagggcgcgcccgtacacctcggcgcgttccttctcgctcagcccggagtcgatgagcgcggcgggtatgccgtgtgatcgcaggtgccgcacctggtcgcgcatgagcgccctcaatggtgtgacgacgagggtgaacgtgccgggcctggcggcggggagctggtagcacacggacttgccgccgccggtgggcatcacggccatgacgtcgcggcccgagatgatcgccccgacggcctcctcctggccgggacggaacgagtcgaacccgaagaaccgcttcaatgcggccagcgtgtaatccccgttaccggccattccgtttcctttcttttcacccacaagtttaacaccctcaagtatagcatacttatttattccatggcgtttcaacgaaagcggcggaatcaccggccgcagggcatagattgtttatcgaccgcccagcgcacaaggaggaagccatgcaatcagactcttcaaaggcatatgagaacgcgagggcggaatacgagcgcctgtccggccagccggcattcatccgcctcatccggaggaaaaagctggacgaggccgaaacggacatgagagagaagcacaatgtctgggtcagcgaggaggtgagcgccctcgccaatgcttggaccccggagagacttcctccataccgtatgatggcggaactcgacgcccggttcggtacggacaggggaacggtggagaccttgttacgcagggaatacgatcgctcctatccactgtcctccttccattggccgatgtcccgagttcgcagcatcctgcctgccgccctgagggcatgcgaggaatcctacgaatccgtcagacaggcgggactcctcacgcaggaggttctcgacgcagtcgaccagtggaggaaatccgacggccccacctccgatttccgtcgcctagaggcattgcctccctcttcgaaggtattcgctaagctcccgtcgggccttcgagtctggcatcgaatgcctctgtcccggccgaattctttcttccctgaggattcccgatgccgggcgatgtccggccatgtgctgtcgctgcgacaaggggattccttctctctgatgcacccgttgtcgacctcccccatagcggattggtggggtgccggaacgcccgccgacctgtcccttgacgagccggacaagggaagcggcatcatttgggagatggtcgttttgacgggactggtctggccgaccgacgcctatctgaactatggcgcgcgtcatgcggattctctggaggtcataatcccggcccagacgacctggattgtggacgggtggagagacatcatttacacaaaggagatgacggggttccgcaaactgtcccccgcccccgatgtccgtttccgcacgctgatggttcatcaggtcggtttcaccagaatcaacgtcatcgacgacgatccggcacctgtcatctgacccttgaatcggcgccggcaccatgtcacccgggtgtatggggcggaagcggggtggtatggtgatcggtccggacggttgcggtttcgatatgcgttcgccttcggagatggaggcggatgacgcgcggcgggagtcgtatgaggcggcgcatgcgcctcgtatggcggtcacgtcgcgtatccgccgggtggtgcagccggaaggcgggtatctgccgttgtccctgttcgacgaggtttgtctggctgatccggtgccgttgtttgcgttcgaggatgtcccggccgatgtgacgggcctcgcggtggattatctgtcccgtgtggcgcgtggcgtgccggcgcgggatgcgttccgcgtgccgttggcgggggcgcgtctggtgggccgttctgcggatgcggagcggctgctcgccatggtggacgggttctccgaccgttcggtgcgggccgcgtgcctgctgtgcgggttcgacgcggcgtcgcgtcgggggccggcgaggtggagggcgggcagggtccgcgatccggggccggccacggtgcataacgtgcggcgcatggtggcgcgcacgttgcggttcatggaccggatggggccggtcgtgtgggaggggttcacgttcgacggcggatacacggaccgggtcacgtccggcgacggggacctgctcaccgccgacggcctgtgggatctgaaggtgagccgttggccgccgaacccgacgtacacgctgcagctgctcgtctattggcggctcggcctgcattccacacatcccgagtatctccgtgtgcggcgtctgggcctgtacaacgcgcggtcggacacgatgtggagcatccccgtggcccggatcggcgccgatgtggtccatgcggtggagcgggatgtgatcggctatgcggacggtctctgactctcgcgccggccggcggattctattcgcgggggttcgtggcggggagttccggcacggggcgggcgagcctggcggccgcgtcggcgagcagccggcgggcctggtccacggtgcgggcggcctcgcgttcgcgtcggtcggcgtccgcgacccgtgtcttggtttccgcgtcgaggcgcgcggccttcgcctcggccgctttgaggattttgtcggcttccgtgttggcgtcggacaggagcttctgcgcccgttcgcggctttcgccgattctcctgtcggcttcctggtcgatctcctgtttgcaccgcgtggcctgttcgacctgctcgtccgcttttttcttcgcctcgccggtcatggcttcggctttggcgtgcgccttgccgaggatggtcttggcttcggtttcggccttgtctaggatggccttgcgttcggccttggcgccgttgaccatgttctgcatgtcgacgccgatgtgctcgtaggggttcgacgcctggtattcgagcttcttgttctgctcctgcagcatggtcagacgctggttgagctccccgttctcggtctgccgtccgtggttctcgcgtttgagccggatgatctcggcctggtcgagcgtgcggcgtcgttcgagttccgccacgcgtcgctccacggcgtcggcccggtatccgccgatcgtggccctgggcaggtcgagcggtttcgcctcggcacgcccgtagtcgcggatgggttggatgaactgggtctcctcaccgtcggatcgtctcgtctccgcgccttcggtgtctgtcatgatggttcctttcctgtcggccggcgctgttcgcacgggtcacccgcgccggccgcgataatcggccttcagcgcgcgcagcatggggttatggtatggttcggtgacttccatgaggcgggtcggccgcccgtagggtccgtaggcggtgatggcgggttcgaccgggcggatgatgccggcgcgttcgagttcgagcagcgggtatgcggccgacgggtcggggttcgggtagaacctgccgtccggtgggatggccccgtcgggttcccaggagacgtccagcttcccgccgggtccggtgacggtcagtcccatgccgccgccgtggtggcggccggcgagcaggtgccaggtttcgagcgcgtccgtatccccgccgtgtcgggggtcggcgtgccagggtctgccgcgtgtggcgagcaggtggcggcgttccccgtcgaacctcgccgcatccagtcgcctccatgtccaccggtcgacctcgaagcggatgccgtgtcccctgatgagaggcggcacggccccggtgacggggttcatttgcggtctccgcggatgatgtgtctgacgcacatggcgagcaggacgaggtcgagggcggcggtgacgatccacagccatcccatccgcggcatgatcgcgcattcgatgatcaggaggatgaggatggcgaggcatgcgagggcgaggaggatggccttgcggcgttcgtcgtccatcattcccctccgtccgtctcgtcggtccagtattggtcctcgaaccagtggtcgaagcgcatgtcgcccgatccggtggcggggttcgaggcgagtgtggcctcgtcggccgccgggtcgtacaggcggtctatgtcgaggtcgccgagccagtcctcgagccatgcctcgagtccgctgccctcctcgttgtcgtcgtcggcgatgagccggatggccctgctgatgaggatctcctcgatgacgctgtgggccgcatggttcgcggtcgggtcggcgaggcgggcgcgcaggcgtattgcggcgccgagcatgcggtagaggaattcgcggtcataccggtcgaggtaccggtcgggcaggaggtccgtgacggggttcccgtcgtcctggccgaggtgcgtgccgcggggcatgcggcccagacgtctgatctcgatcctcgtcatggtctcgatcatggacaggttctcgtcgaacagcctgcgcatgcgggtgcccggcatggggcggtcgccgccggtgtcgttgttcatagggtccttccgtacttcgtgtatctcgtgtattccccgtggcgggtgccgatgagcgtgatctgcgcgtccacgatccttttgcgccgttcgagctcgcgtatcccccggttcagccaggcggacagttcgacgcagccgacggtggccgcgtcgcaccggcgcaggtctcgggcgattccctcgagcaggagtccctggaccgcgagctggatcacgccgctgttcttgaactgcttggcggcctgttcgagccggtcgacgggattggccgggcccgcgctcatcgggcggtcccgtccgccatgctcagttcgagccgtcgcagccgttcctcgagtgcgttgatgcgcatggtctgggcgagcaccacgctcatcggcgcgggtcttccctccctgccggcgtcgggggccggggcgtgcgggcgcgtcgtcccggcgtccggcggttcgcgcttccaccgggcgatgcaccgttcgatgcgtttgttgccgatgaggcgcgggtcgagtcccgcctcgcggaagatcctgacggggctttcgccccgacggtagcgtgtgacggcctcgcgtttgaacgagtccgtgtaggtgatgcgcgtgcgggtgacccatgccacggcgtccagtccggacagcaatgccatctcggcgtccgagaaacccgtcatgcccatggcgtccccgcctccggtgcggtccctcccgggattccggagactcgtccggccggtctttccgtcctgtggtcctgcatgtgcggctccttgcctctccggggccctgccttgtggccccttcgcccatgccacccgtggccccttctatatcgggggattcctccgccgcgcaagaccgatctttcttcgtgtccgcagccccaaaacaaaatgttgacaatgacaataaacaacgttattgttgtcaccgtcagcaaaaatattgctgacggctgatagtcgaaggattatcgcagataaaggataaaagaacagagccgctccttgagaagctcaaggaacagggatggcgcatcgaagccaagaagaaaggctggatgtgctacccacccgacaagtcgaagccgggcgttcccatacacaagacaccttcggatgccagatggtatgagaattgcttgaaatacctgagacgcggcgggttccaagagtgagcggtcgctaatcttgcggagacgaagtttcctaggcttgtcaccgcaagattagcacaccctctgttcccccatcaaccttcgaccgctagggcggctggatggcgtgcgcccatggaggcatctcccggcgcacgccatgcaatacatcggataggtgaaacatgacgagagcacgagaatggcaggtttcccttgacttcaaggcgagactcgacgaggacgcggcgttcgacctcatggaagccctcggaagatacggggcctcggtggcggtcgaccccgggcacacgggcggcggactgaccctcgccgtcgatgccccggacggggagacggcgctggccaaggcgcgcacgctcctcgaagagaacatgcccggcgcatcggtgacgggactcgaggcgagggaatgggccgacgccgtggcgcggaaccgcgagcccctatacccgccggtggtgggctacgccgagatcgcgcgcatgaccggcgtcaccagacagagggcgtacgcgtttcccaggatcgaatcctttcccaagccggtgatagagacctcacagggccccctctattccgaggacgcggttcgcgcatgggcgcagacccgcgagctcagacccggacgtccgaaagcgatggaataggaaacgatgcgagagccccgcggccgcacggcgcggggtttattttttacaaggaggaagcggccgttccccgatggattcgtcgggaagggaatcggctgtcaccaggtccggtccggttggatcacgggacgtgtggcccggtccctgagccggaatgattgggtcattcgcgcatgggctccctcgagcatcacggtccaggtcgtcggggacacggtcctgagcccgatgccgttctggaacgccaggatgaggtcgttgcggaccggtgtctggcccttgttccggttctccacggtgtagcgcacctcgagcaggtccttgtggatggcgtattccacgtccgtcaggagcagcccgtcatgttccccgtattccaatggataggatatgaattccttgccccgtggtacgtgccattccctccattccagatggtcttccagatgcatgcacagccaggtggcgagggatagacctcccagcacgatgatggtcacgaataggatgactttcataaaggttcctctttttaggagattcgagcgacatgagcgaaaaagacgggaagcgggttctgagccccgaggagaaggccgaggcggatgccccgaccaacaagcaatggctcgataccatcggcggcccgacgggaagccgccgatgattgtccgattccgatgaccgtcggcattgttttattgccgatatcgggctgatggcggataatcgggatcatgaaggatggaatcaatcaatgcgggggttccggcatcgagtccgttgatcatttcgacggtgtcggaatcgtcaggatcagaccagtggtcaataaggtggagataaagagggccaagcgtctgattgtcgaacagatccctcatcttgccgatatagaattcccaaagcggccggtcgaggatgacggcacgttgaggcctctttttataggggcgttctccaaggacggcctcataggcgccgccttcgtcacgccaggaatacaggcagcccagtcgttcctcgggtatttctccgcgtcggccggagcgtatcagtgcgcggagcttgtcaggcgtacggtcgccgaagtcgaggggatcgcagtcgtcgacgagtacaggcgcaggggcgtcgcactcgccctgaaaaggtacatcgatgcctgggccgccgatcacggcgcttgtctcgtattgtccgtgcccacgaatgaggcagcgcgtggcctcaacgagaagtccggccaccgcgtcctggagcccgatgtccttctcatgcttcaggtcgaatatgccgacggcggtccctgctcccttccctttgctttggaacgtgggcaggaggcaggatacagttgctgggcattccttccaatcgccaaacctggcgggatgtccgtcagggcgggacaatgcccttccgtcgcttcctctcctggagtatccggtgaggaatacttcgccgtcaagtgggagacccgcgacggtgacgggaattggatcgccacgaccagccgtttgaggggcgtacgcgccgacgtcatggactgatgccattccatcaggccccatgcctggcgcttcggcgttcttgtcttcctgatgattcattcctcgtccttcccctggcgagcggccatgcatggactcatggattgggcacgagtccgcgtgttcgggtgtcttggttgagcccgtcattctgcctgctccagttgccagttgccggcgaagcagctgccgccgtgcgaggcgcggtagtcgtggagttccctcgatcgttcgctctcccggcgggattgttcggcccgggttttgcggccggcgcggagcgcgagctcgatgtagcgtgaggcctggcctgggtccgggtcggggtcgaggcgcagcctgtcggcgagggcgcggatggcggtggacgcgtcgatgtcgtcgccgatgcggtcggcgagcatgcggcgcgcccgggtctcgtaggattccggttccgccggccggctctcccccgtgtcgcttccggtgggttggctggcgtcggcatgctccctgcgtcggcgttcgagggttcgctggtcgcaggtcaggtcgtcgcgcagttcgtcgaacaggcgggcgaagcggcgtcccgtgtcgacgcgtttggcctggaacccgttgtcgagcgcgtggtcgaggacccgttccatgagcccgctcgtgtcgggttcgccggcggcgtcgagccgttcgacgagccgagtgacggcgtcggtgtcccgccggcctgccggtttcggggtcaggcccatggcggctcggcggttttcgagccggtcgaggatccatctggcgcgtatcccggcggggacccgctcttccggttcggggccggcgtcttgccagcgttcgtcgtcgggctcacccatagggcggttcgcctcgtccggcgcggatgcggcttcgatgatgtgggcggtttggtttttcccgtcgcggctctccccggtccggggagatgcctccgtaggaggcaaaggggatatttgtttagaagtatttgttcttactataggggtgtcactggtgacacccctggaggtgtcaccagtgacacccctggcttccctttccgggtttagaggtgtcattttgacacccctagattttggcttgtttccgccgttttccagaggtgtcattttgacacctctaaatctgtccgctttcccggcctgttcggcattgccgtcgccgtcacgttcggcccgttcggcgcgttccgccctggcctgtcgtccgggtttctcggacacgtgctcgagggtcacgttcatgcagcattcccagacgacggaccggtacgggtcgggcacgtagttgccgtgctcgtcccattgggcgagcttctggttgccccggcggatgcatcccgtctcctcgagcgccttcagggcacgtttgacgcttgattcgctcgtgtgcgcctcgagcatcagggtgtccacggtgggccatgcgctgcgtccgtcgggctggcagcggtcggccagggcgatgagcacgagtctggccgtggccgtaggtgcgggcgcctccctgagcgcccatgacgtgcattgccagctcatggtcttgcccctttcgtttcgcgttccttcttgtgttcctgcatgagcctgtcgaacgccttgctggtgggttccaggcttccgtacctggctcccgccgatgcggcggcgcggcccatggcttcctcgttcctgtcctcgtgtccgtcatcgcgcatcgccggacagctccttccccgtgtcggcgtcgagggcggtttcgagggcgcggcacaggtcgagcgcctggtcgaacccgtcgagccatgcgcctacccagtcctgggcgtccccgcccccggccggcgtcatgtcgatggtcttgaggcgttccacggccatggcctgccggtcgatcctgccgtgtccgtcgatgatgatccgcatcgtcttccgttcctttcccgtcgcctcatcgggcgagctcttgcaccgtcatgcccaatgtcgtccgggtcgggtcgtggcgtttccgcaccctgtcgcacagggagggcgagggcatacgcgcgaacatgccggggtcgagctcccggatctctcgttcgtgggagacgagcgcgtcgatgacgtcctgcacgcgtgcgcgcagcagatcatgccatctgccgggccatgtctcgcacatcgcggcgaagcacaccatggcctcgtcgcccgcggccttgatgtaccgggtgtgcgcgggcagggcgaggatctcctggatccattgccagtcgtcgccgcgggcggcgtcgatctcgccggagagcatcctccatgcgtcgaacgtcgcgtcgagcatgatcgacgcctgttcccatgtcatggggatcgcggggatctgcagggtgacggcgtcgggttcggcccctgccggggccgtcatcatcgtggtcatggtcgttcctttcgttcctctatggttcgcgggcctcgtcgtccggcttcccgttgtcctttcgtttgttctttcactcgtccatcgccggttttcggccgattacgggcgcctgtgccggcgcatgccctgaggtaggggtagcggtccagtctcggggtggtcccgttgtggtgggcttcgagccagtggcggatctccctgagcaggggacgggcgcggttcgaggtcatgcatcgggtcaggatccgtttccatgcggcgagtccccattcggcctggaccgcgagggcgagggcctccatgtccgtcttgtatccggcgtgtgttttagcaagttggcgtccgctttgtgagcggtgtttttccgcagtgtaggcagcgggttttccgcagggtgtgcggtatcggccgctgcctgtctgcgttgtgttggttatttggtcatgag

SEQ ID NO: 36 - DNA, 19376 bp, Bifidobacterium longum
gatgctccaccacctgggccgtcgtcatcggcgtggtgaaatacaactccaccgcacgctctcgttcctcaagactgaacatacgaaaatccttccgttcggtctccaagaaaacgtccgcagccccctaccacgatattcttgcgcaattcatcacgatgcacaacaagaagtcaaacgtactgcttatctggtcgggtgactggcccacctacagcagcaattccgacaaatactatgtgattcttgccggtgagggcttcgactcgacggatgaggcttggaattggtgcaaagccaacaattacggtccgaacgactgcatgcctatagatttgcagtaacaagtggaatgtgaatgtcgctacgttgctgggtctcctgagttacaagacgtacaatcgggagcatggccaaggacgacgacagaaccaacaagcctgaagaggccggcaagtggggtacagccggaaaatcctcaggaaagaacaacaagaacggcaagggaaaggaatacaaaaccgatcgacggatcgacaaggtattacagctcgcggcggatcgcatagacaccatcgactccagtgccagcgtgcctgaacgactggcacgtgcggcgaaatccagtgaactgctcagcgccgtatggtcgttgccgcccgctcaacgtcttatgttccaccacggcatgcaggtcactgatgtcgaaggcgattccactcccggattcgacggcaataaagaggacgccgaggagttcatttcgatcagctcctccgaaatcgcccgataccagcggctcatgtacgcgaatggcgtcaaaggctcgacacggcggctgctcatcgtgctgcaaggcatggatgcctccggcaagggcggcatcgtgcgtcacgtgttcagccaaggtgacccgatgggcatccattaccatggcttcggcaagcctgcggccgaggagctcgaccacgacttcctctggcgcgtgaagcgtgaagtgcccaaggcggggtggattgccgtattcgaccgttcccattatgaagatgtggtcatgccgcacgtctatggcacctatcccgaagacgtatggcgtgcccgctacgaccagatcaacgatttcgaacgtgaactggccgccagcggatgcgccatcctcaagatcttcctcgtggtaagccaggaagaacagaaaaaacacttcctcgggagactggacgatcccaccaagttctggaaattcgacatctccgatctcgaggcccgcgaccgctgggatgagtatatggccgcatggcaggaggtgttcgagaaaaccagcacggccgccgcaccttggtacctcgtaccggccgataaccgctggtattcgcgagcagtggtctccgaactgctgcgcaccaccttgaagaacatgaacatgacctggccgcccctcgaacccgaggtggaccccgacgaggtgcgccgccggttggcgtgagcgatcctcccactggcggagccaagcgcatggcacggctcttcgcacggctccgcccgctggcgggaggcgtcgcatagcgacggagggtggctcgtgccgccggaataggccactgggtagactgagcattatgactgacgagaaggaatacggatccctggggcggctggcccccgaatgggacggtgacgagcgtgaacggaatcttacggccgatgacatctacgaacgattcttcggctgggtggaagacatcaaaggcatcgaaccatggccgcatcaggaagaggccattatggacctcttggccggcgaccatgtgattttgaataccccgaccggttcgggcaaatcgctggtggcgcttggcatgcacttcgccgccctgtgcactggccgccgctcctattacaccgctccgatcaaggcgctggtgtcggagaaattcttcgacttggtcgaagtgttcggccgcgacaacgtcggcatgatcaccggcgacagccacatcaacgcggacgcgccgatcatctgctgcaccgccgaaatcctcgccaatcaggctttgcgcgaaggcacccatgccgacgtgggccttgtggcgatggacgaattccattattacggtgatccggagcgcggttgggcgtggcaggtgccactgctcacgctgccgcagacccagttcctgctgatgagcgccacgctcggcaatgtggacgccattgccgacaagctctccgatctgaacgacaccccggacgtggatgtaatcgccgacgcgccgcgaccggtgccgttgagctacgaatacacgctcgatccgatggaaaaaaccgtggaactcgccttccgcaacggcgaaaccccgatttatgtggtccatttctcgcaggacgccgcgctggagaccgcgcaggcgctcgcctccaccggcgtgtccagcaaggaacagcgccaagccatcgcagaagccatcaaaggcgtcaaattcaccacagccttcggcaagattctgcagcgactgctgcgcaccggtgtcggcatccatcatgccggcatgctgccacgctaccgccgcctggtcgagcagctcgcccagcagggtctgctgccggtgatttgcggcaccgatacattgggcgtcggcatcaatgtgccgattcactccgtggtgctcacggccctgaccaagttcgacggcaccaagatgcgccgcctgcgcgcccgtgaattccaccagattgccggacgagctggccgtatgggattcgataccgagggactggtgatcgccgaggctcccgaatatgaaatcgaaaaccagaaggccatcgccaaggccgggggagatccgaagaagctcaagaaggtcaagcgcaagaaggctccggaaggttttgtgacctggaaccagagcacgtttgacaagctcatcgacgctgaaccggaaaccctggtcccgcacctgaaaatcacgcattcgatggtgctcaatgaagtggcgcagggcggtgacgcccgtgcccgtatcgacgatctcatcgacgattccgcgcagacccccgaccagaaggagcatctgcaccagcgggccgacgagattttccaaaccctgttcgataccgaagtcatcgaaaccgaggaccgcaaggacggcggcaaggactactacatgacccttgatatgccggacgacttcgccctcgaccagccgctctccccgttcctgctggccgcgctcgaactgctggaccccgagtccgacacctatgcgctggacgtgatttccatggccgaggccacgctcgaagaccccaagcaggtgctgcgtgcccaggagcgtcaggcccgagacaaggcgatggccgatatgaaggctgacggactcgactatgacgagcgtatggataagctgcaggagattacgtatccgaagccgctggaagacatgctcgaagccgcgttcgatcagtaccgccacgatgtgccgtgggccaacgactactggctgtcgccgaaatccgtggtgcgcgacatggtggaaaccgcctccgacttcaccggatacatcacccgatacaacatcgcccgctccgaaggtaccctgttgcgctacctctcggacgcctaccgcacgctggcgcgtaccgtgccgcccgaaaagcgtgacgagcaactcgaagacatcatctcctggctgcgcgtgctcgtgcgctccatcgactcctcgctggtggatgaatgggagaacgccggcgattccgccgaccagtccgaggcggcggcctccttggcggcgccgggcaagaagaacgcggtggtcgaggaccgacgaggccttatcgtgctgatcagaaacgccatgttccgccgtgtgcagcttatggacctcgaccagccggacaagctcggcgcgctcgacaaagactggggctacggtgtgcacgaatgggaagatgtgctcgacgactactacgacgagcacgagtacgtgggcatcggcgccgaagcgcgctcgcccgaactgttcatgttggatgacaagcacgagaacgacgagcatacgtggaaggtgcgtcagattatcgatgattccgatggcgatcacgattgggccatcgaaggcatcgtggacctcgacgccacccaagacaccggcgaagtagtcttccacgactacaaggtgagtaactgattcctttcttggctcccctctctgagggaagccagggtgcagctcgaacgtctgttcgaacactggggtactataggacgttatgagtgagaacgatttgtttggggcggctgatgcgccggagtcgatgacgcggccgttggcggtgcgcatgcgtccacgcactttggacgaggtgattggccaaacgcaggtgttgggccagggctcgccgctgcgccgcctcgccaatccggccagcaaaggcagtctcaccgcgccgagctccgtaatcctgttcggccctccaggcgtcggcaaaaccacgctcgccaccatcgtggccggccaatccggccgcgtgtttgaggaactctccgccgtgacatccggcgtcaaagacgtgcgcgacgtactcacccgcgctcacgaacggctcgtgtcacgcggccaggaaaccgtactgttcatcgacgaggtacatcgcttctccaaatcccagcaggatgcgctgcttcccgccgtcgaaaaccgcgacgtgacctttatcggcgccaccaccgagaacccgagcttttccatcatcaaaccgttgctctcccgttcggtggtcgtcaagcttgagtcattggagcctgatcagctcatcgaactggtgcagcgcgcgctgactgatgaccgcggtctcaggggcgaggtcaaagccacggacgaagccatcgccgacatcgtgcgcatggccggtggtgacgcacgcaagagtctcacgattctggaggccgcggctggcgcggtcactggcgacgaagcccgcaaaaagggcgcacgccgacccatcatcacccccgaaatcgtggctacggtaatggacaccgccaccgtgcgctacgacaaagacggcgatgaccattacgacgtgatttccgcattcatcaaatccatgcggggctccgatccggatgccgccatccattatctggcacgcatgctgaaagcgggtgaagatccgcgcttcatcgcccgtcgcatcatgatcgccgccagcgaggaagtcggcatggccgccccgcagattttgcaggtcaccgtggccgcggcgcaggccgtggcgctggtcggcatgcccgaggcacgtattattttggccgaagctacgattgccgtggccaccgcgcccaaatcaaacgccagctataacgccattaaccaggcgctcgcggacgtggatgccggcaagatcggcgctgttccgctgtatttgaggaacgcccccaccaagcttatgaaagagtggggcaaccacgagggctacaagtatgcgcacgattggcccggtgccgtggcgccacaggaatatatgcccgaagagctgcgtggcaccgagtactaccatcccaacgatcgcggctacgaacacgaagtcagccagcgtcttgccaagattcgcccgatgttgcatggcggggaacccgaacagaaatgaacataggggagtaaagtgtaacgcaacaataacagtgggaaagggaagacaaacaccatggcgaccatcttcatcgtggacgacgatcaggccatcggcgaaatgcttagtcttgttttggaaaacgagggattccagaccgtgacctgcctggacgggctgagggctgtggaaatattccccatcgtcaagcccgatttgattctgcttgacgttatgctccccgggctggacggcacgggggtggcccgccgcatcagagctacctctaatgtgccgattatcatgctcaccgccaaatcagacacacttgacgtcgtggccggcttggaagccggggccgacgactacgtgcccaagcccttcaaagtggccgaattgctggcgcgtatccatgcacgcttccgcatcgccaagccggccgccgaagacggtgccaccggtggcgcaagcggtggcaatgcaaacgtcaaccatctggaacgcggatccatcgtcatcgaccgtttggaacacaccgccaccaaggatggcaaggacctgaatcttactccgatggaattcgagctgctgttcatgcttgcggccgccgccggcgaggccatcagtcgttccagcctgctcaagaatgtctggggatacgagaattccggcgatacgcgcctggtcaatgtgcatgttcaacgccttagggccaaagtggaggacgaccccgagaacccgcaaatcgtgcagaccgtacgtggcatcggctacaagttcgtcactcctgaacaatgaacctgcgccctcgattcagcctcaaacgcttgctgcgccacggacgcgctgaagttcgtcgctcgctgcaggcccgcaccgtggccctcaccgtgattcttacactggccgtggccatcgtcttctctggcgtatcgatggtatcagtgcgcgcctcgctgcttacccaaatcacttcgcagtcgcgtgccgactattcaaacatggtgcagcaggcccaaaccagtctggacgcggccgatgtctccgccacagtgcagatccagcagctggtcaatgacttggcgtcctcgttgcaatccgaggggccctccaacctgataggtgtgtatttgtggagtcgtgataccaactcgcgtgccatcattcccgtatccaccgaacccagctatcaaagtctgatttctgatgacatccgttcgtccgtggcttccgacttggatgacatcgtgttctatcagccggtcgaaattcccggtgattccggcatgtcgggcagcgggacgcccgcagcggtgctcggcaccgtattggactttggcgtggccggcaacctcgaattcttcgccatttattcgtacacgttccagcagcagtccttgacgcagattcagctcagtctggtggtcatctgtgcgttgctgtccatcgtggtgggcgtagtaatctggctggtgattcgtggcatcgtgcgcccgattgaacgagtggcagcggcctcggaaacactggcctccggcaatctcgatatgcgcgttaccgtgaatcgtaaggatgagcttggtgtgctgcagcaatccttcaatacgatggctgatgcgctcaaccagaagattgatgagctggaggaagcaagcgttttccagaaacgatttgtgtccgacgtcagtcatgaattgcgcaccccggtgaccaccatgcgtatggcttccgacctgctcgaaatgaaaaaagacggcttcgacccctccaccaagcgtacggtcgaactgttggccggccagatcagtcgattccaagacatgctcgccgatctgttggaaatctcccgctacgatgccggttatgcggcacttgaccttgtggaaaccgatttatgcgaaccaattgaaacggcagtggaccaagttgccggcatcgcccaagccaaacgggtgccgattcacacgtatctgcccaatgtgcaggttttgactcgtatcgattcgcgtcgagtgattcgcatcgtcagaaatctgttggccaatgccgtcgatttcgctgaggaccggccgatcgaagtgcgtgtcgcggccaaccgcaaagccgtggccatcagcgttcgcgactatggcgttggtatcgacgaagacaaagtcgctcatgtattcgatcgattctggagaagcgacccttcacgttcgcgcgttaccggcggcaccggattgggcttggccatcgccatgactgatgccttgctgcaccacggtactatccgtgtacgttcggcagtgggggagggcacctggttcttggtattgctgccgcgtgaccccgaccaaggtgaggtggcggacgctgaactgccggtgaattttgcttctgaaacgcccgatgacctgcgtattaccggtgggtttggtgtggccaccagccaagtcacacatgattatcatgaggttcgccgcgacacgatgatggggaggccgctatgagacgagtgaccagaacgattgccgccgcaggcgcggccatagtctgttgcgtcacgatgacggcatgctcaagtccgttcggtttgccgattagcggctcggtgcagactctggcaccggtggaacagcagactcagcgtgtttacaccaatcctcagggacctgcggacgatgcgcagccggaaaccatcgtcaaagggttctatgatgccatgcctgccggcgtacagtccgatggctaccgtgtggcccgtgagtttctgaccggttcggcgtcggccggatggaatggcgattcctcggcactggtctacagcggtacgccggatttccgccgccgtgccaatacgatgagtaccccgcaaggggcggagagctcgctgattgtagaagtacagctccaagtggtcggctctctggactcgcatggcgtgtatacgccgacagatagcagcacgatcagcaaagttccttatatcttgattaaaagaagcggccagtggcgcatctcctcgttggagaacggcgtggtgatatccaccgccgattttgaacaagtcttccgccaagtatccgtgtatcaggtgagcacatccggcaaacagctcataccggatgttcgatggctgagctggcgcaactggcgcacccaggcagtcggtgaagtactctcggatgcaccctcctggttggaaggagtgctgcgaggcaccggcttgcctaccatcaaactcgcggtcgacagcgtgccggtgaagaacaatgtggtggagatacaccttaacagcggtatcaatgcgttgaatgaggaagaacgaggcctgctggtacatcgcatccgtctgactatgggcgacggcaatgccgaatacgcgctgaagattaccggcgacggagtggactattctgatgccgacgcaaatgtgaaacttactaccgagcagccgacagcgggcgtatacacgttgaccggtgggcatatcgtttccctggccagctccagtccgttgcgtgtaggggaggcccccggatatgacgatgctcggggcttcgttttttcctcatccggcggtgcggtgttgcgtgcggacggtgtcgtcgaatgcctgaaatctgatggtgcgtcctgtggggtgatgttctccggcgagtcgatgcgatcgattaccgaaggtctggatggcgaagtatgggctgtatccgagaacgggcgcgaattgcatgtgtcagatgggggtaaggaaaccgatctgaagcttgattggcttggcgctgccgacagcattgtggcattggcggtttctccggaagggtgccgattggcgttggcagtcgagggcgaggacacgaacggcgtgatgatgaccggtgtggcgcgcaacggtgataaaacactgagcggtctgagcaaagcggccacccaagtgagtgtgctcagacacgtcaccatgctcacgttctacaacgatctgaatctggtgtacgccaccacacctcctgagggaaacagcgaacaacaagaggcatggcgtcaaatggcaccaggcccggccaatgcgcagcgtctgcctaatggaaccataacgtcgatggcatcggggcagattagcctgtcccgtcgcctggccattgtggacgatttgggtattgttcgctccgtttctggctcactcgacggttcctggaccatcgccgatagccaggtcactgccctcggtgcgcagtagatggtataagaaaaacggtgttcataataacctttcttgttgtatgaggcaacggctttgtcgctcggctggcgagcggcattgccgctgcgcaaccaatcactattactattattggtctgttatcaaggcaaaacagtgttgcgacgccatttttgaaccactgttattaatttgttataaacctgttatcaaactgttatcgcatgcgattgaacatttggcctgtgagcgtcatactagaggctgtcgatgacgaacagtcaccaaacaggatgaaagatcatccaaaaaataaacactgctcgaggaggagtatttatgaagaattggaagaaggccattgccctcgttgcttctgctgctgcgcttgtcagcgttgccgcatgcggttccagcaacgcaggtggcagctcggactccggcaagaagacggttggcttcgttgctgtgggccctgagggcggcttccgtaccgccaacgagaaggacattcagcaggcattcgaggatgccggctttgacctgacctactctccgacccagaacaacgatcagcagaagcagattcaggcgttcaacaagttcgttaacgacgaagtcgacgccatcatcctgtcctccaccgaggattccggttgggatgactccctgaagaaggccgctgaggctgagattccggtcttcaccgttgaccgtaacgtggacgtcaaggacgccgaggccaagaaggccatcgttgctcacatcggaccgtccaacgtctggtgcggcgagcaggctgccgagttcgtgaacaagaacttcccggatggcgccaacggcttcatcctcgaaggccctgccggcctgtccgtggtgaaggatcgtggcactggttgggacaacaaggttgcctccaacgtcaaggttcttgagtcccagtccgctaactggtccactgatgaggccaagaccgtgaccgctggtctgctcgacaagtacaagtccgacaacccgcagttcatcttcgctcagaacgacgagatgggcctcggtgccgctcaggctgttgacgccgccggcctcaagggcaaggtcaagatcatcaccatcgacggtaccaagaacgctctgcaggctcttgttgatggcgacctctcctacgtgatcgagtacaacccgatcttcggtaaggaaaccgctcaggccgtcaaggactatctggatggcaagaccgttgagaaggacatcgagatcgagtccaagaccttcgacgccgcctccgccaaggaagccctggacaacaacacccgcgcctactgataagtctgctgcgactcattgataactggaccaaataattgatgtgatggtgtgagaaggatgttccttccacaccatcactcatgtgtggctcaaatatcacaaaacgataacatttcattctcgtttaaggcaaagacatgacagataaaaaccccatcgtcgtaatgaaaggcattacgattgaattcccgggcgtcaaggccttggatggtgttgatttgactctctacccgggtgaagttcacgccctgatgggtgagaacggtgcaggcaagtccaccatgattaaggctctgaccggtgtgtacaagatcaacgccggctccattatggtggacggcaagcctcagcagttcaacggcaccctcgacgcacaaaacgccggtatcgccaccgtgtatcaggaagtgaacctgtgcaccaacctttccgtcggtgagaacgtgatgctgggccatgaaaagcgcggccccttcggcatcgactggaagaagacccacgaggccgccaagaagtatttggcacagatgggcctcgaatccattgacccgcacactccgctgagctccatctccatcgctatgcagcagctggtcgccatcgcccgcgctatggttatcaacgccaaggtgctgattctcgatgagccgacctcttcgctggatgccaacgaggtcagggacctgttcgcgatcatgcgcaaggtacgtgactcgggcgtggccatcctcttcgtctcccacttcctcgatcagatttatgagattaccgatcgtctgaccattctgcgtaacggccagttcatcaaggaggtcatgaccaaggacaccccgcgcgacgaactcatcggcatgatgattggtaagtccgccgccgagctgtcccagattggtgccaagaaggctcgccgtgaaatcacccctggcgagaagccgatcgtcgatgtcaagggcctcggcaagaagggcaccatcaacccggttgatgttgacatctacaagggtgaggtcgttggcttcgctggcctgctgggctccggtcgtaccgagcttggtcgactcctgtatggtgccgacaagccggattcgggtacctacacgctcaacggcaagaaggtcaacatctccgatccgtacacggctttgaagaacaagatcgcgtactccaccgaaaaccgtcgtgatgagggcatcatcggcgacctgaccgtccgccagaacatccttatcgccctgcaggcaacgcgcggtatgttcaagccgattcccaagaaggaagcggacgccatcgttgacaagtacatgaaggaactcaacgttcgtcccgccgacccggatcgcccggtcaagaatctctccggcggcaaccagcagaaggtgctcattggccgttggctggccacgcaccccgagctgctgattctggacgagccgacccgtggtatcgatatcggtgccaaggctgaaattcagcaggtcgtgcttgacctggcttctcagggcatgggcgttgtcttcatctcctccgagcttgaagaggtcgtgcgtctgtccgacgacatcgaggttctcaaggaccgccacaagatcgcagaaatcgaaaacgacgacaccgtctctcaggcgaccatcgtcgaaaccatcgctaacaccaacgtaaacaccggaaaggaggcatgagatggctgaaaaggcaaaagccgagggcaacaactttgtcaagaagctgctgagcagcaacctgacctggtcgatcgtcgcattcattcttctggtcatcatctgcaccatcttccagcatgacttcctggctctgagctggaacagcaacaccggtggtctggccggcccgctgatcaccatgctccaggaatctgcccgatacctgatgattgcaaccggtatgaccttggttatctccaccgccggtatcgacctttcggtcggttccgttatggcagtggcaggtgccgccgccatgcagaccctgtccaatggcatgaacgtgtggctctccatcctcatcgccttggctgttggtctggccattggctgcgtcaacggcgctctggtttccttcctgggcctacagccgttcatcaccaccctgattatgatgctcgccggccgtggtatggccaaggtcatcacctccggtgagaacaccgacgcctccgcagttgctggcaacgaaccgctgaagtggttcgccaacggcttcattctgggcattcccgccaacttcgtcatcgccgttatcattgtgattctcgttggcctgctgtgccgcaagaccgctatgggcatgatgattgaggccgtgggcatcaaccaggaagcctcccgtatgactggtatcaagccgaagaagatcctcttcctcgtctacgcgatttccggcttcctcgcggctatcgctggtctgttcgccaccgcatccgtgatgcgtgtcgacgtggttaagaccggtcaggacctcgaaatgtacgccattctggcagtcgtcatcggcggtacttcactgctgggtggtaagttctccctcgccggctctgctgtcggtgctgtaattatcgccatgatccgcaagaccatcatcaccctgggcgtcaacgccgaggcaactccggccttcttcgccgtcgttgtgattgtgatctgcgtgatgcaggctccgaagattcacaacctgagcgcgaatatgaaacgcaagcgcgcgctcaaggctcaagctaaggcggtggcagcatgacaacagctacggcaaacaaagtgaaggctcccaagaagggcttcaagctcgatcgtcagatgatcccgaccctcgcggccgtggtgatcttcatcctgatgatcatcatgggtcaggcgttgttcggcacctacattcgactgggcttcatctcctccctgttcattgaccacgcctacctgattattctggctgtggccatgaccctgccgattctgaccggtggtatcgatttgtctgtcggtgctatcgtggccatcaccgcagtcgtcggcctgaagctggcgaacgccggcgtgcccgccttcctggtcatgatcatcatgctgctcatcggcgctgtgttcggcctgctggccggcaccttgatcgaggaattcaacatgcagccgttcatcgcgaccctgtcgacgatgttcctggcccgtggtcttgcctccatcatctccaccgactcgctgaccttcccgcagggcaatgacttctcgttcatctccaacgtgatcaagatcatcgacaatccgaagatctccaacgatctgtccttcaacgtcggcgtgatcatcgcactggtggttgtggtcttcggctacgtcttcctgcaccatacccgcaccggacgcaccatctacgccatcggcggctcccgttcctccgcggaactcatgggtctgccggtcaagcgcacgcagtacatcatctacttgacctctgcgactctcgccgccctggcctcgatcgtgtacaccgcaaacatcggctctgccaagaacactgtgggtgttggctgggagctcgacgccgttgcctccgtggtcatcggcggtacgatcatcaccggtggcttcggctacgtgctcggctccgtgctcggctctctggtccgctccatcctcgatccgctcacctctgacttcggtgtgccggctgaatggaccaccatcgttatcggtctcatgatcctcgtcttcgttgtgcttcagcgcgcggtgatggcggtcggcggagataaaaaatagcgggcttgcccgctcggtctccgcaccgaatacgacacacaccataactgaataggcgggatcagcccggctgctgtgatggcaaggtcacagcagccggcactgcccgccaaagctttctttctccttttcttcctttcgttagcgtgtggggcgtgccccggggttctcccggggcacgccccacacgtgtttggaaagctgggactctattgatgatcggatttatgcacgcttacgtgccgcgcgaatgcggaacgcggtggccagacagcaccagccaatcaggcagataaccgtcatcgtggcaaacgtccatgtgccgccgacggcagtggcgtgagcaaactcagcggtgccttcttctcctgcgccggcctgagccacggaaagaatcgtggagaacagtgcggtaccggcagcgccgccaaactgaagacacgtgttgaaaatggcgttgccgtccggcttgaactcgggagagacctccgacaggccactggtcatcacattcgcattgccgatggaatagaacagaccgaaaatgaaatagaatccggcgagcagcaagggcgtaagctgcatcgagaacaccagcataagcactgggcccaaaatagcgatgccgatcggaatcagaatcggcttgaccgcgccgaacttatcgtagaaccagccgccaagcggggcacagacagcgccgaccagtgctccgggcagtaccagagagccggccacaaatgccgtggtaccgagcgagagctgtgccacattggtgatgacatagccgtagccgatggcgaccaatggcagcagcagatatgcgcaggcgtgtaacagtacggcgggatccttgagaatgccaaggcgcagcagcggggagaaggcacgcttggaactcatggcgaacacgatcaacaaggcgaggcccgcaatcagactgacaatggcgataatgccggagcgtgtggctgacttgccggacaccgccgcactgatggccacgccaccttggttgagcgccagcaccagaccgaccaacgcgacaacaatggacccaagctgaatcgggtcaagataggcagcctcggtcggtgtcttctgctcaatgcacttcatgccgatgcatgctgcgattagcaccagcggaatggcgatgacgaaaatcgcgcgccacggcagcactgtggtcaccgcgccgccgacggtcgggccgatggccggagccacggtaatgaccagcgatcctacgcccatcaatcggccgatcttcgaacgaggagactgctccagaatgatgttgatcatcaacggcgtggccacgcctgagccaatgccctgaataatgcgggcgacaatcagcagcgggaaggcttgggcgacgatcatgatcagcgagccaacgatggccagaatcacagccgcaagaaaaatggttttcagtgcgaatcggcgcttcaaaaacgagctgatgggcatggtggcggccaccgccaacagataaatcgtggtaatccattgcacagtggccgtgtcgacatggaattcgcgcatcagtgcggggaaaagcacggtcatcacggtttcggtcagaatgccaatgaaggcaagtgagccgacggctacaatcgcgccgataagacgtgtgggaatcttctcgttatcaatatgctgctcaggcatacatgctcctaaacgttcggttgcaatgtatggaatgtaaggtttaccaaccggcgtaggtacctgtgcgtgcggataaaccggcaatcgtactgccttggctgcacgctatggaatcacaaaaccacctgcgagtgtacggttcggggcggacgctacggtcgatgcgcaatgggctgtcccttggtttggtggggtttgatggggcgggttcggcattggtccggcggggcgggttcggcattggttcagcatgaggaaacacgcgataatatccgccctgccgcctagtttggtgaaccatgggtattgagaacacgcataagctgattgtcaactgcctgccactcaacgaaggagaacggcgcgctttcgccaaggcggcccgcgatgtgccgcaggaattcgtaggcgacgaagcgcaccgcggcgacatggtctggtcggccgctgttcccgaggagcttcgttcccaagctaccgcagtcatcggcaactttccggtttcgcaggcttcccaatacacccgtcttgaatggttgcagaccttcagcgccggtgtggatgcgtacatccgcccgggtgtgctgcctcgcggcaccatggtcaccaatgcgagcggcgcgtatggccaaagcgtgtcggaacacatgttcgccaccatgtgggcattgatgaagaacctcaaccggtatgcctccaatcagcgtgatcatcagtggcaggatgaaggcccggtattgagcccggaaggtggcatcgcactgattatcggcgtcggcgacatcgggtcgcatttcgctcagcttgcccaatccgtaggtatgtgtaccttcggcgtgcgccgtcatgcggacgtgccggccaagggcattgaaaagatgtatggcttcgagcggctggaagcactgctgccattggcggacgtggtggcgatggcggtgccgcgctcgccgcagacccatcatctgctgaatgcggatcgtctggggcgtctgaaatccacagccatcgtgatcaatgccgggcgtggcgacgccatcgatcccgaggccttggccgacgccttgcacaatggacggctccacggtgccggattggacgtcactgagcctgagccgttgccggcggaaagtccgttgtgggatgagccgcattgcctgatcaccccgcatgtggccggcggcaatcatttggaaaagactttcgaacacatcatccgcatcgccctgaccaacgtttcccgctatgccaaacagcaggaactgttgaatctcgtgcgatactgattcgcctgtgtcgggtgtacatgaactcatgtacacggccggcgtgtcgcatcccgctgcgactgcggcatcgagatgatacctgcagaggcgtggttgatcaggggcccaatgaacgtggcccgaggtcagtctcagtctgatagttcgtagccgttggcgtctttatgccacggtgagccgggcttgctgcacagaatgatgatgccttcaacaaagccccagatggcggctgcgattgggccaagtccgagcagaatccagccgacaagcgtcagcagcagctgggccacggccttgccggtgttgccgagatagaagttgtgcacaccaagtccgccgaggaagatgcccaacaggccggcagccagcttggacttggacgattgccccaccggggcggcggcatacggagcggcggtgtattgcggctgcgcgtaggcgttcggctgctggtaggcctgtccatagccgggctgctggccgtagcccgctgcgggctgtgcgggctggccgtactgcggctggccgtactgaggctgagcgtatgcgccggcgggctggccgtattgcggttgctgctggccgtagcttccggcggcgggttgagcgtatgcggcgggctgtggggcgccatagccctgcggctgctgtgcggcatcttggccgtaagacggttgtgccggctgtgcgggctgtgccggctgcggaacactgtccgaaccgtacggttgttgttgattatcagtcatgcgggtcagtcccctctcaatcgggaacggcaataccttcttaccgtttctgcacaacatcatctcatgttttgcccaatagtaaaacctgccgcgctacgattgggccatgagaagtttcctgaccagctggttgattatgactatcgccgccgccgtcatggtcgcggtgactcccggcatgaccccggtgggggagcctccgattctcggcatcgccgcgttcgctttgttcatggcgctgattaatgcgtcaatcaagccgattgtgcatctgatcgcactgccgtttgcgattctgtctctcgggctggtcaccttgattatcaattggctgttcatgcgactcgccagctggctggcggtcagtctgttcggcgtgggcgtcttcgtacacggtttctggtggtcggtactggggtccttggtcctgaccattgttgcgggaatcgtcgggtccatcttggatcagtgacggtgctcgctgggcgaatatgagtaatggcggttgggatcgggctgattccaaccccccttactcatattaaaccaagggggtgagcgggggggacattactcccgccccaaacggacatgctccccatcttcgcgcccggggggacgggaaagcacgaaaagattgccgctgggctgcaccacttcggcgctcagcctcccggcgagcccggccgcggcgttccttgccggcagggccgaaccgccctgc

SEQ ID NO: 37 - DNA, 8895 bp, Bifidobacterium longum
tgcgcttgatctcccggctgatgctggacgggctgcggcccagcatcgcgccgatcccgcgtatgctggcgccgttgcctacctcgatctggatgacctggcgttcctcttccgacaggtgcgaatacacttctcccataggtgcgacatcccttcggactggttatctggacaatctccaatctaacgggtgttgcactttcatttagacaacgggaggcgattactcttgtcgctggttgtcctgtcatctaaagatgacaggacaaccagcgattcttcaggtttcttcattgacgttgttttgttcctaccgagatgtgcataatggatccgcgtctgcgggagccacggcctgacgcggtcgatgggcgcgaagggccgcagtccggacaacgcagccgccgggggcttcggcaggcaagcaggagttcttccacaagcgaagcttccaaggtgtctcgatcgacgagttcgtcacgttgttggacgagtgcatggtctggtacagggacaagcgcatcaaactcgaatacggcatgagcatcatggacaaacgcatcggactcgggctcgtcgcctgaacgcgcgtgctatcgttgcgaacgaccatacagacaacgaagtccaacaaaacgtcacccccccccccgacgagcgttgcacttacaaattgaattcgggacaatggtaacaacagctacagttgaactatgcatgggttgaagagtgcgattgacaggggagcggacgcgtgggcacgttcgctgcctgggcgcgtgctcgaccggtatgtgtcgcggagcggccccctgctggcgaatggtctggcatatggtctgctgttcgccttttttgccggcgtctggattgcggtgagcgtgttcggccttatcatggtcggcaacattgattggcagcagatgctgattgacgcggtgcgtgaagtcattcccggtgtggccgactcgtttctgacgtcttccgcactaaacaccatgtcaagcacattgacgtggaccggtctggccacgttggccatattctggtggacggtgaccggctggatgaactcgctgcgccacgccgtacggtccatgttcgacgactgcggcgacgagctcaatatcgtcgtcgcaaggttacgcgatacgcttgccgccatcgccatcgcaatactgttcattctttcgaccgcggccggtacggtgtccggtggcatcgtacgccgactgctgcaatggggcggcatccccagcagttcgttgcccggcaccgtgcttttggagatgaccggtttctgcaccggcgtcgcgctgaacttcgccttgttcatgctgctgttgcgtgtggtcgcgcacatcaaagccggacgattcacgctgatcggcgcgtcgtcgggttccctgacggtttcggtgatgcagctgctcggcgcgcgactgctgaccggcgcctcccgcaatccgctgctcgcaccgttcgcggcgttgatcggcgcgctggtgtggttcaatctcgtcgcccaggtcatcatgctgtgcgccgccctcatcgcggagtgccgacgggaatgctgaacagccgcccagaccacacggtatggtggggcgcatggctgattacgggaacaactttgtgcaactgcataaccacacgcactattcgctgctcgatggtgcgtcgaagatccctgatttggccaagcgtgcggccgaacttggcatgcctgcggtcggcatcaccgaccatggcaacatgcatggcgcctacgagatgtacaccaactgcgtggccaatggcgtcaagcccatcatcggcatcgaagcttatgtgaccccggaaaccgcacgtcaagacaaatcccgcgtgcattggggcactgaagcccagcgccgcgacgacgtctccggtggtggtcttatcacccacttgaccatgtgggctgaaaacgacgaaggcctggtcaacctcatcaaagcttcgtccgtggccaacctcgaaggtcgcgtcatgcgttatccgcgtatggataaggaggtgctcgccacctattccaaaggcgtaatcgcatcctccggctgcccctcgggcatcatccagacccgtctgcgtctcggtcagttcgatgaggccctgcgcgccgctggcgaattccaggacatcttcggcaaagacaacttcttcatcgaactcatggatcacggtctgcccatcgaaactcaggtgaccggtgacctgctgaccatagccaagaaactcaacgcaccactgctggccactaacgattcccactacgtacacgccgaagatgcccaggcacaggacgccatgctctgcatcaactccggttcccgtcttgacgatccggaccgattcaaattcgacggcaccggctactacatcaaaaccgccgaagagatgcgcgaactgttcaaggaccatccggacgcctgcgacaacaccctcgccatcgccgaacgctgcaacgtgatgttcgacgaccacgaagacggcgcgttcatgccgaaattcccttgccccgaaggctgggatgagacctccctgttccttaaaaaagtcgaggaaggtctggagaagcgttacgacggcaacccgccgctcgacgtattgaagcaggccgactacgaatgtggtgtgatctgccagatgcagttctgcggatacttcctcgtggtcgccgactacattcagtgggccaaggaccacggcattatggtggggccgggccgtggttcggccgcaggcgccatggtcgcctattccatgggcattaccgagctcgatccgctcaagcatggcctgattttcgagaggttcctgaaccctgagcgagtgagccttcctgatatcgatgtcgacttcgaccctgaaggtcgtgcgcgagtcatcgaatactgcggcgaaaaatacggcaccgataaggtcgcccagtgcgtgatctatggcaccatcaaaaccaagcaggccctgaaagactccgcccgcatcatgggttatgaattctcagtcggtgaaaaaatcaccaaggcgctgcctccggcggccaccggcggcaaagacatcagtctgcatgacatcttcgaccctgccgccaaacgttatgccgaggccagggaattccgagaactctacgattccgacccggacaccaagcgcatcaccgaagaagccaagggtatcgaaggcctgatccgacagaccggtgtacatgcctgcgccaccatcatgggtagcgcacccatcaccgacacctcgccgttgctggaacgcaccgatggcaccatcaccaccaccttcgaataccacacgtgcgaaacgttggggctggtcaagatggacttccttggcctgtccaacttgacgatcatccacgacaccctgaagaacatcgaggccaacggcaaacccgccatcgactacaccaagattccgctcgatgacgccgaaacctacaaactcatgtcccgaggagacacgctcggcgtgttccagctcgattccgacggcatgcgttcactgctgaaaaccctgaagcccgataacttcaacgatatttccgcacttatcgccctgtaccgaccgggcccgatgagtatggattcgcacaccaactatgccaagcgcaaaaacggcctgcagaagatcacgccaattcaccctgagcttgaggagcctctgaagcaggtgcttgacgagacctatggtctgatcatctaccaggagcaggtgcagtccgccgcccgaatcctcgccggttattcactgggcaaggcagacgtgctgcgtcgagccatgggtaagaagaagcccgaagtgctggccaaggagaaggtgccgttcttcgccggtatgaaggagcacggatattccgaagaggcatcccaggccgtgtgggatattctggtgccgttctccggctacgctttcaacaaagcgcactccgccgcatacggtctgatctcctactggaccgcatatctgaagacgcactacccggtcgagttcatggccgccctgttgcaaggtgccgccaccaacaaagacaagaccgcactgtacttgggcgaggcccgccgcatgggcatccaggtgctctcgccggacgtcaacgaatcggtgtacgagtactcggcagtcggcgacgtcgtccgattcggtcttggtgccatccgtaacgtgggtgacaaggccgtggccgatatcatcgccgaacgcgaaggcccgcgcggcaagttcgtgaacttcatggacttcatccgccgcgtgcccctgaccgcgctgaaccggcgattggtcgaatcgttgatcaaggccggtgccttcgactcgattgacccgaaccgtcgcgcgctgttcaccgtgcacgaggccgccatcgactcggtggtgagtctgaagcgcaaacaggcggagggccagttcgatttgttctccgatgccgaggatgggggagcggaggccatgggcgacgcttccgtgaccgtacccgatcttgaggaatgggacaagaagaccaagcttaacttcgaacgcgaaatgttgggcctgtatgtgtctgaccatccgctctccggtatgcagtcgattctcgcgtccttgcgtgaaatgtccatcgcgcatctggttgatcgagccaaaacgatgggtgaaggacagcaggtcacgttggctggtttggtcaccaatgtggaccggcgcgtatccaagaagggcaacccctgggccatcgtgaccatcgaagacatggaaagctccgtccaatgcatgttcttcggcaaggtctatgaagcggccgccgccgaactcgccgtggacgccatcgtacagattcgtggccaagtggagttgcgcgacgaaaccgtttctctgagagccacggaaatgcagattccgaccttggaagccgaggatgaacgtccgttggtcatcacgctgccgccggtggcgttggagcgccaacgcatgatgcaactcggtcaggtgctcgctaatcatcctggttactgcgaagtacatcttgcggtgctggatgagaagggtaacgctcaggtgctcacgtttggcgatcgtttccgcgtcaagcgggatacttcgttgtttgctgagatcaagattctgtttggccccagctgcttgcctgccgcctgattggcgggtttcgcccctggcctctccctcacctggctttgctggggactccttcatcagagggagctaaggcatgtgccaccatacgatgtgcgcgactattgtggaacgtatgggcatggagatggcggatactggtaacaacgatgacgagcgacaatggattgccgcgatgctggaacggctgtctcattcgcagttccgcgccaaattcgctttgaccgacaaagaacgagcctatgcccgcaccaaaggcaaggcgaccatcgatcgtcatgcgcgagaaatgttgcgagaccgcataggcgcagccgaaccgaagaacgacggcaggcagacgccatggcgcggccatccggtattcaccgctcagcatgctaccgccacatgctgccgcggatgcatcgaaaaatggcatcatctgcccaaaggccgtgaactcaccgaagcggaggtaaaccgacttgccgatttggtcatggcatggattgagcgggaccttatcaatcatccggttcggtgaagcaccccgcatcctcagtatgcctgtatgccttcaatagttatgagccaacagccaacataggcctcgaaaaccgtagatgcaaggtattggcgaatgcggcagaacgccgaacgttgcctatggcgcgttcgtcaataatgcgacatgatgtctattcaagaagagttgatgaagtgtcaactctgccccaaggaggcggaatatgtactacagcagcggcaattatgaggctttcgcacgtccgaagaagccggccgacgtggacaacaagcatgcatacatcatcggtaccggactggcggcattgtctgcagcctgttatctggtgcgtgatggtcagatgcctggcgagaacatccacatccttgagaaggacccggtacccggcggcgcctgtgacggtcttgatattcccggccttggctatgtgatgcgtggcggccgcgaaatggacaatcatttcgaggtcatgtgggatctgttccgctcgattccctccatcgaaaccgaaggcgtcagcgtactcgacgagtactactggctcaacaaggaggacccgaactactcgctgtgccgcgccaccaagaatctcggcaaggacgcggggctcaagggcaagttcgggctgtccgacaaggcttcgatggaaatcatgaagctgttcttcaccccggacgaagacctgtatgacaagccgatcaccgatttcttcgatgatgaggtgctggactccaacttctggctgtactggcgcaccatgttcgccttcgaaaactggcactccgcgctggaaatgaagctgtacatcaagcgctacattcatcacatcggaggcctgccggacttttccgcgctgcgtttcacccgctacaaccagtacgagtcgatgattctgccgatggtcaagtatctggaatcgcacggcgtcgaattccgctacaacaccaaggtcgagaacgtggaattcgcgattggcgggggagccggccccaagcgcgagcacaccggcgtaggccaagacaccatccagaagattcaggccacctccggcttcttcaagcgcaaccctgccagcacgcccaccaagaagcttgccgtgcgcatcgacgtggaccacgagggtgataaatcctccatcgacctgaccgagaacgatctggtgttcatcaccaacggcggttgcgtggagaactccaccatgggttcccagaactcgcccgccgcatggaacccagacctgaagcccggtggcggctgggatatgtggaagcgtatcgccgaccaggacccgagctttggccatccggagaagttctgctccgatccgaatgccaccaagtggatgagcgccaccgtcaccaccctggacggcgagattccgccgtacatccagaagatctgcaagcgcgacccgttctccggcaaggtcgtcaccggcggcatcgtcaccgtgcaggactccaactggctcatgagttggaccctgaaccgccagcagcagttccgcgaccagcccaaggaccagctgtgcgtatgggtctacggcctgttcccggacaagcccggcaactatgtgaagaagccgatgaccgaatgcaccggtgaagagatttgcgaggagtggctttaccacatgggcgtgccgaccgacaagatcgaggcgctcgcaaagcaccacgccaacaccgtgccggtcatgatgccgtacatcaccgcgttcttcatgccgcgcgcggccggcgaccgcccggacgtggtgcccgatggtgccgtgaacttcgcattccttggccagttcgccgagaccccgcgcgacacgattttcaccaccgaatactcgatgcgcaccggtatggaagctgtctacacgttgctcggcgtggaccgcggcgtgcctgaagtgtggggtagcgtctatgacgtgcgcaacctgctcaacgccaccgtcaaattgcgtgacggtgcaccggtcaccgatatgaagctcaacttcattgaaaaggccgtggtcaagaaggtgctcaagaaactcgacggcaccgatattgccaccctgttacgcgaataccgcgtaatctgacatccatctggctcccctcgactggcacgcgaagcgtgactggggggagttgctcacaacggagtgttaagagaaagacaaaaacatgactgattctgatccccagttaatccgccacgccaccatcgacgatctggacgcgctggccgccatggaatccgaatgcttcccggccgccgaggccgccgaccgctcgtccctgcgcgcccgaatcgagacctatccggaatgtttctggctattgattgatggcgagatcgtcatggcgttcatcaacggtttcgcgaccgatcggcgcgacttgaccgatgacatgtacgaggatgccgcgcagcacaaccctcaaggtgactggcaaatgattttcggcgtggatactgcgccgaagtatcagcatcgcggttgcgccagtacactcatgaggaaagtcattgaagacactcgtgcagctggacgtaaaggcttggtgctcacctgcaaagatcggctggtcggattctatgcgcaatttgggtatgaggacgagggcatttcggagtccactcacggtgacgtggtctggcatcagatgcgcctgaccttctaatccccctttgcttccccctctttgatgctgaggcgtctaaaaaaacagtccggtggactgtttttttagacgaaggcgagacgatagtcgagccataaggacgagagctttttgcgggtgagccgtccgcgtgatcggactgagggaagttgaacgtggaataaattgttgcgacacgccggtgaacatctgatttcgttacgtgagcccataaaaagccggcgtatcctgatggtaacggcgtgattcaagctgatttcgacacgccgatggaacgacgtcgttgcaacgattctggcgtgttttttcgtgcccggtttgcgcgagtccgcgaatgcgtgtaagttatctccttgctgccgctcagcgagtggttctcctccggggagctgcgaggtgggtgagtggtggtggtttgagaactcaagagcgtgtttgtactacttctttatagtcaatgattgccagttcattcctcgcctgattgcctgtcgtggtggttgggtacccgggagggtttgatgaggggtg

SEQ ID NO: 38 - DNA, 7223 bp, Bifidobacterium longum
gatgagtacatacgctggtacaaccacgagcgcatcaaacagtcgcttggttggatgagcccggtacaataccgtcaaagccaaggaatggctgcgtgattatctccaagaaaatgtccgcagcccccaactggatgctcgccatcgtcatcgctctggtcgtcggcctgatcgtcggcgtctggcagggcttctgggtcgccgtcatcggcatcccgggcttcattaccactctggccggcatgttgatcttccgtggtctcgccaccgtgatcgtcggcgaatccgtgccgattacctccctcgaattccgtggcattgcccgtaactacctgcccaacatccttggctggtggggtccgttcgacggtctgaccattgtgctcggcatcctgtgcattgtcggctttgcctggagccagctgcgcaagcgcgcccgtgtggccaaggtcggcctggtgcccgagccgatgagcctgaccgtcctcaagattgtgcttgtcgcggtcgtcatcgccttcgtcacctacctgctggcttcctccggtaacgctgatcagggtggtaccccgatcatgctggtgatcgtcggtgtgctggtcttcatctacaacttcatcctgaccaagaccgtgttcggtcgccacgtgtacgccgttggtggcaaccgcaaggccgccatcctctccggtatcaacacccgccgcgtggacttcctgctgttcgtccacatgggcttcctgtccgcagtggccgctgtctgcatgctctcccgtctggcttccgcaactgctcaggccggtatggagttcgagatggacgccatcgccgcctgcttcatcggtggcacggccgtcaccggtggtattggtaccatcccgggcgctgtgatcggtgcattcgtgatgggtgttatcaaccagggtctgtcgatcatgggtgttgacaccgccgtggtgaagaccatcaagggcctcgtgctcctgctggccgtcgccgtggacatcatgtccaagcgcaagaagagctgaccttcccctttctcctcctcgatgtgggattcgtgccggtgccgctggtgcggatcccacactgttatctgccgtcattcttgtaatcaaaggactttttccgccatgaaactcaccgcgcgctccacctcccgtatgtatgcattgacctgcttggcctgcgttatctggctctggcagtcactggtcgaggccaataacgatggctcgctgttcaattgggccactattgtcttctcgctgtgcttgctagtggtcatcggatggagtggttggaatgccgtcgccgggtggaacgccaaggagactgaggccgccacggcaggtgccaaggatgatgagggcagcactgatcggtagcgtatatacggctgttgttgccggggacatataggtcccggcaaatctgcagcgatatgtgcattgcaagccagggattccctggcttttttatgtcgaaacggaactcgacacgggcgcgcaggccgttgggtttgtctagagcctgcatatagttacttatggtaatgactattggtaactaattggaggttgggccagcgatgtgcgattcccgaaccgataccaagaccggcttgcttccggtgaatgaggtgcggagcctcctggatgtctgctggaaagcgaaggctatcaccgagctgatgccggcactgcccaaaggcctgaaaccgcgctacgtacacgtcattgatgccgtctggcatatcaacgaaacgaatgggcaggaaatcggcaccgcacgggtaagcgatgtcagcgcctttctcggcgtcactacgccgagcgttaccaaactcgttggcgagatggtggagcttggtctggtggtcaagcatatggatgccgccgatcggcgtgcggtgacgctcacgctcaccgagcgtggactagatatccgccgcgtttacgtagaggaataccatgcgcatcttagccagctattgggcgggctgaccgtggaacaatgcgaaaccactgtgcgcacattgaccgaagccctgcggcttatgcaggaagacgcgcagcatcgcaaaagcatgtgaatgaatggaggagagcaacgattatgactgattcagcaacacaactacctcacggcggcaaacaacccttttccggcaagctcgtcatcgcggtcgtctcgcttgcgattctgaccttcctcggcatcctgtcggaaacctcactgaacatcgcctactccacgctgatggaggagttctccatcggcgcttcggtggtgcagtggctcaccaccggctatctgctcttgctgtcagtatcgatttcgagctcgccgttcatggtgcgcaagttcgccaccaaaaccctgttcatcatggccgtcgtgatcttcgccgccggcacactgctgggcgcgctcgcggtcaacttcccgatgctgctcgccgcccgactggtcatgtcgctcggtaccggcatctccctgccgcttatcaccaacatccactggcacgaagaagcgtgattccaacatgcaacgccctattatgacttcgcggtcgtttttgcgcacgccgtctgaagcggctgggcccggcgacgaggcaactattcaggacctcgtggatacgttggaggccaaccgttcacggtgcgtgggcatggccgccaacatgatcggcgtgagcaagcgcatcatcgtcttcgtggacgaagatttcggtggccgtatcacggtgatgctcaaccccgtgatcgccgcttcggatggtgccttcgacacccaggaaggctgtttgtcgctgaccggtgaacgccgcacactgcgctgccgccgtatcgaggtcaactacgaggaccgtcggttccgcgcccgccacgccaccttcaccggctggaccgcgcagatcatccaacacgaagtcgatcactgcaacggcatcatcatctgattcattcggtgctcgttgcagcccaccccccccccgaggctggtcatcgcgattacgatgcaattacatcgcaaccgctatgaccagtttttttatgtgcactggtggggtgggtgttctcagcggtgttggggtgccatgcgctggccggttggcttcgctgaggggtgtgggtggtgtcatgttgccagcggttggccggttggcttcgctggaggttctctcagcgtcggtgatgtgccaaagagtggcgggctggcttcgctaaggagcgttaccgtcggtggagaaccagtgcgtgacctgctgccgacgctaagcgttcattaagcgtcgttagcggccaaaacttggacgtgtaacgatgctgggcggttttagcgtcgttgctgtgccaagttgtggtcctctgccgacgctgccagtgcagtagcgtcagcgttgggacaggtgttgggcctttgccgactctataagcgagggaaaatcattcgccggtgcctaagtgggtctattgccatgctgaatacatctgctgagtgtagctatgcgttcgaaggcgatttcgggacctttctcagtagcaaatatgcctaatgcgcggagttatacacttcaccgtgcacttatacacgccaaacgaagcagaaatcgactgctgacagtggacgacacgccagagacgatgtggataacccagagacggtggataacagctgcgcgatcagtggataacctgcaagaaagtgcggttatccaccgacggtagccactgttatgcacattccataccccttggaatcattgggttttccacttatccaccatctcgccatgcgggcttgcgggccaccgcacgaacgtcatacagtgtgcctcacggcgggcaacgtagcccgccgtccacatcacatgaagggggaaacaccatgagcaccgcaaccactactactgccgaaaatgccggtttgccagcaatgctggacaccaaagacgtagccgagatgttcaaacgctgcaatctcgccgtctatgccgaagcgagacgcatatattatcgcgaagtgaatctgaacccatgcaaaaagtatccgaagcaggtgctgcaaagggtcgaatggtggttctgggattggtttgcctatgactgcgccgtcagcggtattggactgaccggcaatgaatccgaagatttacgtatcgaattgcagtacggtccgggcgcaggtatctcgccattcctagccttggccgaattcatgtatgacaaggacgaacgtatcggcacacgcgagatacgtgattttcgcgaacttgatgacaccaatttcgcttcgatgttctggattcgcgatgccagcgcggtcaaaggtcgtctgacagttgaggacatcattcatggtggtgtctacgaggtggcggacgtacatgccgcctcgcaatacgatggtgcgcacggcggcatgatcgtcaatcgcatcgcacatgtgagaggcgtgtggcgatcctgttccatcccgatctatgaggcacgaaggcctgatgacccgcgaatcggtgattcgctggcccgttcattccgggaaaccggatataaaccggactttgccggtctggtgcggtttttctacgggagggccaaagacaccggtctcgactgggaagatgtggaagccgcgcgccaagccggtactttggacgcgctgatcaagaaggccagcaatcggtgaaggattcgcctaacgctgctgtccaagtcggcggccgcgatcacgaatgaagagtgacgcaaccaaacagaccgcgcacacaatggcgaccgtgcggaacgaagcccgcacgccaatggccgatgccgccgctttcggcactccggtgcgcatggccgccgcggtgtgcgtgttcatgatggtgaccagcagcacagccgcagacgtcatgatcgcgaagcccagtaaggcgagcggccggccaccgatacggtcatacatcttgcctgccaccgggttcaggatgcccatggcgatgccgctcggcatcatcaccagaccggacaccagtgcattaacgccaagatcattctgcaaatatgcccatcgcgtacaggaacagctggcgggtggtgaaggtctcgatgaggaacgcggtgatcgggatcatgatgccgttggtaagcatgaatccggtggtcagccattgcacggtgctgctgggcacgtcgaactcgtgcatcaacgtgggcagggcggagatcatcagcgtttggttgaggatggccacaaacgagccgatcatcagggtgatgaccatggcggtggtgttggcgggggtggtgctgttggagttggcggggtggtggagccggcctcagcggtggccggcgaggaattgcgtgacgtcaattatcaagtctcgtttccttggctgagttgtctttcttggcttgcccatactatctgtgccttgactgcattcgaaaaccattgcaatgactagcaacacgctgagacgcggcgtattaattcaatcatttgacaaacttagttcgttcgttttattattggtcctgcaatccgtaatatcgcctactgcaaaggagcgcccaaatgggtctgtgggatgttgacaagatcgagtacgtcggccgcgccaaaggaccgaaggaagacttcgccttccattactacgatgccgacaaggtcgttgccggcaagaagatgaaggattggctgcgcttcggcgttgcttggtggcacaccttcaaccaggaactggttgatccgttcggcaccggcaccgcgcaccgcccgtactacaagtacaccgatccgatggaccaggctctggccaaggtcgactacgccttcgagctgttccagaagctgggcgtcgagtacttctgcttccacgatcgtgacatcgcccccgaaggcgataccctgcgcgagaccaacgccaatctcgacaaggtcgttgacaagatcgacgagaatatgaagtccaccggtgtcaagctgctgtggaacacctcctccctgttcaccaacccgcgcttcgtgtccggcgccgccacttctccgttcgccgacatctacgcctacgccggtggccagctcaagaagagcttggagatcggcaagcgcctgggcgccgagaactacgtgttctggggtggccgcgaaggctacgagaacctgtggaacaccgagatgaagcgcgagaccgaccacatcgccaagttcttccacatgtgcgcagattacgccaaggaaatcggctttgaggcccagttcctgatcgagccgaagccgaaggagccgacgctgcaccagtacgacttcgatgccgccaccgccatcgagttcctgcgcaaccacgacctgaccgacgtcttcaagctgaacttggaaggcaaccacgccaacctggccggccacacctaccagcacgagatccgcgtggcccgcgagtccggcttcctcggttccctcgacgccaaccagggcgacaagctcatcggctgggatatggacgagttcccgaccgatctgtacgagaccgtcgccgtcatgtgggaagtcctgcaggccggctccatcggacctcacggtggtctgaacttcgacgccaagccgcgccgtacctccttctacgaggaggacctgttccgctcccacatcgccggcatggatgcctacgccgccggcctgctggttgccgacaagatgaaccaggacggcttcatccagaatcttcaggccgagcgctacagctcctacgactccggcatcggcaaggacatcgacgagggcaacgtcaccttggccgacctcgaagcctacagcctcgacaagccgcagtccgagctcatcgccgccaccaagtccgatcacctcgagtccgtcaaggccaccatcaacaactacatcattgatgccctggctgaggtcgagtgaccatcggtctgaccgattgaattcgctccatcgggcgtgtacacatcaattatgatgccagtgcgcccgatgggctgattcgatagtttcgccatgtgcggtgttgtgttatgcccgcatggcatctttccattccttctttctcctttctctccttccgctggaaaaccgcctgaggcaacgtcgccaagggcggttttctggttgtggcgggggtgggggggggctctttttaacaactcccctgccaccagccaagagggaaaatccttttttcgcttcttctttgaaaaaaa

SEQ ID NO: 39 - DNA, 7122 bp, Bifidobacterium longum
ccccgccacgctcgtccaatggcccttgccgtcgccgtccgtcttcctcgcctccacgggcctggcgtcgatcaccggaggggtctcgcgggcgaacgtgaacacgaagcccgacagcctgcgtttcacgtactggcgctcgatcttcaggccaaggagaggcccacactcttcggcgatcgtcttcagcacgaccctgttcaggttggcggtggattttgccgtggaatcggatacgccaagcagtcggcagaactcatcgcggctgatcttccagattcccgagctgcggtactgcttggcgcgcctgtagaactccttggcgtacttgctcttgaggtcggcgaactcggccagctcgaagcgcgtgaactggctggtcaggtcgttgagcaggaaagcgaactcctcgttgaccccaaccgcgagagtcgcctcctgcgggtcggtgacgaacttcgtgaacagcgcgaactggatgatcttgcccgaatcctcgaacatgtagttcagcgccagcaggcgcgcgttcgtctgcacgatcttgtctgccagctgcttgttggtcaggttcttcctcaatcgcatgaggccgcgcagctcctcgaacgagaactccaccgtggccgtgcccttctccctcacccttgaggcgatcgccatgagcacgtccaggtgcacggcgtcgaacttcttcagcacgacgttgttgaactggttgctgaacttcacgatctcattggacatgactccatactagtacaaagtttatttatttactagttcgctccccttttgtactaagttcgctccccttttgtactaagttcgctccccttttgtactaagttcgctccccttttgtactaagtaccgtccgaaacccgttgggagagtagggctgcggagggcctaaaagaatgtaaaaagattttaaaagatttaaaaagggcgcacggcgccttttttcggacgtcagatcaggccatcggagggcgtctgggcggtcctgcgttcggggttgaccggctcgtatgagggcggctggtatccgtccggcccgtggttctcccatgggtcgtcgtcctcgccgtcccttttgcgccattcctcgctcagcgcctcgtagacgaggtcctggaggttccagttcatgccatcgctggtcctgacgttgtgttccagggccttggcgacggtggccctgaggtcctcgcggctcgtgtagttgtccatcacgtcggtggagcacatggcttccaccagggagccgagctgcacgaggcgggcgatgtgttccttggccctctcgtcgcctccctcgaagccggcggccgactcggccatcgcgccgacctcgatcaggcgcttggttcgggccttgcgttcgcgttccctgcgccgcgccttgaggtcgtcctcgcgggccttgagctgggcctgcctctcctgcagggacttgatctgctcatccaggctcttcaccatcgaaacggctccttacatggtctgcatcatccgtatggtgatatgattctaccagcaaggaaatccctaatcaaagattagggcgcacttacatgcaaccggaggttgcattttccgtaagcgcgccctccgggggccacgggccttgccctttggattcccacccttccgggggagcctcccggcaggcccagcgggtgctcgccgcacccctgggaaccccttgccgcagggccgccgccccgcaccccgccgccctggccgatcacgaaaggagccgaagccgatggcgatctaccatctgtccgtctccaacgtgagccgcgcgagcggttccagggccacggccacgctctcgtacatcaccggcaagcgggtgcatgacgagcggcgcggcgagacctacgactacgggcgcaaggagcgcgtgctgcgcgtcggcaccctgctgccggagggcgcgccggccgagttcgccgaccccgccgtgctgttcaacgcggtcgagctgcacgagaccggacggacggcgaggccggccaagaagatcgtggtggccctgccgcgcgagttcacccccaggcagcgcgtgcaggcgctggaggagtacatccgcgagaacctgaacgcggacggctacgcggccacctacgccatccacgaggacagggagggcaacaatccgcacgcgcacatcctcgtcgccaaccggcagatcgacccggccacgggcggctgggccagactcaagcagcgcatggagtacgtgctggacgagcggggagagcgggtgccgctgatcgaccccgagaccggcaggcagaagaccgacaagcggggccgcaggcagtggaagcgcacgagcgtgtccctgaacccgctcgaccggaaggccaagctcaaggccctgcgcgaatcctgggcgaagacctgtaacgcgcggctggacgagaccgcgagaatcgaccacaggagcctcgaggaccagggcagcgacctcgaacccaccatccacgagggctacgcggccagggccatcgaacgggccgggggcgtcagcgagaggtgcgaggccaaccgtgagatcaggcgcagcaacggcctgctgaccgccatccgcaccgaactcggccggatattcgaccgcctgggcgagctgttcgccgccaagatcaggcagctgcgccaacgccaggcgaggccggaaccggacagggagccgaactggcgctacttcgagggcgacgcgcgccgccagctcgaagccgacagggccgaccacacggcagcgatccgtggaaaactcatgggagccaaggccgacgtgaggaaccgcgaggagtggtggaggagccacggcaccgaggagtttgaggccgccaagcagatcatcgacgtggcgcgagccgcctcgcgcgaggccagggacgcgaacgtcttcaagcgcggcaggctgctgcggaacgccgaacaggtggccggggagcagtccgagaagctgcgcggggcggtgccatggctcgaagacaccgacatcccgagcgactgggaccaggccaacaggttccgcatgagggccaccaaggccatccacgaccacgacatgcagccgaggaccggcctcgtggacgaactggagaggcggctcgaacaggccgagcgggccgagggcgagaagccaagccccgaacaggtgaaggccctcgcactgcgcatggccgaacagcgtgaacgggcggcggaggacccgacgcaggaaacgccgccacaggccccgcaggaacccccgaagcccatcaggacgaaaaaggcgctcaccgacaggttcaagacacggcttgacgagcggctggccgaaaacgaacgcaaacaggccgaaaaacaggccgaacccgacatggaggagacatgggacctctccgaccccgccgacccgctcaacatcggcatgggctggggcacgggaggccacggactcggcctgtgagaacgccgggaacgcaaagggccggcatccgaagacaccggcccgaaatttagaaagacatccttaccagcgggtaacggatacgccgtcgacgccagagccgtctgccgtggcgatgcgcatccacggaccagctgcgacaggggtgtatgtaactccattgattgcgaaggtgatctgtcccgacttattgccggtcgtatagctgttgcgatacggccaggaccccgttgccgttccggtgcctgcaaactgcatgtcacccaaagcgttcccgccagcccagcatccagcattggaatcagcgcatccacgcgagacagttaccgaataatcttcagcctcgctcggcggcagcacgtccaccaattcgccgttgctggaatcaaagagaatcgttgtgccaggttcgccgacaatcatgtccccgcccgacggagtggtggtaagttcatagaacgactcgtcagtggtttcttgagcagatgccaccgggactgccgtcgacaggagcgccagcagagtcattggaaccactgccatcttcaaatgcttggtacgtaacatttttgcccccccctgattaggtatgccagacgtgcgtctgacaaggaaattatagctcttggaccttggattgaacagaccagtaatgcaaagggttggtgtttgaagacgccggccccgcatccgaagacgcggggccacggcccaatcaaaggggatggcgggtaacccatcccgccggcatcggccatccccgaaaagtcatgcatgcccgcctgatcgtaagggggaagttagcagcgcctccgccggcgtttccatcttagccgatacgattggcgtcgtcgatggacgtcttgtagcagggacgaaaaccgaccgcccggcatccgccgggcgacgctgccgcgccagtcgcggcgcggcccgaacgaaaggcgcagcacatgcgcatgggtaacaaggggccgcacggccggccctggatatggctgatggcggtcatcgtcatctgcctcgctcccgtgatggatcccatcgcggccgacatcaccgtgacggccctggccgtctgggcgatggcatccagccgccgttgacggcgcaacctgccgcgggtcggagcccgcggcaggccccttgttcagaaaagagtcggctcgataccaggctccatccgatcatcgggcatggcctgtgaatcatggctgcgtctggccacctcgaatggtgtcagaccatcgtgggccgccttatacgcatccagttcagccctggctcgttccgccgcaagttcaccgcgctcgatcttgatttgctgatggcggtcatcgccgtctgtctcgcaccggcggtgcatcccatcgccgcggacatcatcctcacggccctggccgtctgggcgatgagaaacagccgctaaacggcacccggcccgtccgagcgcaagcccggacgggctttcacataccatcacgcagcactcggccagtcggagacatacccctcggcaccggcgaatccatgaccgccgtgcgcgtcgaggaacgcctgagtatcagggtcgagcgccggtccctcgcccggcaccgacagatcgggcacgggcgtcttcgacacgtccctgagcgacttcctcgcctcatcggtcaccacggagccggacagctccacgcgcggagcgggagcgccgccgggtaccttctccgggtcaaattcaaattcgaacccgacaagggaagcgcggccacgtcccggcttcttcttcaggtacttgcgatgcaccttcagattcagcagaggccccaactcctcctcaatcggcttaagaacatacttgttgatttcgctcggccgatacgatttgggtacgtcgagcagtcggcggaagtcctcaaggctgaccttccacacaccggtttgtcggtactgcttgagcctcctgtagcactccttggcgtagctggagcgcagggccgtgaactcggccagctcgaagcgggtgaactgcgaggtgaggtcgttaagcaggaacgagaagcgcgagttcaccgatacggtgagtgtgcgtttggtcgggctggtgacgaagcctgcgaacagggcgaactggatgatgtcgtgctcttcgttctggaactcgaagttgagcgcgagcaggcgacggttcacattggcaatctgcttggcgaactcatcgttggtcatgttcctctgaagtccggccagccgcttcaattcttcgaacgtgaacgccacctcgtccgtgcccttgtcccgcacgcgagacgcgatggccatcagcaaatcaagatcgagcgcggtgaacttgcgcagcgcctgattgttgaactggttcgagtacttcacgatctcatcggacatgactgcattctaccataaaaacgagatttttatattttctaccctttattctcccaaaacctcgtttttattcctcaaaagcgtcctttattctcccaaaacctcccctaaataattcccaaaacctcccctttaatctcccattttctcccctttaatagtgcgtttcccctactgccgtaaggcctgcggggagtctaaaagagtacaaaagattctataaaaaggggctccgccccgatgaagagaagaaaccgactcagttccaaggctgctgctgccattgctgtggctgttggaatccgggctggtagccatagcccggctgctcctgtatctgaggctcttggggcaggtcacgaacctgttcccgcagctcacccgccgactcagcgctggggagcctcacgcccgcgtcagaggcccatgcgcgcagttcggcggcatgggccttgagcatgtccagcagcctttgccggttgccctcgtcgttccagacgccctcgtcgtagccaagcacgccctcgttggagaggatgccgcccagccggatgatcagatgggtgcgccgcttgcgcgccttggcgttctccctagccacgatgcgctgtttgcgcgccctgagctgcttcatccggcgctcgatgtcggccatctgctcctcgacgctcctggtcatcggttcctccctgcgttccgtcggttatcaatcaggacgctagaccccacggcagcacggcacggggcacggcgtctacacaccaaacctaaacccggaagaacggagccggtttggacatccaagccgcgagggcgaagcgttcatcaatgccgaacgtgccgcccccaggaccaaggccgacctgctcagggagatcaggcagcgcgcagacaggcgcacaggccagcaggaggccgaacagcggcagatcgacccatggcaggcgcaaccgccccagaggcgcggacacggccgctagaacagccttccggcgttccgcgcatgatgttcgcggttgcgcgcgtcaaacgcgcagaaacggcattccccggcctccacggtgccgtcgaagtggtcacgcgcggccgtcacggcgaacagctccgtggtcgtgaacacctcgccataccccgccacgctcgtccaatggcccttgccgtcgccgtccgtcttcctcgcctccacgggcctggcgtcgatcaccggaggggtctcgcgggcgaacgtgaacacgaagcccgacagcctgcgtttc

SEQ ID NO: 40 - DNA, 5524 bp, Bifidobacterium longum
gtggtggtggtttgagaactcaagagcgtgtttgtactacttctttatagtcaatgattgccagttcattcctcgcctgattgcctgtcgtggtggttgggtacccgggagggtttgatgaggggtgaggttttttgagggcgtccttccttaaggacgtgctcgtcaatttttgttttgagagtcatctattcggatgcttttcatgaagtttttttgtggagggttcgattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgtagagatacggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttctacggagaattcagtcggatgttcgtccgacggtgtgcgccccgcgcgtcgcatggtgcgatggcggcggggttgctggtgtggaagacgtcgttggctttgccctgccggtcgtgcggtgggtgcggggtggtatggatgcgcttttgggctcccggatcgccaccccaggctttttgcctggcgcgattcgatgcccgtcgtgcctgggggccggccgtgtgccggcgcgatggcgtggcggtgcgtggtggcttgagaactggatagtggacgcgagcaaaacaagagtttttgaatctttgttttgctgttgatttcgaatcgaactctattgttcgtttcgatcgttttgtgatcatttttagtgtgatgatttgtcgtctgggaatttgctagaggaatcttgcggccatgcactttcgtggtgtgtgttgcttgcaagggcgtatggtggatgccttggcagacaggaccgatgaaggacgtttgaggctgcgatatgcctcggggagccgccaacagggctttgatccgaggatttccgaatgggggaacccaccgaccgtcatgggtcggtaccggcttcggccggggggtacgcagggaagtgaaacatctcagtacctgcaggaaaggatattccgtgagtagtggcgagcgaaagcggatgatggccaaaccttgcgcgtgtgatacccgtcgggggttgcgcgcggggtgttgcgggatcgcgtgcgccggctccgacgggccggccggcagttgcagaaaaccatgtgtcaggggaaccgggttgaataccgggccgcagagggtgagggccccgtacctgaacgcgcatggtctgccgatcgcgtctcccaagtagcacgggtcccgtggaaccccgtgcgaatccgcccagaccgttgggtaagcctgaatattcctgtctgaccgatagcgaacgagtaccgtgagggaaaggtgaaaagtaccccgggaggggagtgaaacagtctctgaaaccgtgcgcctacaatccgtcggagcccttttgtggggtgacggcgtgcctatcgaaaaatgagtctgcgagtcagtggcatgtggcgagcataacccgtgtggggtatgcgtagcgaaggcgagtcttaaaaggcgtttgagtcgcgtgtcctggacccgaagcgggatgatctagccctgagcaggttgaagcgcgggtaagaccgcgtggaggaccgaacccacctgggttgaaaaccggggggatgacttggggctaggggtgaaaggccaatcaaattccgtgatagctggttctctccgaaatgcatttgggtgcagcgtcgggtcattacgtcccgggggtagagctactggatgcttgcgggcccgtatcgggtaccaacagcaaccaaactccgaataccggtgacgcgtatcccggcagtgagtcggcgggggataagcttcgtcgtcgaaagggaaacagcccagaccgtcgtctaaggtcccgaagcgtgtgctaagtgggaaaggatgtggagtcgcatagacagccaggaggttggctcagaagcagccacccttgaaagagtgcgtaacagctcactggtctagtggttccgcgccgacaatgtagcggggctcaagcacaccaccgaagacgcggcagtattttgtactgggtaggagagcgtcccatgaggggcgaagcggccgtgtgaacgcgccgtggacttcatgggagtgagaatgcagacatgagtagcgagagacgggtgaagatcccgtccgctggatgaccaagggttccagggccacgttcatcgtccctgggtgagtcgggtcctaaggcgaggccgacaggcgtagtcgaatggatgaacgggtcgatattcccgtaccggctttcagccgccaaaaccgaggcttggagtactaacctccgggtccgggcttactgctccttcgggggcgggatgccctggcctgttgggaccgatccttgtagtaggtcagcgcaggagtgacgcagaagggtagccggccgcggaggtggtcttccgtggtcaagcacgcagggcgtgggacaggcaaatccgtcccgcatgggtccgaggtgcgatgatgggggccttatggcccgatatccggtgatcccggctgccgagaaaagcttcggcgtcaggctcaaagccgcccgtaccccaaaccgacactggtggtcaggtagagaataccaaagcgatcgagcgaatcctggtcaaggaactcggcaaatcactcccgttccttcggtttaagggagacccccgatggtgaacacacttgctgtgggagcttttgggggtggcacagaccagggggtagcgactgtttaccaaaaacacaggtgcatgcgaaggcgcaagccgctgtatatgcactgacgcctgcccggtgccggaaggttaagaggatccgtcagccttcgggtgaagcggtgaattcaagccccggtaaacggcggtggtaactataaccatcctaaggtagcgaaattccttgtcgggtaagttccgacctgcacgaatggcgtaacgacttccccactgtctcgaccaggagctcggcgaaattgcagtacgagtaaagatgctcgttaagcgcagaaggacgaaaagaccccgggacctttactataccttggtattggcattcggtgtggattgtgtagcataggcgggaggccgagaggcgcggtcgccagatcgcgcggagccgtaaggtgaaataccgctctgttcgcattggatgtctaacctcgaacagtcatcctgttcagggacagtgcctggcgggtagtttaactggggcggttgcctcccaaagagtaacggaggcgcccaaaggtccgctcagcccggttggcaatcgggtggcgagtgcaagtgcacaagcgggcttgactgcgaggacgacggtccgagcagggacgaaagtcgggactagtgatccggtgccggtgtacggacgcggcatcgctcaacggataaaaggtaccccggggataacaggctgatcattcccaagagtccatatcgacgggatggtttggcacctcgatgtcggctcgtcgcatcctggggctggagcaggtcccaagggttcggctgttcgccgattaaagcggcacgcgagctgggttcagaacgtcgtgagacagtttggtctctatcctctgcgctcgttggaatgctgaggaggcctgcccatagtacgagaggacctgggtggacgaacctctggtatgccggttgtcacgccagtggcacggccggttggctacgttcggaagggataaccgctgaaagcatctaagcgggaagcctgctccaagataagcattccgtggaaccttcgagttcctgtagtccccatgcagaacacgtggtcgataggccggacgtggaagccccgcgaggggtggagccgaccggtactaacggacgaaaggcaacaccaacattccaacccctggcggttggaccgcatcttcctcctgcaaacgacaccagacggcaatgagcattgtctggccacaagacgaaacatcgacatatccgcgtccgctgtccggttcccaggccgccacaggccggcagaccccagcgtctgaccgtataagagaagatttgcggcggccatggcccaggtgagacgcccggtcccattccgaacccggaagctaaggcctggcacggcgatggtactgcacccgacagggtgtgggagagtagcacgccgccgca

SEQ ID NO: 41 - DNA, 5133 bp, Bifidobacterium longum
accctcccatatggcgatacgccatcgcgggccgttacacggtattgatacattgttcacgattcatacaaaccaccatgtgcaacccacacaacaccgcagagaaagggaacgcaaatgaacctgctcgccaagctgggcatgggcgagaggacccgacgcaatttcgtggccatcctgctcgtggccgccggcggctccatcatctatgggctgccctacttccactacgattactacgaggcctacgcgcaggcctaccacctcaccaacacgcagatcggcgtgttcggcagcatcttcggcgtgttcggcatgatctcctacctgttcggcggctacttggccgaccgggtcagcatccgcctgctgctgtcgctgtcgctgatcggcaccggactcggcggcttcatccatctgctgccgctgaacttccccgagctcgtggccctgtactcgttctggggcttcacctcgctgttcgcgttttggccgtgctgcgtcaaggcggtgcgcgtcctgtccagccccgaggacaagggcaagtccttcggctggttcgagggcgcgcgcggcgtggcctccgcgatcatgaccccgctggccgtcatcgccttccgcttcggcatgaacgcggacggcaagcacgacatcgccggcatgcggcaggtcatcgtcttctactcggtcatcaccgtgttctccggcctgctcgtcctgtggaagatgcgcgacgacggctcgaagatcgacaaaagcgaacaggtcacgttcaaggacatcggcaccgtactgcggatgccggccatctggatcatcggcctggtcacgttctgcaactacgtgttcacgctgtccgtctactacttcacaccctacggcacgtcgctgctgggcatgtccgtgaccgccggcgcggtgctcgccgccgccaagcgctacgtgacgcccgtgtcgaacgtgggcggcggctatctggccgacaaattcggcacgagccgcctgctgctcatctccttcctggtcatggccatcggcaccgcggcgatcctgctcctgccgttgaacgactcctcgacgatcgtgttcgtgatcgtgttcctcatcatctacttcttctacaacgtgaactacccgctgacctgggccatgatggacgagggcgcgatccccgagcgcgtgtcgggcacggccgccggcatcatctccaccatcggctacctgcccgaggtgttcgtctccctgctcgccggcgccctgatcgacgggcatccgggcgtcgccggctaccgcatgttcttcggcttcctcatcgccatgctgctgctgggcgccgtgttcgtcgtcgtgtggcagcggttcctccggaagcacggtctgggcaagggctccgccgcgaagaccgaagcacaggccggagcgcagcccgctgcgaaggatgccgcggcatgatcccctcccgcctgagcgccccgacgcgcccggtccacgacgtgcgctcgtgcatcgtcgaacgcgtgtgggtcgaaacgcccgtggatacggacggcgacggtatggccgacctgatcgccgtgtacatccgccgcccgctggcgtgcgacgacggtctggtggtgccggccatctacgtggccgacccgtacatgctggggtgcgacgacgacggctacgcgccgcatcccaccgacgtcgagctgggcggcgcgcagtccgccggcaccggagcgggtgatacgacggcaccggccggccgaggagccgaagccgactcccccacatggccggaccccgaccctgatccccgcgcgcgattcggcgcggagcagccgagcccggccatggcgcggggccgcttccgcaccccgcgcggcaccggccccgcgcaccgcctcgccccggacgagatgcccgagctggagtgcatcagcgactactacgcgttctacaactcgtgcggctacgccaccgtgttcgccggcggccttggcacgcgcggctcacaggggttcaacgactgcggctcccccgaggagaccgccgcgttcgccgccgtgatcgactggctcaacgggcgcgcccgcgcgtttacgaatcccgccgacggcatcgaggtgcgcgccgactgggccagcggcaaggtcgccatgaccggcaaaagctacctgggcacaatgtgcgtggcgcttgccgccgcgggcgttgacgggctggagacgatcctgccggtcgcagggatcagcgactggtatcggtactaccgctgcaatggactggcgtgccccgcgctcggatggcagggcgacgacatcgacctgctggcggccttctgcttcagccgggaacgcgacggtctcgatgccggcgcccggcggcgctatcaggtccatctcgacgcgatccgcgcccatatggaccgcgagggcggcgcatacaaccggtggtggcatgaacgcaactatctggcccacctgccggaacatccttgccccgcgttcatcatgcaggggctcaacgacatgaacgtcaagccgtcgcaggccgtgcgcctgcgggatgccctgcacgggcgaggcacgcgctcctgcctggtgctgcaccgtggcgaccactgctacacgcatgatctcgaaggcaatccggtgaacgggtacgcgcaccgatggctcgaccattacttggtcgaccgcagcaccgatatcgcggacatcccttcggtgctgatccaggacgacctcgatcccggcgtatggcgtgaggagccatcgttccccgcgccggatgcgcgcccgctgccggagttcgcgcgtgcggaccgcacgcagcgcgatgcatgcggcgtcatcgccgacgacgtggatgccaccgcgttccgccgcgacgccccggaagactcgatcggcccgtggcgcgacgagctgatcctcgccgaccccgagccgcgccactgcctgcgcttcgacaccgccccgctgactgcgaccacgcgattcggcggcacgccggtcgtgcggttcgcggcgagcttcgacgcgccggccgcgatcctgagcgtcatgctggtcgacatcggatcgcaccgccgcctcaccacggctcaggtgagcaccggcagcctggtctgcgggctcgacggcccgaccattcccacgaagcgcttcgcggtggagcgggagacttcggcataccgcatcctctcgcgcggctggatggacgcgcgcaacgccgaggcgccgtgggccagacgccgtctggaaccggacgcgtggcaccgctacgccatcgccatggagccattcgaccagaccgtcacagcgggcgaccgcctgcgactcatcatcttcggcaccgacccggaggccacgacgaagccccgcgggcaacggctgatcacgatcaacacggcatccgtcacgctcgagctcggatgagccgccgacccgggcaagattcggcggtccgggtttcgaccacacccaagcagggatcagaaaggaagtaacgccatgcgactgggacgcataacggcggcgttggccgcagtggccgcggtgctggcgctggcgtccggctgcggcggcgcgcgcaccggcgcgacgggcgccgacgccacgatatcggtctattccaccgagccccgttccgcgctgacgccgggcggggccggcgacgccggcgggttctgcgtgctgtccacgcttctcgccgggctggtcgtctacgacgagcagggcaagcccgtcaacgaggtcgcctcgtccatcacgccgaacgacgattccaccgtgttcacggtcacgctcggccacggctggaccttcaccgatggcacgccggtgacggcgcggtccttcacacgcgcgtggagctatgcggcgaatcccgcgaacgcgcagatcaacgccagctatttcgcgaacatccaaggctacggcgacctgcagcgatccacggacggcacggagcagctgtccgggctcgtcgtcaccggcgacgaatccttcgagatccatctgagcgcgcccgattcgatactgccccagaaactcggcacggtcccgttcctgccgctgcccgactcgttctacgacgatcccgacgcgtatgcgagcaagccggtcggcaacggcgcctaccgcttctcgtcgtggacgcacggccaggatctcacggtgacccgcaacgacggctaccatggcgcgatgcccgcacgcaacggcggcatcgacttccgcttctacacgtccacggacgccgcgttcatggacgtgatcgccggcaatctcgacctgctcgacgaggtgccggcctcgaagtacgcggtgtacgccagcaccgacggcatccgctcctacacggtgccaggcgccgaaacccaagggctgaacatccccgagcggctcgcccatttcggcggcgacgaaggacggctgcgccgccatgcgatctccatggcgatcgaccgcgacctgatctgctccaagatcttccatggcaccagacagccggccgtggatttctccgcaccgacgatcaccggatacagcgaccagctcgccaacgcgcggcacctcgcccataatgccgcgcaggccaaggagctctgggcacaggccgacgcgatctccccgtggagcggcacgctgaggctgtcgtacagcgccgattccaacgatcaggcatgggtcgaggccgtggcgaaccagatcgcgaacacgctgggcatcagcgcccaggccgagccgtggacctcacgcaaggagctgcgcaccgccgccgtcgacgggacgatcgactcgccgtacggcagcgaatggcctccggactatccgcatatcgagaactatctgacgcagcgcttcgcctcgaacggcgggtacaacgaattcggctacgcgagccggcaggtcgacgatctgctggctcgcgccgcagcaagtacggacgaggatcaggccgtcgcacgctatcaggaggcggaggagatcctgctcgacgacctgccgcagattcccctgtggtacgccaatgtggccgcggtgtcgtcgatggcgctgacgcatgcggcgttcacgtacagcaactatccactgtacgcggcgctggagaagtagcgggaaccccacccgcccc

SEQ ID NO: 42 - DNA, 3834 bp, Bifidobacterium longum
atgagtacatacgctggtacaaccacgagcgcatcaaacagtcgcttggttggatgagcccggtacaataccgtcaaagccaaggaatggctgcgtgattatctccaagaaaatgtccgcagccccctacccgcacgttccctgattatctcggctgaatatgtatcacaacagggactcagcgcaattgacgatgaattgctccgactggccgacaggaaagcgctcatcgaagtttatgtccgtttgccggcgactgctgcggtggcaaccagaacacgaatagaacggaatattaatcggctgcgtgctattgggtgcattgtccggaccgtcgaatcgtgttccgattttgccataatcgatgacggattgatttggtttggaggcatccctttacttggcaatccaaggagtgacgactgtgcacttcgattcaaagatacgaaaatcggcgagaatctagcagatggactgaaacgacggtcgtcctgagtcaatattcagttaagataatcgcgcagtacgagggcgtgattgatgtgcgggtccttggcggcatagagcagggtcacgtcgggatgctccgcgcagatgtggcgcagattgtccacggcggcattggcgtcgagctcggcgatgtaacgcatgcggaattccgcgaatttggcggggtcatggccgaaccatttgcgcaggaggggagagggagcgacgtccttcagccacaggtccaacgccgcacgctctttcgtcatgccgcgaggccacaggcgatccaccagcacccgatacccgtccgacgcagtcggctcttcatatatacgtttgattgcaatacccatacaccccatgattggtgtgcgcttgccggaagtcaaggggagacgcgatccatctacccgttcgatttctgggtgttctgtctgaggccttgtgctatgacagctagcgattcagcagcttttggtgatatcgtccaaccggaccgccttgcccctgtcgaaggtgttcatagtgagatcgacgggtttggtcttgatgaacgctgacagcgcggtgtgcggcgggttgtcgatcaagtgggtgatggggggcaatcgccttctcgacgctgacgcccacaatggcgtaaatggcacgcgccagcagcttcatcagtggcgaatcgaaactgttcaatgcctcattgctgcgcacggcccaagggttgaacaacacatagtggatgcggcctccggtctgctgttggttttccgcgaagagcactcccagcagatcgttcagacgactcgtacagatagtcgcgcaatgctagaacgtgattgatgtgcacccttcattgacggtctctcaattgatctcctgcgattcatgccgtataaggaagttctcgaccaaggcgatcatcgtgtccttccccgcaggtgcggacagcgcaatcatcagcgtcatcgccgccaaggcgttaccctccacaagcaggggagtcatcgtcgcccagtatactgttgccgttcaggaaatacacgaacagtgcggcggcacaacgtttattgccgtcggagaacgggtgatccttgacaacttgatacagcaggttcgcggctttctcctgggtggaacggtacagttcttcgcctccgaacgtctggtagagtcctgcgacgattccttggaacgaaccgttgcgttccctcccgaacagatcggattgcgtgtagaacggcatcgaccggatgaacagcatcgcgtcctcataggtcaagacccactgggactcgtcgcccttgggtatagggacattgcctgtgtcatagtcgttaagcagcacaagactcggcaaatatcgttccaagatctctgcggtgccagcaatttccggttcggtggacctcgatagcaccttgacgacggcgtgaagtgcgtcaagccgcttgcgattgatgatataaccatcaacgagatgctgcttcagaactgagttggcccatcgccgggaatagatgccttccttggatttgacgcggtatccgaccgacaggatcatatccaagttgtaatgctcgacttggtatgtcttaccgtcagatgcagttgtcgcaaattctgcgacaactgaaaatccattgagctcttccctcaatgcattgccgatatgcttgccgattgttttgatatcgcggccaaacagcaatgccaattgctgtctgttaagccacaccgtgtcctcgtccaccttcacatcgaggtgcacggtgtggtccgcgctctcgtacaaagcaatctgctgcttcagttcctcgccagtcatgagattacctctctttttcggctgtctgtaaatcatgtcgttggcgtcgccaaattatgcatccagtttatcaggacagtcgaacatttgttcgattactgtatctctcatctttgtatgactttcccgacgacgtattggctatgacggaggtaatgggcacggggataatgctgatgatgggcatttccatcatgcaaaaacctatgccccgtattgaaaaaagctattggaccaagccgttgggcttaggccatgataattgggccattgcgcggcttatccgttcgacggatgttccggatttgcgatggcgttgaattgcaattatcaaatgaaagagcaaattgtatgagcgaaaacaatgatgccaaacacgtgctgttggtgttgatcagtcactccgatttgggaggtgtgagacctactggcttttatgttgatgaggccgcacatccttggcaggtgttcagacgaatgggcttcactgtgggccttgcatccatcgctggtggcgtaccgccgcaggctggccgtcatcccggtgaccctgtgcaagagcaatttctgcatgatgcggatatatcacgccagctagtgaatacgcgcgccttggctcaagtaaacgcgaaccgatatgatgcggtgctattcgttggcggtcacggtgtgatgtgggatttccccaacaattctgtggtgaacgccgtcggccggaacatctgggagcgcggcggcattgtgccatgggcctgcggcattggtggatatgacgttgtcggatggcagttatctgattgccggcaagcaggtcaccggattcaccaacggcgaagagcaaaatctcgggcgttatccgtggctgcggcgggcgaatagaagggagattgagatagaggcaggggagatgccgggtgcatcgccggcatcacgcctccgtgaaatactcgttttcgtccgcaagccggccgcctttgatgaacaggaatcgctcgcacaactcctgcagctggagatgagcatggcgatgctgcggtcggaagcccactgtctgagcacggcgatgagctggagcacgccgtccgggtcgaggtccacgaacggttcgccgagaatcaggaactccggatcattgaccagcgcgatggaccaacgcaagacgctgtttcatgctgaacgagaaaccggcgggcctgcggtcgcggtacggccaaagtcccacaagttcaagcaccgggcggattgggaggcgcgagcggtgggtcggacgattacagtgtgagccgaatacgttcatgaatcatcgaatcacaaggcgaggcggaccgcaagtattcgagagtcgccagttcggtcgatttcaatgacaatggtgtggacgattacgcggatatggggctgcggacattttcttggagataatcacgcagccattccttggctttgacggtattgtaccgggctcatccaaccaagcgactgtttgatgcgctcgtggttgtaccagcgtatgtactcat

SEQ ID NO: 43 - DNA, 2590 bp, Bifidobacterium longum
tgtgttttagcaagttggcgtccgctttgtgagcggtgtttttccgcagtgtaggcagcgggttttccgcagggtgtgcggtatcggccgctgcctgtctgcgttgtgttggttatttggtcatgagggcgtgttcgcttcggtaggagcggccctcgaatctgatgagccgtccgtggtggacggtgcggtcgatgagggcggcggccatgttcttgtcgccgagcacgcgtccccatccgctgaattcgatgttggtggtgtagatgatgctccttgtctcgtaggaatcggaaatgatctggaagaggagcctgctgccctcctcgtctatgggcaggtagccgaactcgtcgatgatgagaagtcgggccttgccgatgctcgcgagttcccggtcgagccggttctcctgctgggcgcggcgcagacgcatgagcagtccggtcgcggtgaagaagcgcaccgggacgccccgctcgcaggcgagccgtccgatcgcgatggccaggtggctcttgccggtgccgacgggcccgtagagcacgaggtcctcgcatccggcgacgaagtcgaggttctcgagctgcgcgcgcccccagtcggcgggcatcttcaggttggtccagtcatagccgtcgagggtcttgtcggcggggaagccggcctgtttgagcaggcgcaggcgtttggatcgctcgcgcgagtcgagttcggccgtgaaccatcgttcgatgaagtcgagctggttgggcgtggcctcggcgagcgtgccggcgagcacgctgcgtgtcagggtcaggctgcggctcatcttcaggatgcgttcgcttttctcggtcgtggacgcgcgcctgcgtcgggtctccgggatcaccggatcgggtctgacgctcaccgttcttcccctccgtcgtccgtgccggtgatgaaccggtcgtagccgctcaggtcgggctcctcgatcccgccggggtattcccactcgccgtcgcgcatgcgcaacgcgatcggggtgagcgagtccgcgtgcaggcccatgtccctgttcgagcgcaggatctcgccgcacgcctgcatcgcgggatcgaacccggccgcccggcacgcgtccccgatcgctttgaggctctccctcaacgtcttttcgtccatggaatcaagccacgcgcgtatatcgtcgggcacgtccgggcggatcgagctttcccgccacgcgcggggtttgaccgcgagccggggaagcacgagcgcgggatcctccacattgcgcgaccgtccgtactgtctgggatactccgcgaagagctcgccggtggcgggcgaggtgagcgtgaccgtgtcccaccggatcgcggccagcaccttggaacgcgccgaatcggggccggcgaggtaccggttcgagtcgatgtcgaccagcccgtacttgtcggccgtccggctttcccagcgaaccgggtcgaacgccgtggacggcaacggcatcaacgcggccctctcctcgtcgaacacctcggccacgggcacgtccagcaacctcgggcaatacgagtccctggcgagcccgtcgcaccgctccagcaggagacggctcaactgcccatacgattccgcgcgcatgggcggcaccatgagattgcgccgcaaaaacccgaccgcgttctccacgctgcccttctcgttgcccgaatacgggttgcagaaccggacctcgagccggtaatgcgccacgaacgcggagaacaccccggtcaacgcgacctcgcccttcgcgttgcgccggccggcaccggtcgcgttgtccatcacgatcacgggaggaacacccccgatatgctcgaacacgagcatcaggccatggcacagacactccgcgttctcgcccggcaacgccacgcacaaccgcatgttcgaatacggcaacgagaccaccaggcaatgcacgtccgccatctcgccagcgatccgggcccgggccacgccgaaatcgacctgcatgctgcccgccgcccactcgagccgcacgtacccctcgcgatccggcacgccgcggttcgcctcgcgccaccggtgcacgtaacgcatcgtggtcgaatactcgccgtcgtaatccgtctccgccagcagacggtcgtgcacgcgcctgatcgtgtgccgctgcttcctgggcagcagacgatcggcctccagccactcgtccaccagatgcgcgtacgggtcgatcttcgacccgtacctgcgatccgccttcggcttgggcgagcaatcctccatatccgcgtacttcgcgaccgtcccgcgatccacgtgaagacgccgcgctatctgcgcgcgcgacattccctgccggtcgagtctcctgatatcttgcacaatgggcatcggtatcgccatgttcctttccttcccgagcgccggccggcggcaaccggccgaatcaaaaccgattggcaactcgggaatatacaggcggcggcaccgatgcctatcacatcaccgggaaacgatgacgacaccggggaaaaccatcagcccacactacggaaaaacactgccgaacctgtcgaacaaacattgaagcaaaaca

SEQ ID NO: 44 - DNA, 2057 bp, Bifidobacterium longum
tcatgaccaaataaccaacacaacgcagacaggcagcggccgataccgcacaccctgcggaaaacccgctgcctacactgcggaaaaacaccgctcacaaagcggacgccaacttgctaaaacacacaccgggaaccgggcctggcgcatgagccttgcccgtttggaggcctccctgttggccagttccgtggcgagcatgcggtcgatggcgtccagttggcggggcgtggcccattcgagcgtttcgtcgatggtggcctgcgagatgaacaggctcctcgcccgctcgcgcagcgggccggggtcggtccgtccgttcttctggttcactcgtcctccttggtgtaggcgatgtcgtattcgctcaggtccacggggtcgtcgtaggccacgggtcccaggcccgaggcgtggcgtgccgcggccagacataccccggcccggtccgtgcctccggtggattcgaggatctcgagcatgccggccacggccgcccgccagccgctctcgccgtcggcgtgcagcagggcacgcaggctgtcgcgccgcgtggcctcgtcctgcgcgtcgatccattcgcgaagcgggtcgggcatcgcgtcgcgcacccggctgttgcgccaggccgccggccggtcgcacaacagcccgagctggctcgacgggtcgccgctgtcggtcggcttgtccccgtaggatctcggatgcgtgatcacgcgtttgccttcggcatcgaggatctccacctccagggccctcaggccgacgatcatctcatggccggcgtgttcgggtccggccgcgtaccggtggcggccctggacggtgatgttgccgtatttgtcggccttcatcctcgtccacgtgaccacgtcgaacggcttggcgggcaggggcagcagcgcctttcggtcctcgtcgaacaggccggtctggctctcgcccttcctgtagtggtccttgtcccccagttcgaggcagcggccgggcaggcgcaggttgaagctgtcgaggttccatacgccgggcaccggcacgaacagcctgcggcgcacggccccgacccgggcctcgacgccgcccttctcgtgtcccgagtacgggttgcagaacgtgtactcgaacccgtagtgcgcctggaacgcctggaacaggcgggtcaggcggatcccgtcgaaccatttgcgtccgacgccggcggcgttgtcatacacgatgcgttcgggcaccccgcccagccattcgaataggttcctgagggcctggcacgtgcactccgcgttctccccgggcatcagctggctcggcccgatgttcgagtacgggaaatccaacacgaaatgccgcattcgcgtcacgacgccccggtagcgcacgtcgacctggccgaagtccgcctggcattcgcccggatgccacgacaggtccaggaaaccggcctcccgctccgccgcggcctcgcgcctgagccgcgccacggtccgggtcaccgtcgacaacgacaccccggccccgtactcgtcgcgcaaccgctcatggatgcgggtcgcggtatgccgctgcttgcgccaggtctcccggtcctcggcgagcatgccctcgatcacgggcagccactcgtcgatcaccgaaccacgacgtcgcctcacgggcggcctggccgataggtcgtcgaccctcagatacttgcgcacggtcggctcgctgaccctctcgctgcgcgctatcgaggcgatggactcaccgttcctgcgacgcgaacggatagactgtatttggggcatgctgatcattgcctttccggacctttcccgaatggaactagaagcaccatcaggctaaggcccacgggtggtcggcatgcctttccgcctaaacccgaaaaatcttcgtgactaaaacctcaacttcctattgaacaaaaacaatcgcgtgggtcctgcgtatgccggccaggccgatcgcgtccgccaggtcatcccgcccgagccatctgaacaacgggcgcaggtccgacgcggcgtgccgcatcgacgactccgaccagcgtgaac

SEQ ID NO: 45 - DNA, 1749 bp, Bifidobacterium longum
cgaggtggtgacgttttcttggactccctgaccgggaggagaaccccctcatggcgaagtacagcagggagcagcgcgacagggccgtggacctgtacatcaaatacgaacgctgcgccgccgacgtgatccgcgagctcggctatcccagcaagggcgtgttgctgtcgtggtacgcggaccggctcgaggaggagcgcaccggcgttccctccgggcgcggggaacgctacaggcggtacacggacgggcagaaacgggccgcggtggaccattacctcgaatacggcagacggctcagccgcaccatgcggatgctcggctatccgaaaagcaaggaactgctcatggcgtggatcgacgagctcgcgcccggccaacgcaagttgaggcacggtccggtccccgaggagctgaaacgcgaggcggtggtcgcggtcgcgtccggacggctgaaatcgcgtgaggcggcagccgaactgggcgtgcaggacgcgactgtgcgagaatggaaacggcagatgctcgcgaaatccgaggaggcgactgtgtccggatccgggaaaagaaggaccgtcgtggaatccaaggagccgtccgtcaagccgaccgtggctccgaacgcgtcggacgcggccggtccggcggatgcgttggcgtcgatggagaggaaagtggcggagctccaggcccgtctggacgagttggacgccgatgtcgaacggcaacgacgggagaagagggaactcgacatcgagatcgcgatccggaagggcgcgttggagctgttgggaaaagagccgggcgcagacccggaaaacctgaccaaccgagagaagacactcctcgtcaagaccgttagcgagacgctgggcgtgacggccaggagcctcttgcccgtggtcggcatcgcgcgcagcacgtaccattaccagctcaagtccatgaaacgtcctgacaaagacgcgccgctgctggagctcgtgcgcgaggcgttcgagaacagcgaacgccgctacgggtacaagcggatccacctggagctgaaaggcatgggcgtcagggtatcggccaaacggatcatgcggctgatgacctcacatggcctggtgcccctgttcaagagcgcgaagcggtacagctcgtacaagggcgagctcaccaaggcgccgaagaacctggtgaaccgcgatttccacgccgagcggccgaacatgctgtgggtcacggacctcacggaattctcgatccccgcggggaaggcctacctgtcgcccgtgatcgactgctacgacggcatgccggtcgcctggacgatcggcacgagcccgaacgccgagctggccaacggcatgctcaccgacgcctgctccacgctcaaggacggagagaagccgatcatccacagtgaccgcggctgccactaccggtggccggaatggatccgcatctgcatggacaacaacctgacgcgttcgatgagcgcgaaaggctgttctccggacaacgcggccgcggaggggttcttcggccgtctcaagcaggagttcttccacaagcgcagcttcgcgggcgtctcgatggacgggttcatcaacatgctcaacgactacatggtctggtaccgggacaggcggatcaagacggagttcggcatgagcatcatggatcgtcgacgcgagctcggtcttgtggcatgattggtggtgatggaatcaacgacgagtccaacaaaacggcaccagcccc

SEQ ID NO: 46 - DNA, 1315 bp, Bifidobacterium longum
ggggctgcggacgttttcttggagaccgaacggaaggattttcgtatgttcagtcttgaggaacgagagcgtgcggtggagttgtatttcaccacgccgatgacgacggcccaggtggtggagcatctgggttatccgaccaggcagtgtctggagcgttggctggcgatggattcccggtatgctggccatatggccaaacccatcatcccactggagaccaggcgaagggcagtcgagctggtgctgggcggcatgcagcagaagcaggccgccaaacagctcggcgtgagcgtcggcgcggtgcatggctgggtcagggcgtaccgcaagggcggcatggccgcgttgcagcccaaaaacaggaactccgcgcagggcaataagcccgcggactcccgccgccggccgtccgcagccgatgatgatgacgcggaggctttgcgccgcagggtcgaggaactggagctggagaacgcgttgatgcgggaggtggtggaggtcgtaaaaaaagaccccggcgccgacctgcggcgcctgtcgaacagggagaagaccctgttgatcgaccggttgaggccggcgtattcgctcagctcgatgacatgcttgctcgccatcgcgcccagcagctaccactaccaccacgcccggctcggcgttgacaagtacgccggactcagggcagaggtggccggggcgttcgccgattccaagggcaggtacgggtaccgcaggatcaaggcggtgctcaagaccggcgtatcggagaaggtggtccgcaggatcatggcggaggaagggctcgtggcgcacgtgcccaagcgacgcaggtatagttcctacgagggcgagacgacgccggctcccgccaatctcgtcgaccgggacttcacggccgagcgtccgaacgagaagtggctgacggacatcaccgagatcaaggccagggacgggaaggtgtacctctcgccgatgatcgactgcttcgatggcaagatcgtcgcatacaccgccggcttcagccccaacgcggagctggccaaccggatgctggagaaagcggcctcgacgctgccggggaacgcgcgtcccctggtgcattccgaccgtggatgccattaccggtggcccggatggctcgggctcatggaacgcttcgggctgacgcgctccatgagcgcgaagggctgttcgccggacaacgcggccgcggagggattcttcggcaggatgaagaccgaggcggtctaccccgagaagtgggaggaacacacccgcaacgaggtgctcgccttggtcgatgagtacatac

SEQ ID NO: 47 - DNA, 1071 bp, Bifidobacterium longum
tattcgcacctgtcggaagaggaacgccaggtcatccagatcgaggtaggcaacggcgccagcatacgcgggatcggcgcgatgctgggccgcagcccgtccagcatcagccgggagatcaagcgcaacacatggttcccgtccaacgagaacgagtcgtaccgcccgtaccggccgaaaagactgaaggcggggccatggaccggccgctactacatcgccgggcccgagcagcgcaaggccgaccgcaggagatccaagccacgaaagccctaccggctgtcgcacgaccgcctgtgggcgcaggtggccgaatggctgggccgcggctggtcgccgctgcccgtcagcggcaggccgcgcgtcctgtggccggacgatgcgctcatgcgcgtgtgcccggagaccatctaccgatgggtctactccagcaggccgcttcgggaacgctgggcgcggtgcctgccgcgagggcacaggcggcgccgcaggcacggcggcaggaggacgtcgcgcttcccgatccccggccgagtgcccatctccgaacgcccgccggaggccgacggcaggagcgcgttcggccattgggaggccgacagcgtcatcggagtgggatgcaacctgcacaccgaggtggagaggaggaccaggttcctcatggcccgcgtcgttccggacaagaccgccggcgagagcgtcggggcgcagctggacatgttctcgccgctgccggccggcgcgcgcgtcagcgtcacgcacgacaacggcaccgagttcgcccaccacgaaaggctgcgcgacgggctgggcatggccacgtacttcgccgacccgtactccagccggcggcggggaagcaacgagaaccgcaacggcatgatccgccggtatctgcccaaacgctgcgagatacggatggacatggcaaaggaggtcagggagatcgtcgacgagatcaacaaccgccccatgcgcgtgctcggctaccgcacgcccgccgaggcgttcgccgacgaactgttagaattacaggaccaacaagggtgttgcacttctaaatagacatcg

SEQ ID NO: 48 - DNA, 1018 bp, Bifidobacterium longum
ggtttaggcagttgcatgcattttccttatttttccggttgcgcggaggtgttcctgccgaacatgagggcctcactgacgcggcggctctggccggtgaactcgaggagccgcccgtggtgcacgatgcggtcgatgatcgctgcggcgagtttgtcgtccgcgaagaccgtgccccatttactgaactcgatgttcgtggtgaatatgatgctccgtctttcgtagctgcccgcgatgatctggtagagcaggcgcgccccgtcgatgtcgaagggtacgtagccgaactcgtccagtatgatcaggtcggcacggccgatgtcccggagcatcgtctcgagcgtgccgtcgcgtttggccttgcccagctggaggacgagctcggcggtctgatggaaccgcacgcccagccccatgtcgatcgccttcatgcccagcccgatcgcgagatgtgtctttccgcgcccggtcttgccgtagaacaccaggtcctgcgcgcgcgggatgaaaccgagccctaggagctcatcgagcatgtagccgtcggggagcctgacgttcgtgaagtcgtagccgtcgagacccttgacgacggggaaccgggcgcggcgcaggagcctgtcgtgcttcgcgcgttccctgttcgccagttccgtgtcgagcaggcggtggacggcgtcgacctggcggggcgtggcccagccggcgaattcgtcgatgctcgccttggagatgaacagcttgcgggccttctcgtagagcccttcgtccgtcttcgtgttcatcgcccgccttcctgcacgccgacgtccgcggtgaacgcgatgtcgtattcactcagatccggcctgtcatcgtcgtattcgatacccgccacgccctcggcgagcctggccgcgagcagtgtgacaccggcgcggtccgccccgccggtcgattcgaggatggaaagcatcgcctcgaccgcgttcgcccacccggattccctgtcaacgcgtttgagggtctgcagcgc

SEQ ID NO: 49 - DNA, 975 bp, Bifidobacterium longum
tgcggtttcgtggccagctccaggcaccggtccggcagcccggcgttaaagttctccaggctccatacgctcggccggggcacgaacagcttgcgccgcaccatgccgaccttggactccaccgcgcccttctcatgaccggaatacgggttgcagaacgaacaatcgaacccgtaatgcgcctggaaggcctggaacaggtgcgtcaggcgcggctcgcgctccccgtaccccttatggcccacgccggcggcgttatcgaacacgatccgctccggcacaccgcccagccactcgaacaggttgcgcaacgccaggcacgtgcactcagcgttctcgcccggcatcaactgcaccagaccgacgttcgaatacgggaaatcaagcacgaaatgatgcatccgctgcaccacgccgcgcaacagcacgtcgacctcgccgaaatcggcctgcgcctcgcctggatgccataccagatccatgaacgcctcatcacgctccgccgcgaactcacgcctgagccgcgccaccgcccgcgtcaccgtggacagggagacctccgcgccatgctcgtccctcaaccgctcccagatcctggtcgcggtatgccgctgcttgcgccagttcgcgcgatcctccgcgagccactgctcgatcacgggcagatacgggtcgatcaccgacgcgcgcggctttctcaccgacggcacggccgacagatcctccttcgcgaggtacttacgcaccgtcggctcgctgacatgtgttttccgcgcgatcgacgcgacggattccccgttccgccgcaaacgacggatagactgtacttggggcatgctgatcataatcctttccggtcctttctggcggagatacaagcaccatccagttaagaccattccgtggtcggcatgctctgcctaaacccgaaaaatcatcgtgactaaacccgcaacaactaattgaacacaaaca

SEQ ID NO: 50 - DNA, 857 bp, Bifidobacterium longum
ggacgcgggtggcgccatgcctgcccatggacgccttgaagcggatgtactcctccaattcgccggcgagcgggccgacgaatccgtgttccgtgggtctcatgacgatccgccttccggcacgggcagcacgcacgcgagcattcccccgcggtgcgtggccatgtagacgcgtgtggaatcggggtcggcgtggccaagcaccgcgctgatcgtcggcaacggcgtggccgcctccagcatcctcgtcgccgcgttgcgccgcaacagcctggaaccgccccggcgtccgagcccggcgtgccgcatgacacggctgatcgcctcgtacaccgatgaatgaccccgaagcgcgacatggggcgccttgtaccgcacgaacacacggtcgtcgtcggtggcgggcctttcgtccaacagccaggacgccagcctcgcggccagcggtcccgtcatcggcacggtcaacggattgcccgtctttcgctgcaccagacctatgctcatggaatcccaatccacgtcggcgatcctcagaccgatcacatcgcatgccctcagcccgcacgtcagcgacagcagggtgatcgccgcgtccctcgacggcaccgaccgcgaggcgcacgcctccagcaagcggcggtgctcgtcgtcgggcaacgttcccgcgatcgcgtgtgtttttagtcaagtcggtgtttcgtgtttcgtcactaatttttttcggtttcgaggtggtgacgttttcttggactccctgaccgggaggagaaccccctcatggcgaagtacagcagggagcagcgcgacagggccgtggacctgtacatcaaatacgaacgctgcgccgccgacgt

SEQ ID NO: 51 - DNA, 849 bp, Bifidobacterium longum
taccgggacaggcggatcaagacggagttcggcatgagcatcatggatcgtcgacgcgagctcggtcttgtggcatgattggtggtgatggaatcaacgacgagtccaacaaaacggcaccagccccttttcggcatgaggagtgccggccggtggtttgttttactggttgtccgtcttgccgaacatgagggcttggctgacgcgtcggctggggccggtgaattcgatgaggcgtccgtggtggacgatgcggtcgatgatcgcggcggcgagtttgtcgtcggcgaagatcgtcccccatttgctgaactcgatgttcgtggtgaagatgatgctgcgacgttcgtagctgccggcgatgatctggtagaggagacgggccccgtcgatgtcgaagggcacgtagccgaactcgtcgaggatgatcaggtcggcacgggcgaggtccctgagcaggctgtcgagggcgccgtcgcgtttggccttgccgagctggagcacgagctccgcggtctgccggaacctcacgctcctgccttgctcgatggcgagcatgcccagggcggtggccaggtgggtctttccgcgtcccgtcttgccgtagaacacgaggtcctgcgccttggccgcgaaatcgaggccggtcagctgctccttggtgtatccgtcgggcaggcgcacgttcgcgaagtcgtagccgtcgaggcttttgggcaccgggtgttttgcttcaatgtttgttcgacaggttcggcagtgtttttccgtagtgtgggctgatggttttccccggtgtcgtcatcgtttcccggtgatgtgataggcatcggtgccgccgcctgtata

SEQ ID NO: 52 - DNA, 779 bp, Bifidobacterium longum
gccaaccggctgaggctggacttcccggataatggggatatgcacgcgagcgtcgagacgatctaccaggccatctacctgcaggccaggggcgaactcaagcaggagctgaaacgcgccatgaggcaggggcgaaccgcccgcagaccccaaggcggccaaggccgcaaaccccgtttccgcgaacccatggccatgatctcggagcgacccccggagatcgaggaccgggcggtcccgggccactgggagggcgatctcatcaccggcagccgcaacaaaagcgccatcggcacgctcgtcgagcgcaccaccaggttcacgatcctgctgcacctgcccgacgggcacgacgccgaacacgtccagcaggccatcatcgacaagatgcagcacctgcccaaactcctgcgcaacagcctgacctgggaccagggagcggaactcgccctgcacaaacggatcggcgcctcgctggacatggccgtctacttctgcgacccgcactccccgtggcagcgcggcaccaacgagaacaccaacgggctcctgcgccagtacttccccaaaggcaccgacctatccgtctacccggaggactacctcgacgcggtcgccgaggaactcaacgaccggccacgcaaaaccctcgggttcatgaaaccaagcgagaagatcatcgaactgctcgacgccgcgtgataacctcaacaaccgacaacgtgaccatggaaggccgctcaaaccccaggtgttgcaaccaccactagaatctgccg

SEQ ID NO: 53 - DNA, 768 bp, Bifidobacterium longum
atcgcgtgggtcctgcgtatgccggccaggccgatcgcgtccgccaggtcatcccgcccgagccatctgaacaacgggcgcaggtccgacgcggcgtgccgcatcgacgactccgaccagcgtgaacgcagcccggccaggaaccccagcacatgcgagccatccgaaccatccaacgacacgaccccatgagattccagccacgtgaggaacaagcccgccatccgacggtaatgccccaccgtcgccgaagccagtcccgaaccggcgagatacgcctcccaacgctccatgaccacggccaaacccggaaccaccggctccgcaagcctgctcctgcgccacttgcccaggtccaccgaaccggaccgcagatacgagtcgcacaaacgcgccagcctgccgtaatcgaaccaccgctgcctgctgaaaccgcccgtccgctcactgaaggtcgacgcggcgaaccccgcgcccaacccacgcgtgtacaccgcatccgggcctccggcgtaccgttccaacgccctgatggacttgcggtactggcctatggtggattccatataaccggccccgtaaagcgcgcggaccacctcgcccgcgacatggccaaccgtcgtctcacccatggcaaactccttcgttcgaatcaaatgggacaagacgaacataacccggaacgttaagccgggaaaccacatgggacacggccagccaccaagaccccgaaccgttccccggcttaacaacaaacccggcttaatc

SEQ ID NO: 54 - DNA, 746 bp, Bifidobacterium longum
aggaatgaactggcaatcattgactataaagaagtagtacaaacacgctcttgagttctcaaaccaccaccactcacccacctcgcagctccccggaggagaaccactcgctgagcggcagcaaggaaataacttacacgcattcacggactcgcgcaaaccgggcgcacgaagataagcccaaatcgttgaaacgacaggcttcgctcggcgtgtcgaaatcgacgtttcgcacgtctatatcttcagtctagaactagatatcgtcgaaaattggattgaaaattttggtcgatgggcgtgtcgcgaattacctcttacggcgcatgtggtgcaccgccaattatcggaatcatcattgatccagtacaccgataagaaccattatgttcggattactatatgctcgccagtcgtgcgccaatcaaccgcctggtagcgatgcagttgtcgtattgcttgccttggcacgaccaacgactgaatggcatcagcacattcagagtcgccgattcaatccatgcgtcgtagcacagatcagtcgtggtctcacgggtatgggggctcgggcgtcgggctcccacggtcgcggacgcgccgcgtcgttcggcctcgccgtcggggctggccgggaatggtcccggacgtgggtctcatgagtgcgagaagccccgggtgtttttgtgggggtgtgtgggtttgggtcgtgagtgtttcgggtatgcgaaagccccttggggcgtgtg

SEQ ID NO: 55 - DNA, 669 bp, Bifidobacterium longum
gcctggccgcgagcagtgtgacaccggcgcggtccgccccgccggtcgattcgaggatggaaagcatcgcctcgaccgcgttcgcccacccggattccctgtcaacgcgtttgagggtctgcagcgcctcgttgcgtgtctgtctgtcctgccgatccagccattcccgcaacgggtccggcaacgcgtcacgtacccggctgttgggccaggacgcgggcttgttgcacagcagcgccaactgcatggacgggtcctcgctgttcgtgctggcctggccgtacgcccgaggatgggtcgccagatgcttgcccgacgagtcgaggacctcgacctcgagcgcgcggaggcccacgatcacccctctgcccgcgttcgcccggtccgcggaataacgatgccgtccctcgagcgtgaccacgccgtaccggtcggccttcatatgccgccacgtgaccacgtcgaaacgcttcccgggcaacggcagcagcgccgcacggtcctcggagaacaggccacgttcctccgtgtccttgcggtaatgcggtttcgtggccagctccaggcaccggtccggcagcccggcgttaaagttctccaggctccatacgctcggccggggcacgaacagcttgcgccgcaccatgccgaccttggactccaccgcgc

SEQ ID NO: 56 - DNA, 654 bp, Bifidobacterium longum
cggttttgccggatgcggccggtaccgggccctcgaatacgagcccgccatgcccccggccttcatgatccggttgacgcggcggcgcgacatgacgatgccctcatgccccggggcgtgcttgatcttcctgcccccatagatcttgccgctgtcgcgccacacgcgtcccacatcctcctcatgggggtcggcccgttcggtctcggggtgtccgagcatccagcagtaggtcgacttggcaacgcccaggatcctgcactgcgccgatatcgggcagcggccggcgtcggaccgtatggcctctgctttcgtgcgaataccggcgccgcttgttctgaaacatccacctccatctccaactggcggttgcgccccctcaacgcgatcagctcgttccgctccggcgtgcggttgtcggccgccctggtcgaaccgctgttgcggacccccgcacccaccggtgcagggtggaacgcgagatgtcgcactccgtcctgatctcgcgcgcgggcttgccgttctcgtacaattgcacgatccggcgtttgaactcctcctcataatgacgtggacgaccaggatcggccatgaccatcaactccttcgttgcccggcccctcaataaaccatccaatacattggagccaatcc

SEQ ID NO: 57 - DNA, 447 bp, Bifidobacterium longum
tgctccaccacctgggccgtcgtcatcggcgtggtgaaatacaactccaccgcacgctctcgttcctcaagactgaacatacgaaaatccttccgttcggtctccaagaaaacgtccgcagcccctaacgcccgaattcttgcgcaaaagcggttcggcccgttgccgggaggacaacttcagtcggttgattgcatgatgccgtcgagccgggacatgtccaggtagcggcgtgcgctccattggttggcggtgacgtagcggatcctggcgcagacgagcatgagcgcgctcctgccgtccgggaagctgccgaccactgtttgtgttcaattagttgttgcgggtttagtcacgatgatttttcgggtttaggcagagcatgccgaccacggaatggtcttaactggatggtgcttgtatctccgccagaaaggaccggaaagg

SEQ ID NO: 58 - DNA, 385 bp, Bifidobacterium longum
cttctgcccattcagccgtaaccagttctaaataacgtcttttaatatcacgtttaaaagaactggttacgataatcttacgtttagccatgtacttcttccgacatagctttaatcgcttcttctaccgtttcgtactcggtgtactcgccattttcaatctcttttaaagattgaagtaacttggctgctgctttaggagttaaagcaggttctcgtgcatagtcaaaagacaaaggaatcgctttagttttaacgatttgattcaagaacagtttgaatgcttgaggcatagtcaaaccatagtcttccaaaataggggtaacttgttcttttaactctgcttctaagcgcatattgaaattgactgcggacatgattccct

SEQ ID NO: 59 - DNA, 344 bp, Bifidobacterium longum
tgcgcttgatctcccggctgatgctggacgggctgcggcccagcatcgcgccgatcccgcgtatgctggcgccgttgcctacctcgatctggatgacctggcgttcctcttccgacaggtgcgaatatacttctcccataggtgcgacatcccttcggactggttttctaggcaatttccaatctaacgggtgttgcactttcatttagacaacggggccaaccggctgaggctggacttcccggataatggggatatgcacgcgagcgtcgagacgatctaccaggccatctacctgcaggccaggggcgaactcaagcaggagctgaaacgcgccatgaggc

SEQ ID NO: 60 - DNA, 270 bp, Bifidobacterium longum
tcgtgcaccacgggcggctcctcgagttcaccggccagagccgccgcgtcagtgaggccctcatgttcggcaggaacacctccgcgcaaccggaaaaataaggaaaatgcatgcaactgcctaaacccgaaaaaaatacatgactaaaccgaggtggtgacgttttcttggactccctgaccgggaggagaaccccctcatggcgaagtacagcagggagcagcgcgacagggccgtggacctgtacatcaaatacgaacgctgcgccgc

SEQ ID NO: 61 - DNA, 257 bp, Bifidobacterium longum
gcgcggtggagtccaaggtcggcatggtgcggcgcaagctgttcgtgccccggccgagcgtatggagcctggagaactttaacgccgggctgccggaccggtgcctggagctggccacgaaaccgcactgccgcaaggacacggaggaacgtggcctgttctccgaggaccgtgcggcgctgctgccgttgcccgggaagcgtttcgacgtggtcacgtggcggcatatgaaggccgaccggtacggcgtggtcacg

SEQ ID NO: 62 - DNA, 255 bp, Bifidobacterium longum
gcctggccgcgagcagtgtgacaccggcgcggtccgccccgccggtcgattcgaggatggaaagcatcgcctcgaccgcgttcgcccacccggattccctgtcaacgcgtttgagggtctgcagcgcctcgttgcgtgtctgtctgtcctgccgatccagccattcccgcaacgggtccggcaacgcgtcacgtacccggctgttgggccaggacgcgggcttgttgcacagcagcgccaactgcatggacgggt

SEQ ID NO: 63 - DNA, 255 bp, Bifidobacterium longum
cgagaaccacgagcggcaacccccgggattcgcgtcgatcctatgggcgatccatcgctccacgacgccccgctccagacgcacggccccgtgttcgaggcaatgccggtcgaacgagcgcaggacctggacgcgggtggcgccatgcctgcccatggacgccttgaagcggatgtactcctccaattcgccggcgagcgggccgacgaatccgtgttccgtgggtctcatgacgatccgccttccggcacgggc

SEQ ID NO: 64 - DNA, 255 bp, Bifidobacterium longum
gcccgtgccggaaggcggatcgtcatgagacccacggaacacggattcgtcggcccgctcgccggcgaattggaggagtacatccgcttcaaggcgtccatgggcaggcatggcgccacccgcgtccgggtcctgcgctcgttcgaccggcattgcctcgaacacggggccgtgcgtctggagcggggcgtcgtggagcgatggatcgcccataggatcgacgcgaatcccgggggttgccgctcgtggttctcg

SEQ ID NO: 65 - DNA, 255 bp, Bifidobacterium longum
gcggtttggggcgtttgggccggtccgcggccttctgctgggcgcggtaaggctcgtaaccgccggactcgggattcctgttgcgctcgacctcgcggctgaccgtgccggggtcgcggcccagcagacgggcgatggcgcggatcgaatcgcccagacgcagacggtccgcgatctggatgcgctcctcctggctcaggtagcgcggatggagggtcttgggtttgtccatggtggaacgataccagtccacca

SEQ ID NO: 66 - DNA, 255 bp, Bifidobacterium longum
gcacgaacacacggtcgtcgtcggtggcgggcctttcgtccaacagccaggacgccagcctcgcggccagcggtcccgtcatcggcacggtcaacggattgcccgtctttcgctgcaccagacctatactcatggaatcccaatccacgtcggcgatcctcagaccgatcacatcgcatgccctcagcccgcacgtcagcgacagcagggtgatcgccgcgtccctcgacggcaccgaccgcgaggcgcacgcct

SEQ ID NO: 67 - DNA, 253 bp, Bifidobacterium longum
acgtcggcggcgcagcgttcgtatttgatgtacaggtccacggccctgtcgcgctgctccctgctgtacttcgccatgagggggttctcctcccggtcagggagtccaagaaaacgtcaccacctcggtttaggcagttgcatgcattttccttatttttccggttgcgcggaggtgttcctgccgaacatgagggcctcactgacgcggcggctctggccggtgaactcgaggagccgcccgtggtgcacga

SEQ ID NO: 68 - DNA, 252 bp, Bifidobacterium longum
gcatatgcacgcccatgaactgccgaccccccacgtaggccgggttggcggcgatgtgcgtgtgcgggggcgtagccatcgaattcgcggccgaggatgttcggggccggatcgtcgttcggttttgtgtgttttagcaagttggcgtccgctttgtgagcggtgtttttccgcagtgtaggcagcgggttttccgcagggtgtgcggtatcggccgctgcctgtctgcgttgtgttggttatttggtcatg

SEQ ID NO: 69 - DNA, 252 bp, Bifidobacterium longum
tatacaggcggcggcaccgatgcctatcacatcaccgggaaacgatgacgacaccggggaaaaccatcagcccacactacggaaaaacactgccgaacctgtcgaacaaacattgaagcaaaacacggttttgccggatgcggccggtaccgggccctcgaatacgagcccgccatgcccccggccttcatgatccggttgacgcggcggcgcgacatgacgatgccctcatgccccggggcgtgcttgatc

SEQ ID NO: 70 - DNA, 251 bp, Bifidobacterium longum
gcctcatggcgcgtttcagctcctgcttgagttcgcccctggcctgcaggtagatggcctggtagatcgtctcgacgctcgcgtgcatatccccattatccgggaagtccagcctcagccggttggctatctgctccgggctccaatgcctgcgcaacccggcggcgatctcgtcccacagtcgcgtgccctcggccgccttgcgcggtttggggcgtttgagccggtccgcggccttctgctgggcgcgg

SEQ ID NO: 71 - DNA, 246 bp, Bifidobacterium longum
atgccctcagcccgcacgtcagcgacagcagggtgatcgccgcgtccctcgacggcaccgaccgcgaggcgcacgcctccagcaagcggcggtgctcgtcgtcgggcaacgttcccgcgatcgcgtgggtcctgcgtatgccggccaggccgatcgcgtccgccaggtcatcccgcccgagccatctgaacaacgggcgcaggtccgacgcggcgtgccgcatcgacgactccgaccagcgtgaac

SEQ ID NO: 72 - DNA, 246 bp, Bifidobacterium longum
gatcaagcacgccccggggcatgagggcatcgtcatgtcgcgccgccgcgtcaaccggatcatgaaggccgggggcatggcgggctcgtattcgagggcccggtaccggccgcatccggcaaaaccgaacgacgatccggccccgaacatcctcggccgcgaattcgatggctacgcccccgcacacgcacatcgccgccaacccggcctacgtggggggtcggcagttcatgggcgtgcatatgc

SEQ ID NO: 73 - DNA, 548238 bp, Bifidobacterium pseudocatenulatum
gggtaattctatgagcgttactatctgtgcaaaatggcggaactgttttgttttgaagatggaactccttcttttcattggggggaagggtgggctttattcgagggttttaacgagggtgccaatgggaaagctccgatacgattctgaaccaagctgtttaggcaatatagggggagggaagaatggttgatggaaaattcaccgcaaaggagcgcgcgtatttggccagccttcccgcagtggaaagcgtgagcgcgtcgcatatccggtatgccgacagtttccgcatcgaagtcatgtgcagatacaatgcgggcgaatcgccggccgccatcttccgcgaggcgggtctcgacccgaaactcatcggatacaaacgcattgagcggtgcattgcacgctggaaaaagcaggaggaacgagaccgccgcaacagcaagcgggtggaccgcgacgacctgcgcgtcattcggcatcatgatcttatgcgcgatgatgcgcaatcgtcggcaacggaatcgcaggatgcgctttcgaagctcgcccaagcgcaactcatcatcaaccaatgcgacgaattgatcgcgaaacaggcgttgcgcatcgacgaactggaacgtgtgctgcgaaagcttgtcgggtgacggcacggttgcgtgagatggaggaaacggcggaatggcatgacggtcgttggccgtcacccgaagaggctccgatgggtggtcgactttcgttggaaagtcactttccgtcgttcgaagaggcgattgacgttgccgacgaaatgcgtcaacgacgtcacgctcgcggcaaaacgctggcgatgcgtgcgattgcggcgctgttgattgtcgctgcgatctgtattggcggttttccggcgatgttgcagtatcggtcggcgcgtgatctgtcgggaacgtcggtaagatccgcgcagacggttgcgggctggccgtatccgcaggcggatgacgcgttcgccgcggcccaggactataacaagcggcttgcggaatccggacagccgattttgggtgaggcgaaggatccgttcgctgatgtgcgtggaggatcgcgtgccagtgtgtccgattctggtgaatcggacaatgaagcgggtgaaagtggaccacagttgtccgattctggtgaatcggacaatcagagtggtgcgggtacaggcgcggacgccggttccgcggacgctggttccgcaagcgccagttcggcggacgcggagtaccggagtctgttggattccggcggtggcgtgatgggtacgattcgcattccgaaaatttccgtgagactgccgatctaccatggcacctccgaatcggcgctcgcttcgggcgcgggccacctgtacggcagcagcctgccagtcggcggcaagagcacgcatgcggtgctcaccgggcatcgcggactggtcgaggcggccatgttcacgcggctcgatgaaatgcgtgtcggcgactacttctacatcgaagtgatgggtcgaacgctcggctatcaggtggaccgtatcacggtgatcgagccgaacgacacgtcgcagctgaaaatcgtgcctgatgaggatcgcgtgaccctgatgacctgcacgccatatggcgtcaacacgcaccgtctgctggtttcggccatacgttccgccattccagatgagattcccgccgaaaacgacgcggtgaaggatgcccgcgcgattggtgcgatcacaggtattgcgactctcgtagtgggcgcgttgttggtttggttgcgacgcaagccgtggcatattcgcaggcatgctgcttggtggccgaagcgcggctgattcggttacatttgcgtgaataatcgcgcttttcgcacgtttttccttttgtgatgtcgggtgattgcgccgtaggaaatgtgttgcagggattttgttgttgcgctgttgccaaaccccgactttcccgcacgtagggtgtgcgcgcgattgtttgatttcctttagttttcagggttgaagcagtgtcggattgctccaggcgagtcagtggcgcgattcgatgagagacgtgaattaaggggatgcatatgagacatgcgcacaacgaggcaaagccgaggggaggctttgttcaacgcatggttgcggcgctcgctgcgattgccatgcttggcggcttgggctacgtcaccacgtcttccgccattgcggaagacgaccagaatccttccggtgacacttccaccttgcagcctgcgaatagtaaaagcattgccaaaatcgaaggtggagacggtgatcagtatgcgttgcatttgactgcgtccggcgatagttcgtcgtccacggttacgaccgcggtgcctgccgatattgtgctggtgcttgacaagtccggcagtatgaaaaacagcaaccgtgacacgaatgcgaaaaacgctgccacggccttggcgagtaagcttctgacggccgcgaatgccgctcttccggctgagcagcaagtacagatggcggtggtgacgttcagcgacagggcgcgaacaacttcgcagttcacgacttcccctggcgctatcggcacggccgtcagtgcgtggccaaatggcggaaccaactgggaagacgccctgaaaacagcgaacgatctgtcgtcgggacgttccggtgtgcagaagcatatcgtcttcctgtctgacggcaatccgaccttcagaatcacatcctattccggatgcttcaagtggagtgggttcggtcagggatgggaaagccatcctgaatacgggacacaggcggagtgcgaggctaacaataagtggttggaccagtcctaccagtggaaaaccgacccggacggctcggacggaaacatccacggcgagggcgatgacgatagctacggctacaactatgcggccgctctgtcggaagccaacgaacgcgggaacgcagccctgtatgtggtgaaggtttcggccgacgccaataagatgagcgacctagccaaagaagcgaacgccgtcaccggcaaggaatacgacggaacgtccgcggaaaatctgacgaaggcattcgaacagatctacaacaccatcaccacaaccgcgaaaatcagagcgtattccatcaccgacaccctgtctcaatgggtcgatccggtcgatttcgccgatgtggcaaacggcaccgatatcacgcgatatgtgacggtaaccaacaatggcacaaccgtaagtggatatacggccgtctacaacgtcgacgacaacggcaatcgcacgattaccgtgacattcaacaatgggaacggcatgatcgtcgacaaaaacgaaaccatcgacgtttccttcaaggtaaaaccaagcgacgccgcatatgcggattacgcaagcaagcagcaatacccggacacgggagaagccaataccggcaatgaatccgcaggaaagcaaggatacttctccaatgccggagcgcatctgaactactgcgtggtcacgtccgttaacgaccaggaatcggaatgcacccaacagacgctcgactatgccaaaccggtcgtgcaagtcagacttggccaaatcaccatcaacaaggtgtggtccgacggtgcgagcaagcatgcgagcgacgcggtgacggtccaattgcagcgcacgaagaccggggaagcggccgcacaggctgaaaaagtaggcgatccaatcacgttgaacgcgtcgaataattggacggccacgatcggcagattgcagcccggatacacctacagcgtggctgaaacgtcggaagacagccgctacgcggtctcctaccagtatggcaatgctgcgagcaacgcgaccggcgtggacctcaccaaagccatggtctggcagagtgacggcaacggcggcaacatgacggccacattgaccaacacgttgaagagcgcgacgctatccaatgtgatcaccgtgcagaaaatcctagaggggcgcgactggaaggcaggcgattcgttcgatttcgaactgaccgcagacggcgacgcgccgctgccggccgattgcgcgcaacaggcgcaacagtcgtgcaaggtgacggtcgcctatgatgctgattccccggatagccagcattccgcaacgttcggtgacatcacctacaacgctggaaaagccgactacacgtacaccattacggaaggcaacggcaatatcgcagccctgcactattcgggcgcgaaataccagattgtggtcgccgttaccgaaacgaacggcgcatggacggcttcggtgaaatccgtgacgaaactgctcgacgacaacggcaagaacgtttccgaatcgcagaaaatcggcgatccgatcgcattcaccaatacgtatgtggcggtgtcggcgttgccgttgacgggcggaaccacggatcgtcaatggctgctggttggcggctcgatcggcggactcgcagtactgctggttggcgcggctggcgtctggaacagcaggaagcgtctcgtctgagacggttcctcgggctggactgccctaccaaccttcgcagggcagtccagccgcacatcacaaatttgtggatccagagcatgttgggcttcagatcccgttagcaaaaacaaacacaacatcaacaacacaatgagaggggattctcatgaagatgaggaaacttttcgccggtatcgccgccgctgcgacgttgctgggcggcatggctctgggcgcggcaagcgcacaggctgacggcagcggcactgtcgtcactagtaaggtgaatttcacattcactgctcaggacgccaagcagctgaccaatcgtaagctggacgcctacaagatcgctgactatgtgcagtacggcactggtagcaatgcaacgtacggtgtgcagactgccggcacggtgacggataactccggcatcaaggctgcgctcgaagctgctgttgcaggcactaataagacggttccgaccgatggcggcgatctgatggcttgggcgctcgccgaaggcgtgctgtctgtggacaattctgcagatggtgcatggaataatagcgcttcccgtaagtttgtggaatcgctgaagaccacgactgacaagcttggtaccgcagaagaggttgatttgggtgctgccgctaatggcacttccgctactgtgacgctccctgcaggcctgtacctgtttgtggacgcggattactcggttggcaccaatggagctgccactccgtctatcgcaatcctcgttggctccggtaacgttaaggatggcgtgctgaatccgctcactgaggcaactgtgaccattaagaaccagaccaccactgtgagcaagacggtgagcgctgcaaccgcttccgccggccagacggtgacttacaccattacgagcaaggtgccgcagaacacgcagtactacagcgattacgcctacacctacacggataccccgagcgctggccagaccgtgaatctcaactcccttaaggtgaaggttgctaacgccgaactgaagaaggatacggattacaccgtgaccgggggcgctaatggccaacctttcactgttgccatccgctccatccagacgcagcgcgcaggcgcagagatcgctgtgacctacaatgccactgttaccagtgaggaagccgccggcagcaaggccgtgactaatacggttgtgctctccgacaatggtgctgaagctactgacagcactaccatcaccaacggtcagttctccttcaccaagaccgacgcccagggcaatgctctggccggtgctaagtttgagatcgaaggacagaacggtgcctcgactccgtccactgctactgcgacttccgagtcaaatggaacggtgactttcaagggtcttgcggacggtacttacaaggtcaccgagaccgaggttcctgcaggcttccagccgaatctcaaagctgcatttacccttaccattacgaacggtaaggccgtcaagtatacaggtgccgatatctggggcttggctccgagcactgaggtctccgataactacacgtacaaggtcaagaacgtgaagaacgtcacccagctgccgcttaccggtgctgcgggcacgaccctcttcaccgtggtggcgctgctcgtggcaggtgccggcgttaccgtcgcactcaagtcgcgccagcgcgtgcgctgatatgcgctcaatcgctgaaacaataagcgaaaaaacgaaataagcgggcattcgcggaaaccatccgtggatgcccgcttatcgtgcctttccatactttttaggggtgaaggttttgcacggggcaatacgggatcgaagcgggtgaaatccggtaccaaacggcgaaatccggcatgaaaaaggtatccgcaggtggcgagtaggtggcaaaacaggcgtcaaccaaagcaatcatacaggggttgcaggtgggggcatctcacgacaatggcaccctacaatcgcaagcacatccatgaaaacagtggaaaggcgggtgtcatggcacgaggtgggggagcgttcagcgacgaggaaatccaactattgcgcggactgccagcggtcgccaacgtaacgcgcaatcgcatcacctacgccgattcgttcaagcaagtgtgcaccatccgctacttgacaggcgaatcgccaaccaaaatcttccgggaagcgggacttccgccggatctcatcggatacaagcgcatcgaacggtgtgtggatcgttggaaaacgtcggccatcaaatccgtgaccggcagcggcaacatgagcgacagcgagatcatcgcgcaactcgtcaaccggtatgagcatgcgttcgtgatgaggcgcaacctcgatagcatcaccaacaggacgatggaacatattcccgtcaaagcgcaaggcgacgacggcatcgacgtgggaaccgcgagcatcatcatcaaacagcaggcgcgccgtatcgacgaactggagcgcgcgaacgccgaactgcgcgggcaaatcgccgccaccgcctgacccagaccatcgttatgccgcgtaagtgtctgattctgcagaatcggacaagtacacaggcaaaaacgggtctcagttgtccgtttctggtgaatcggacaagtaatgcggcgaacgtgcgttgcggatgtccgtttctccagaatcggacaactggagtactgaaagtgtgctgtggatgtccgtttttgcagaatcagacaagcgaggcgcgatttgtgtcggacagttgggcgtatctcacttatatggcagatttgctcatgcgtcatgagccatttcgcttatatatggcagtcagcctgcggaaatacgcccaaaacgtaccccctaagtggtgttttgccgtgagcaagtgccatatataagcgagaaagtagcggtcaacctcgtgaatctgccatatatagacgagatagggcggcagggggtatggcgaggcgaaaatacgggaataaggtggtcggctgggcacggttgaccacaaacgggatgcgccagtgccgcaaaatctgcgtacgtgcccaaaaacaaagcttcggcgggcgcaatgtgcggttcgcggggtagggtagtgaacattatgacttccgagaacaccaattccgcgggctcaagcgccgcgcacatcaaatccgtcgaaagcctcgaccaaagcaacgaaatggagcgaggcctgaaaaaccgccacgtccagttcatcgccatcggcggcaccataggcaccggcctgttcctaggctccggcaagtcgatcgcactgaccggcccgagcatcattttcgtgtacatcggcgttggcctgattatgttcctgctgatgcgtgccatcggcgaaatgatgtacagcgatcctagccagcacacgttcatcaacttcatcacgcgctatctcggccgcgggtggggcaagttcgccggctggacgtattggatcgtgctcattctgaccggcatgaccgaaatcaccgccgtaagcacatatttcgtaacgttcttcggcacattcggcatagacctgaactcgtggaagtggttgatcgaactgtgcttcctcgtcgcgctcaccggcatcaatctgattgcggtgaaagtgttcggcgaggcggaattctggttctccatgatcaagatcacgctgatcgtcggtctgatcgtcaccgccatcgtgatgctgatcatcggcttcagctaccccgccacgcacatcgaaggcgtggacggcacggtgtcgggtgccacggtgagccttacgaatatcaccgacggcttccagctcgcgccgaacggttggatgaacttcttcatgagcttccaaatggtgttcttcgcctaccagctcatcgaattcgtgggtgtcacggtgtcggaaacgcagaatccgcgcgaggtgctgccgaaggccgtgaacgagctgatcatgcgtattctgatcttctacgtgggtgcgctgatcgcgatcatggctattgtgccctggcgtaactttcacgagaattccgatggctcgttcggttcgccgttcatcatggtgttcaaatatgcgggtcttgattgggccgccgccctggtgttcttcgtggtgattacggctgccgcgtcggcgttgaattcgctgatttattcggccggtcgtcacttgtatcagcttgcttcggattccgagtcgcctgcgatggcgcgtttggctgaggtttccgaccacaaggtgcctgcgaaggcgattgtcgcttcgggttgcatgattctgttctccccgatcatcaacgcgattccgggtatttccggcgcgttcgtgctattcgcttcggccgccagcgctgtggtgattttcatttacgtgctgacgatgctcgcccaccacaggtatcgtcagagcagcgattttctaccggacggtttcgtcatgcccgcttggcaggtgtttgattggattgcgatcacgttctttgtgctcgtgtatgtcacgttgttcctgtcgacggacacgattggttctgcgattgccggtctgatttggctggttgcgtttggcggatattgcctgctacacgaacgattccagaatcgcgatcttaaggaagccttgcagcagtaacgtttgcaggtaacgcaggatacaagtaaggggcgtttgccgaacgtgagtgcatcacgtacgttcggcaaacgcccctttcagcatggtctttgcgcgaatccccattacgggatccagtgcaaatcagccgatgtagtcggcctcgttcgtcgggctggacggcacggcatgatcttccgtaaccttgcccaagccagacaaatacgcttcacgacccgcttcgatcgccttcttgaacgcgcgtgccatcagcggaatattgccggcggaagcgatggctgtgtatgccatcaccgcgtccgcgcccatttccatggcttccgcagcctggctcggacggccaataccagcgtcgatgatcaccggaacattggagttcttgatgatcacttcaatgaaatcgcgtgcacgcagacccttattcgagccgatcatcgcgcccagcggcattacgcaagccgcacccgcgtcttcaagacgcttcgccgcaatcggatcggggaacatgtacggcatgaccacgaagccttcttttgccagctgtttcgtggctttgatggtttcctcattgtcgggcagcagatacttcgcctcatgttcgatctccaccttcacgaagtccgtctggcacacttcgcgggcgagacgtgcaatacgcaccgcttcctcggcattgcgtgcgccggacgtgttcggcagcatggtgatgcctttcggaatgtaatcgagcagattgttttcggtggtacggcagcgacgcaacgccatggtgacgatctgcgtgcccgcgttctcaatggtcgccttgatgaggttcagatcgtagcggccggaaccgagaatgaagcggctcgtgaacttgtgtccgccgaggatcaacggatcggcgtcgccggtggcgatttcgtcatacgcgtgcgcatccggttccggcagcagtgcggtgttcgtggtggtgccgaccagctcgtcgagcgtggcgttcggtgccgccgcgaagtctttttccgcggtggtgatcgtgttttcggtgctcatggttaatccttactatgcgattagtgttgtgtcattcgttgcgatttgcgatttgcgattgcgattgcaattgcaatcgcgtttgtgtttgcgtttcgctgtcaggcgtcttcttcgccgagaatcaagcgagtgatcatattggcttcatggcaggcgaccacgcccactcgcggtgccatcagaccagcgcccggcaccggagcggtttcgccgtcgccgcagaagtagaaattcttcgaaacgcgacgagtattcaccaaattggaactgcggaatcccgccattccagaagcgctcaccagcttcttgttcggcagattctcaagcacggcgttcaccagcatcgtcttgttttccggcacgtcgaacgcttcgcaaataatgtcttcattgccgaacagtgtcggcacgttctcgtcggtcactttcacggtatcaatggtgatatcgataaaaggattgatctgacgcaagttactgcgcaatgcttccgtcttgtactgcccaagatccttcaaaaaatactgctgacgattcagattcgtcatatccacgcgatcaaaatcaatcaaatgcaggtgaccgacgccaatgcgggtcaacgccaccgcaatggtcgatccgaggccgccgcagccgcaaatggccacgtgcgccgcgtcgagcttgtcttgcgtggctgcggtatgacggtcgagcagggccgcacggatttcttcgcggctgacgagcgtggtcgggtcgggctggttgtcgaaagcgtgctggcgggcgtcgatctgcgcctgcgatgcggatggttcaaaagtcatggttgttctcgtattctcgttttccgttcgtgcgttgtttttgccgggttggttgtgttttgtatgttcttgcgattgttacgcgtgcattgtgccggtcgtaatcgcaagaaattttgaaagtggttcagccgccctgcacgaacgtgacgatttccaacgtatcggtgcccttgagctgcgtctgcgcacgctgggtgcgaggcacgatctcaccattgagctcgacagccacgcggtcggcgcgcaggcccttgctttcgatcagttcggccacggtgatcggcgtggcgatgttctcttccttaccgttgatgatcattgcggttcccttctgtgtctgtcgtgacacatgcttcctgcactccggatgtccgtttctggtgaatcggacatccggaggttcattgttggtctttaaatgtccgattctgcagaatcggacacgcacggcatctatttcagtccacggatgtccgtttctggtgaatcggacacgtaggcgcttatttgagccgcttgtgcgtccgtttctgcagaatcgggcactcaaggttggtacgaaaaaagggtcgccgaaggaaccgtaccctatgaggtggtgcgcccctccgtgaccctaatcacgcgatattcggttatcgcgaacggaagatgagatacgtcttgcggcgtgaacaacccgtctccttacggcggcattacccgcatcaagtcctcggtcgaagctccgtgagctccctctcagcctttcggctcccgttcggttgtgccttcatcttcgcgcacgcgcccgacaagcttgcgccggttcacgttgggttagtcttgagatgaacgtgtacgaatcggctatgttcttggaaggaaggggaagatgatgatgaacggtgagttggcaggatttacgattcctcggcttggtatgggaacgatggctttggcgattgaggggcgtccggatcgcgataccgcgattcgtacgattcatgccggtttggacgcgggtgtccgctatttggatacggcttggtcatattatttgccgagcaagcccggcaccggcactgcggaagaccttggctacggtgaaaagttggtgcgtgatgcgctcgcttcgtggaatggcccccgagatgcagtgctcgtcgccaccaaaaccggatatcgccgtacttgcgaagcggccgcggccactgacggtacgcatgcggtgggcgctgatgagagccgcccgcaaagccagcgtttgcaggccgaaggcagccgctacggttggattgccgactctcgccccgaaaccatgattcgtgacgccaaggagtccgcgttgcacttgggcgtcgatacgctcgacctgttgtattcgcatggccccgatcccgcggttccttacgaagaccaatgcggcgcgttgaaacagctgctcgacgaaggcgtgatcaaatatgcgggcatctcccgtgtgaataacgagcagatcgatcttgcgcgcggcattatcggcagcggcttggtcgccgtgcaaaaccagttctcgccgtcgcatcccgatccggaacatacgatggagcattgcgccgaattggggctcgctttcgtctgttggtcgccgctcggcggattcctcgatacgttcgatcagagcgcgtacgatccgttccgcacggttgccgcgcaacgtggttgctcctaccagcgtgtggtgctggcgtgggaattgactcgttacgaacgtctgttcaccattcccagcgctcgcaatccgcaggaaatcaacgattccttcgctgcaacgcaacttcagctcactcaagaagagcttgcgatgcttccttgctgattatcgtttccttttttgggcgttttcctgtacttgcacgttgcgatcgaaaaaatgtttacagtaaaagatattatcgagacataactgatgggcatcgaataaggcgaggtgaagcgtgggcttcgagcgggagtcgtttgacaagctgatgaaagtggtctggggtaagaagtctcagatgcagcaggcgatgtcgcgtgattccaagggcgagccattcattattcgcgagcttgagttcaagggcgcgcaaacgccctcgcagttggctaccgcgttgaaggtcacgtcgggcaggatttccacgctgttggctgcgttggaaaaaaagggtctgatcgagcgtgaggtcgatcccaacgaccgacgcattgtgcatgtgaatcttaccgagcaggggcgggcgaaggccaagcagcagcgcgaggatatgcgcgacgccgtctgctgggtcttttcgcagatgggggagcgtcgcacgcgcgaattcgtggatcttaccgaggaatttgccacatacgtgaccatctgcatccctggccagccccgccccaccgccgaagaagtaaagcaagccttcgcaaaagccgaatctgaagatcctgcgtagggactgcccaccacgtaagcgtgcgcctcacatgtgccgttcgcgactgtgagcttggccaaacggccttgagtgtgtcgcgaatggtatatgttggccgcgcgcgaccgagctgagaagaatcgctctcagcaaatacacagaaatatgagattgtcttacactataagtaattaaatatcgtaagacaattcaataggacttatgtaaatcattaatcgcaattcgatcaactcatgtagttgatccaaccaatccatcaatcgcaaaaacttcaaacgcaacacaagagaaggaatccaagcatgttccgcattatgcgatacctctccaaagcggagataggccagatgctcattgcactggtcagcatcgtcgggcagatctggcttgacctgaccctgccggactacatgtccgacatcaccaccctcgtggaaacccccggcagtgaaatgcacgatatttggatcgccggcggcaaaatgctgcttatttcgcttggatcggcagcatgcgccatcatcaccggctatttcgcggcacgcatcggcgcatcgttcagccagcgtctgcgttccatggaattccgcaaggtagaatcgttcggaccggctgaaatgagccgattctccacagcctcgctgattacgcgttccacgaacgatattacgcagattcagatgttcatcaccatgggattgatgatgattgtcaaatcgccgattatggcggtttgggccgtctgcaagattgcgggagacggtctcgaatggacgctcgccaccggcatcgcggtagtggtgctgctggtctccattacgatcctcatggttctcgtcatgccgaagttcaagtccatgcagcgactgaccgataacatcaaccttgtggcgcgcgagaacctcaccggcctgcgcgtggtgcgcgcctacaatgccgaggattaccaggaagccaagttcaccaaggccaacaaggaactcaccgacacccagctgttcaccaaccgtgccatggccttcatgatgccgttgatgaacaccatcatgaacggtcttatgcttgccgtgtactggatcggcgcctacctgatcgacgccgccgacgcggccgacaagctcaccaccttctccaacatggtggtgttctccagctactccgtgcaggtgatcatgagcttcctgctgatgagcatggtgttcgtgctgtggccgcgagcggacgtgtccgcacagcgcgtgctcgaagtgctcgacaccgagccgctgatcaccgacggcacccgcagcgacgccggcgaagcaggcaagcagggcgaaatcgaattccgcaacgtatgcttcacttacccggattcgcgcgaagccatgctcgaaggcatcaacttcactgccaagaagggcgaaaccgtggcgttcatcggttccaccggctccggcaaatcctcgctcatcaacctcgtgccgcgtttctatgatgcgacgcaaggcgaggtgctcgtcgatggcgtgaacgtgcgcgactacacgctcaaggcattacgagacaaaatcggatatgtgccgcaacaatccttcctgttcaaaggaacgatcgcatccaatgtcagctatggcgacaatccgctcgacaccaccgatgccggcatcgtcgacatggccgatacctcgaccgcggccggcagaaagcgcgaaaaagagctgatcgcaacgcaaaacgagcatcgcacactcacttcggaacagcgcgccgacgtgcgcaacgcatgtgaagtcgcacaggcgaccgaattcatcgcaaccaaggaaaagcagtacgattccgcgatttcgcagggtggatcgaacgtgtcgggcgggcagaaacagcgtctgtcgattgcacgtgccgtctatcgtcatccggaaatcctgattttcgacgattccttttccgcacttgatttcaaaaccgaccgggccgtacgcgacgcgctcgccaaggaagcgaaagattctaccaaactgattgtcgcgcagcgcatcggcaccattatggacgccgaccgcatcgtggtgctcgacgacggcaaggtggtcggccaaggcacgcatagcgaactgctggaaaactgcgatgtgtaccgtcagattgcgcagtctcagctgagcgaagacgaattgaacggcggcaagtcgggcgaaagcaagctgccgggcgaaaccggcaaaccgattgaaaccggcaagccgtccgtcgaaagcgaattgaacgaaagcgagggtcgctgatatgccaggaggacctatgggacgcggccgcggagccgttgaaaaaccgcaggatttcggtggtgtgatgaagaaactggtgcatttctgccgccactacattcccgccatcattgtggcgctcgtattgggcgcgatcggcacggtatgccagatcgtcggtccggacaagctcaaggacatgaccaacgagatcgccaaaggcctgcctgcgctagtcaatggcaagccggtgctcggtgcgatcgacatggacgcggtcacgcacatcgcatggctgctggtggcgctgtatgtggggtacgcggtgctgtgctacgtgcaaagctggatgatggcgaacgtcacgcagcgcaccgcacaggagctgcgcgaagccatcagcgtgaagatcaacaagctgccgctcaagtatttcgacaaggtcagctacggcgatgtgctcagccgcatcaccaacgatgtggacgccatcggccagacgctcggccagtcggtcggctcgctgatcacgtcggtcacgctgttcgtgggcgcgctcatcatgatgttctacaacaatgtgattatgacggtgtgcgccatcgcttccagcctggttggcctgctcatcatgggcgcaatcatgaaggtttcgcagaagtacttctcccgtcagcagatcgcattgggcgatgtcaacggtcacgtcgaagagatgtacgccggccacaccgtggtcaaggcgtattgcggcgaggctgattcgattcgcgcgttcgaaaagtacaacggcgatttgtacgattcgggatggaagagccagttcctttccggcctgatgatgccgttgatgaatttcgtcggcaatttcggctacgtggttgtgtgcgtggttggcgctgtgcttgcgatggatggcaagatcgagtttggtgtgatcgttgcgttcatgatgtacattcgactgttcacccagccgctttcccagttcgcgcaggcattccagaacctgcagcgttgcgcggccgcttccgagcgcgtgttcagcttccttgaagagccggagatggccgacgaatccgacaagcaggcgctgctcggcgtgaacggcaaaccggtgcgcggtgacgttgagttcagtcatgtgaagttcggttacgatccgagcaagacgattatcaacgatttctccgcttcggtgaagtccggtcagaaggttgcgattgttggtccgaccggtgccggcaagaccacgatggtgaatctgctgatgcgtttctatgagatttcgggcggttcgattgcgattgatggtgtggatacgaagtccgtgccacgctggaacgtgcatgaccagttctccatggtattgcaggatacgtgggtgttccgtggaacagtgcgtgaaaacatcgcgtattcgaagccggacgtcaccgacaagcagatcgaggacgcatgcaaggccgtggggctgcaccactacatcatgtcgctgccgaatggctatgacacagtgcttgacgacaaggccacgctttcgcagggtcagaagcagttgctcaccattgcgcgagccatggttgaggatgcgccgattctgattctcgacgaggccacctcttcggtcgatacgcgtacggaagagctgattcagaaggccatggacgcgctgaccgtggaccgtacgtcgttcgtgatcgcgcaccgtctgtccaccatccgcgatgcggacatgattttggtcatgaaccatggcgacatcgtggaaagcggtacgcatgaggagctgctcgccaaaggcggtttctacgccgacatctacaacagccagttcgccctcaccgactgattcgccgttctggctggctgattcacaggagccgcacgtccccaaagacgtgcggtctttgtttatttcggctggtattcggctgttatgcggatcgcaggaagagttcggccgggaagttgcggctgactgcgatttggcgggattcgtccaatgttgcgtatgtgaaatcgaacgtgcgttgcagttgtgctacgtcggaaacgaacagggccgtggccaggccgtccgcaacggcggtggggtagtcgcgtgcaagattgagcgttgcgtttgctggaacgtatgcccagctggcttcggtttgttgcgcgggcagtccgtcgatggcattgagcagatgatgaatggcgatttgggtgcgctcgttgactgccacgttccaatggcgtcggctgggtgcgcttgcgcacaacgctccgttcgcaatatgtgcgattccgattgcgtgggactgatcttccggatcctcaagtgcgacggaaataggctgttccgtatgaatcagcaaatcacctcccgcatcaatcacgaattgtgacgactgcagcatgcgcccgagcagatcgacgagatagcctttgccgcaggcgccgaaatccaactgcaccggctcatacgttaccaatgtggttccgtggcgggtcacatcgcgtccccaaacggcgcgtccgcgcaatgcgcccaaatgttcgggcgcatcttgcgtaaccgtgaaactcagcgacgcatcgtatccaagtcggatcaaatcctcgccgacgcacggatcaatcgcgccggaagtggcggaaaatagcgcatcatacagatcgaacagcggcgcgcaccaatccggaaaatcgaaacttccgccatgctcggccttgccgatcgccgcaatcagcgaatcattgcggaatcgagacagcacgtgttcgtaatcctcaatgagcgattccattgcgggacgcaccttgtcgtcgatcggcgaatccgcggaaatcaccataccggtgccgagcgccctataaaacgccatgacaaacggcaagcgttgcgtcaaagaatccatgcctccgatgctacacgcccatttcctccagatactgggggaaatgggactttcgcgatggggcgcatggtacagttgccggcagggcgtcaacatggaggttgatatggggaacgtcgagaatgcaagtgcagccacgcgcacaacaaaaacggtgaagagcctgccgatgcccaaagtctgggctttcgccgtcggccaattcggctgggcgctactttccggcattatttcgaattggctcgtctacttctaccagcctgacaacgaaaccatctcgcaagggcaaaccgtgttcgtaccgcaaggtcttgccgtactcggcgtggtgaccgtagtcggcggcatcaccgcgttcgcccgcttcttcgacgcattcgtggatccggccgtggcaagtctttccgaccgttgcacatcaaaatccggtcgtcgcatgccgttcctcaaatttgcggcccttccgctcgccctcgtcaccgtgctggtgttttggagtccaatcaacgatacgagctggatcaacggcgcgttcctgttcgtcacggtgatcggctactacattgcgctcacgttctactgcacgccctacaacgcgctgatcgccgagcttggtcacgattccaaacagcagctcaccatctccaccgccatttcgttcacgtgggtggccggcaccgccattgcatacgtggcaccggtgatttgggctggtttcgtgccgggcttggggcgtgtgaacgccattcgtttgacgttcaccatcatggcggccatcgcattcgtgtgcatgctggttccgccgctcaccatcaaggaacgcgattacgtcaactcgcagcccacgtccgaatcgaccatcgaatcgttgaagcagacgttcggcgacggcgaattccgcaagttcgtctgctccgacgtggtctattgggttgcgatcactacattccagactggtttgccgttcttcgtgacgagcctgctcaaacttcccgagaccacgaccaccatctatttcgtgctcatgaccgcagtgtcggtgctgttctacatgccggtgaatgtattggcgaatcgtgttggcaagaagcggattctgctggtcgctttcgttattttcacatgtgcgttcgcgtttgcgggcgcgcttggctccggtctgctcgctgcgattccgccgatggcgcagggcttgattctctcgattgtcggcgcgattccgatggccgcgttcggcattcttccgcaggcgattgttgcgaatattgccgacgcgagctcgaaaacgaccggtcaggatcgtcagggcatgttctatgcggctcgcacgtttgcgatgaagatgggtcagtcggtggcgatgctgctgtttaccggcgtgagcacgattggcatggcgtcgggcgccggctatcgcattgcggctgtttgcgccgcggtattgtgcggcatcggcggtgtggtgttcgcgttctacaacgaacgcaaggtgcttgacgtgctcgaatcctgattccgtccatgcgcccgctggcctcacgattttgtttttcgttgctttttcggaatcgtgaggtcaccagggcggaatcgtgaggtcagaaagtccagctccatcccaaatcccccaattcccgaatcttccaatcgcacgaatatgcatggagaggaacggcgaaagcgcctcaaaaaatcactatgtgagacgactcgcgcggattacagaaaagaagaatggcggaattccgccattttaaaggtttctacaacaaaactgccaaaaaatcaagactgttctttcgatttttttcgttttatcttgtgaagtcggtgcgcactgtgcgtatggcaaaggtggcgcactcgtgaatcggattgtgaatggctgagagaggaagcggtcttatgtcatcctgcgatacgcagcgggctacaagtgtgtccggtcgccttgtcgcgttcattgcggcattgatgatcgcgttgaccacgctttttgcgactaccgcagttccgcagccggcaattgccgccgatgacggtcaaacgaattttgattcctggactgccgctgcgaagaacatcgaagaccagcttgcgactgccgaaaaagactacaatgacggcaattacggtcaggctggcaccgatttccagaccgcgcattggatcggttacgacgcatccaacttctcgaaagtcgtcaacgacaccatcagtgccgacaagcagaaggaactgctgcagcaattcaccgatcttgaaggtcttgcctaccagcaggaccaaggcgacgccatcgcagccaaaatcgacgcgctgaccgccgaaatcaacgcaaccgcgcaaacgcttgacgcgaacgccgacctcgccaatcctaaggaatatgcgaagcagcgtgccgcgcaaaccgcggaagagcgcaagaagctcgacgcggccaagaagaattcatccaaaggcaaaggcgaccgcacgtggagtgaggttgccagcgaaatgaccgtcattctcgaccaggcatacgaggctgccgctgccggcaagggcgacgaaggtgccacgctggtcaacaacgcctactaccagtactacgagaagctcggcttcgaaaagaacgtgatgaacgtgatttccggcgatcgtgtttcgcaggtcgaataccagttcaagatgactcgtaagatcatgcgcgacggcggttccgacaaggaaatcaagcagcatgtcgacgatttgaaaagctggcttgtgaaagacgcggccaccctggacggtggcgcgtccggcaatgtcaacggcttcaccaagctcgtcaccagctccgccggccaggcgttcctcattctgatccgtgagggcctcgaagcgctgctggtggtggccgcagtgatcgcctatctggtgaagtccggcaacaagcgtttcactaggtggatctaccttggcgtggtcgcaggtctggccggttccggtttggtcgccgtactctttacgttcctgttcggcggttccggcccggttcaggagatttccgaaggcgtgtgcgcgctgatcgccactctcatgctgctgtggaccagtaactggatgctcaacaagagctccgtggaagcgtggaacaactacatcaggaacaagaccgaagcggctgtggccggcgcgcaaagcaaggtcgaatccggtcagagactgggcttgggcatgatcacctcgcttgccatgctgagcttcctcgccgtgttccgtgagggcgccgaaacggtgatcttctacgagtccatctactccatgagccaggatgcgcacggcatgtgggttggcggtctggccgccgccgcggtgctgatcgttatcttcctgattctgcgattcacttcggtgaagattccgatcggcccgttcttcctcgtcacttcgattgtgatggccgtgctggttgtcattttcgcgggtggcggcatccatgcgctcatcgagggtgatcttattgaaggcacctacttgagcagcgtgccaactaacgattggatcggcttgtatccgtacgtcgaaacgatcacggcgcaggtgattgccgcgatcgcggtggttgtgctgttcgtggtcggtttcatcaagaaacacaggatgaagttggccgcgcaggcggaacaggctaagtaagcgccaatcaataatcacaagtaaagatttagagatttccataagtttccaacgttcctcaaggaaccaaagaaaaggaagagaacacaatgaagaataagaagatcgccgccctgctcggcatcctgttggcaggctctatggccttctccctgtccgcatgcggcaattccaacgattccgcatccgatgccaagtccgacacctccacttcggacaccaccgacaaatccagcgattccagcgctgatgacagcaacggcgccggcttcgaagagattcaggtcgacgagaagcactccgatcaggatgttgacgctctgaccgtcaacgccgtgtacttccagccgatcgatatggaaccgtccggtatgggcctgaaggctgccgacgcttccttccacctggaagccgacatccatgccaacgagaagggcaccgagctcggctatggcaagggcgacttcgtgccggacctcaccgtgaactacgagatcatcaacaacgcgaacaacgagaccgttggttccggtaccttcatgcagatgaacgcttccgacggcccgcactacggcgccaacgtcaagctcgacgaggctggctcctacaagctcgtgctgaagatcgaatctccggagaagaagggttggatgctgcatgttgatccggaaaccggcgttaagggccgcttctggaccgagccgctcgaggtcactttcccggagtggaactacaccccgcaggagtggtgatctgaaacgtgagttccggcacatgccaagcgaaatggtttggatgtaagcctgaattcatgttgagattcaactcgtggttaacgccgttcacgtatcgcgaaacgtatgcaagtagcgcgaatatgggtacggcgttcgcggttgcctggatagtcgttcgacgcactcaaggccggttggccgagcctacggtcgaacaaccatccaagcaaccgctctcttgcgtttgaggggatacgcttttgggagataacgcgcttttgggggaatcttggtaagggggttccttttgtgtgccgaattcactaggctttgacagggatatataacgaaaggtgtgagatgctgacgcagtacgtcacggtgttgcagggaacgctggcaccggctttgctgattatggcgctgaacgtgatgctcacggtcggtgaggggcgtgacaagccgttgagcgcgtactggcgtcttgcgggcttcattattggattcgcgggtgccattgtgttcgccgcgttgcgtgcatccgcgatgatcaatcagcgtacgttcgtcaattaccccacgttgtggtgttgtgtgattttcgatatcgcagtgttcgttgttgtgctgttcgcacgtcgcatcactacgaattggcatgatcatcgcgcgttgctcgatattgcgaatgcgattggcgctcttgcgattgccgccaccaccttccgtgcgttgcctgatgttattttgcgtttgacgattttcgtggagccaggagatccgatcttcacttcggatatgctgcttcgtgcgcttggtttcgtattgggtgcggccactgcgattgttgcagcgttgattttccgtacgatgcgttccactgcgattcgttggtcgttcaccacggccgtgctgctgctgattgtgctgctgtttgtctcgcatttcactgatcttgcgcagattctgcagtccaagcgcatcgttcatttccctacggaagcgttcctggcgttggtgtggtgcatcaatcatcagcgtcatatggtcattgccatggtgttggtgttcatcattccggtggtcgccagcattgtgatgggcttcaaaatcaagccggaaggcgcaaacgaggccattgtgcgatcgcatatcgcgttccgtcgccgtgcgaaggcggccggcgcatggagtcttgttgcgatgatcggcatcacgttcgcgctcacgtatggtgtggcgcaaacgaagaaggtcattacgctgtctccgcctgaggattattcgctgagcgacggcgtggccaccatcaaattcagtcagatcaacgacggtcacctgcatcgcttccaatacaaggcgaaagatggcacggtaatgcgtttcatcatcattaaaaagaatggtggagcgtacggtgtcggtcttgacgcatgcgataactgcggtgacgcgggctattacgagaaggatggcaagatcatctgcaagaagtgcgatgtcgccatcaacctcgccactatcggattcaagggcggctgcaatcctgtgccgttcgattatcaggttgaatccggcaaaatcgtaattcaaacttcgacgctcgacgcattgtcgacgcatttccagtgagcggaaagaggtagtcatgttcttttttcgaatgattttccgctcgttcagcaggcagttcaaacgcagactgctgatcgcggtcaccgtgtgcctgtcggccacggtcagcgtggccatgctgggtgtggtgttcgacgttggagacaagctgaacgcggaactgtcgacgtacggttccaacatcaccgtgcagcccaaggccgatgccgtcgtcaacgacctgtacaacacggggggtgacgcgaatagcaacgcttccggcacttccgaatccgatccgaccacatttctgaaggaatcggatgcaccgaagatcaaaaccatcttctgggcgttcaacatcacgaattttgcccccgaacttaatatccatgctgacgtgaactgcgcgtccgaatcggtggattccagctcctgcaaggcttccggcgtgccgatcgtgggcacatggttcgccaagaccctgcatatggattccggtgaatccacggtggcgggcatgaacggcatgcgttcgtggtggaagcttgacggctcctggccgaaagacgatagcgcgcaaggcctgatcggcaccacgctcgcatccaaactcggcgtgaccaagggagataccgtaaccctctacaaaaccaccgccgacggcagccgcaacaagcagcggatcaccatcaccggcatttacgattccggcgatagcgacaacaatgcgatgtacattccgtcatccaccgcgcaggtgcttgcgaatctgcctgattccatcgacaagatcgaagtcaaggctctgaccacgccagacaatgatttggcgcgtaaggcgtcgaagaatccgaatgcgctcacgcaagatgagtgggaaacatggtattgcaccgcgtacccttcgtccatcgcctatcagatcgaagaggtcattcccggttccgtagccaagcaggtgcgtcaggtggccgcattacagggcgatgtgctgcagaaaacgcaggcggtgatggtgctgatgaccgtgctttcgctggttgcggccgctatcgcggtggcgaatctgatggccgcctcgattggtgagcgcggttcagaattggcgttgctgaaggcgattggtgccaccgatggtgcggtttctcgcctgatgctcgctgagacggctgtgatttcgttggttggtgcgattgtcggtgcgctgttgggttccggtgttgcgcagattgtgggacatgtggtattcggttccggcattacgatgcgtccgatggtgtttgtgctggtgtttgtgctgctgacgcttaccgtgctgatcgcctcgttctcgtcgatccgttcgattctgggactcaaacctgcggaggtgttgcatggccgctgatgtcaacttgggttccgtaaactcggccgcggctgcggcctcggtcacgaacggcacactgtgctgttcgtctgcggaggtgttgcatggtaggtgagttcaagacagtccgtaaggggcatgagatgactaatcgcaagatgttcttcaccatgctgtggggcgcggtgttccgccgtcgttcgcgggccgttatggccgtgatcgcctccatggtgggcgctgccacgctgttctgccttgcggcgacgtgtattgccgttccacagcagatgaacgaggaaatgcgtgcgtatggtgcgaatcttatcgtcacgccgtccgaatcagccgaaaagtcccacggcatcgacaccgataccgtcaaagcgttgaaccagatggtgaaaggctcgtacagcgcccgttccgccgcttaccggtatgaaagcgtgcgcatcaattctgcgccatacacgctggctggcatcacaaccaaagacgtgaaggcgctcaaccatcattggaacgtgactggcgattggcccagcaaaggcaacgtgatgctcggccgtgacgtggcagacgcgctcggtgtctccatcggttcgaccgtaaccatcggctaccgcgcatccgacgatgcgcaggattccggcgctcttagccaaaccgaagcgcaagtcaaagaaaacggccgcgtttcgtccgacattatggaaaacaccggcactgaattccgtgtcggaggcatcgtcgatacgggcggcagcgaagacgaaatcgtctacgcggtcaacgctgacgtggccaaactggccggtttcaaacgcggagcggacgtgatcgaatattccgtcaatgcggtaggcagcgaactcaacgatgtcgtcaaatcgatcaatgcgaatccgtcaaccggcgtgaaagcgcagaccgtcaccaaaatcacctcatccgacactcgtatcatcgccatgctgcaaaccctgttctggatcgtgtcgctggtcgtgctcgtgctgacgtttgtgggcgtgggcaccaccatcagttccatcgtgtctcagcgacgcaacgaaatcggcttgcgcaaggcgttaggcgcatcctcgcgcgccatcggcatcgaattctatgtggaatccgccatctacggactgattggcggcctgatcggcactgccatcggctacctgctggcccgcgtgctgtgcgtatccgtattcgaacgtgccattggcttcaactggctgttgggcgtcgcttcgctgctgttgagcgtgctcatcgccgtcatcgcatccatcccgccggttcgccgcgcaacccgtatcgaccccgccatcgttttgagggaggaataatcatgagttccgaacatacgttgaatacgttgcttgaattggatcatatttccaagatttacggcgatttgcgtgccgtcgacgatttgactttgaccgttccgcaaggtgaatggcttgcgattgtcggttcgtcgggttccggcaaaaccacgctgatgaacatgattggctgcatggacacgccttcaaagggttccgtcatgctggaaggccgcaagttggaggatttgaacgccaagcagcttgccgacgtgcgtaagaacatgatcggattggtgttccagaagttctatctggtaccgcatctgacggctgtggaaaacgtgatggtggcacagtactaccattccgtagtcaacgagcagcaggcgttggaagcattggagcgcgtcggtctgaaggagcgtgcccaccatctgcccggacagctttccggcggcgaacagcagcgtgtgtgcatcgcacgtgcgctcatcaactgtccgaaactgattcttgcggacgaaccgaccggcaatttggatgagaagaacgagaaaatcgtgcttgacctgttccgtcagctgcacgagcagggcactaccatcatcgttgtgacccatgatgcgctcgtcgcgtcttgtgcccagcgcgagatcatgctcaaccatggcgtgctcgtcggtgagaagtggaatgatgaggccgcacggaaggtctatgagcaggcgggtggcaagccggcatacaccggttccactacggaaggcgcacagaatggcgagacggccatcagcttcgccgatccgaccaaagccgcgaaaaccggcggtgaggaataagctgaaatcagccgaataatccaagccatagcactgacgaatcgtacggagcgaacatgagcaacgaatcatcgaatgcgatcaaagtgatcgcactgtctgcggcaagccttgcgctgctgtcggcatgcggcgaacccacggcgacaccgatggacgatgaatatgccggaaattccggcgaaagcgtgcaatcgcaggaagaaaattcgaagaacagcggtagcgccaccgactccggcgattctgcggattcggacgacaaaaaccatgccgacgatccgaacagcaccacatccgacaagcaagacaccggcaactacgccgacggtacctactcgatcaacggccagtacgggccggtgggcgaagacaccatcgacgtgcatgtgacggtcaaagatcagaccgtcaccaatgtggaggttatcgggcatccgttcacgtccatctccaaaaagcaccagaatgcgttcgccgaagccatcaacggcgtggtggacggcaagccgctcaaagatctcaaggtagacaaggtggccggtgccagctggacgtcggaagcgttcaacaaggcgttggacgtggcccgtcaggaagcgtcgatccagtaggcccagtagcggcgaaaagtctgcaaacgtacaatgagcgcctcagctacagcctcactcaaagagtgattaaaggccgtagcggggacgctcacgagtttcagatactactacgtgcaactctgctctgcaatgcctttcaggcggccataacgggccacagaacagccgtcatgttctcaggccaaggaatactcgcgtcgccatgcaacgccttacaggcgagcatggagccgagtatcgtgctgaacaggaattgcggatccaatccatggcggaacacaccggccttcatgccgcgctcaacaaactcagaaaaacgcttttccgcaggaacaagcacttgatcggcaatcgcattcaacgaaggattatcggaagaaagcaccacaccgacggctttcaaaccaagctcactgtcgaaaaaacagccctgaatgcgttgcagtatcgtcagcagaccgtttttcgacaactcgacatcgctgaaatccggcaatcccgcaacttccaactgaacgcggcgcaacagatcgtccgcattcttatagcgacggtaaatcgtggttttcgcaacaccggaacgacgggcgacctcttcaatggtcaccgcaccgacaccatcggaaatcacaatcgcaagcgtggccttcatgatcttatgatcggtttgctcgcgaagctgctcgcggcggctctgcgccttgcgaacggcctcatgcacgtcactgaccgcgtcggaaaccacatcggaaacggcttcggaaaccgcctcatgcactccggtaatcatgcgaccaccttggtgctttccaccttcgccacgtaccacctattgaacttgaccagcggaatacgcagcagcaagccaatcagcagcagcggaatcaggaacagcaacagcgaaccgatcgcatgccaataatcattgttgtaaataccggcaatggccgcacgcaatgccgtaatcgcatgcgtggccggcaggaacgggctgatatcgccgatgatcttcggcagcacggcaagcggatacgcgccgttcgcgccggaaatctgcaacaccagcgtcagcacgccaatggccttgcccacgttgccgaagctcgccaccatcgtgtaggtgaagaacgagaacacgagggaggccacccagccggtcaacatgaacagccacgggtgcaccgcctgaatgtgcaggaacagcaggccgccgcccagcgagaacgtgctctgcaacagtgcgatcacggcgaacacgccataatggccgaggaacagctgatgcggcttcggattgtcgagctcctcacgattcttgcgcgacaccgtggtcttgagtgttacggccataagcagcgatcccacgaacaacggcagaatcgtgtagaacggagccaattgcgagccgaaattctccacagggaacacagccgtgcgcttcacctggacgggggccgcaagagccgccgccagcgaatcggtgttgttgccgagcacgtccttgacggtgtccatattgccgctgttcagcgcgtcggaaagcgtgccattgaacgaagacagcgcggtgctcgccttagtgaggctttcggcggtggaatccaacaccgtgcgaatattggtcagctgcttgcctgccgacttcgtggtgctgttgagatctcccaacgcgcccttcagatcggtggccgtgctgctcagtgcggtggccgtgctgctgatcgaatcggaaatgtcgttgagctgcggcttgagctggctgtcgaaatcggttttgatgccgtcgatggaggccttcgcctgctgggcaagctggctcacgcgctcgcggtcggctgtggtgtcgctcactttcgcgtcgatattgtcggcgctggtgttgagtgagttcgctagatcgttgagttgcgtaatggtcgcgcccacgttggttttgagatgattgatggcgattttcgcgacttccggcaccagattgttgttgctgagctcgtcgagggcatcgtagatgttctgatagccttgcgcctgcttggatacgttcgcagcctgattgcgcagggcggtggccgtattgccggcttgggtgcccgcattgttgaatacgctgtcaatatcggtggagacagcgccgaagctgttcgacgagctgctcaacgcggtgctgagcgcattcgtgctggttttgacggctccggtcagatcgttgatgccgttcttcgactgtttgagctcgttgacggcgttcttcgcgctgccgctcacgttggaaagcaggctgttggagctgtcgagcaggttctgcgcgctcaacgtcagcgagctgaacgtggtcaacgcggatgacgtgtcgttcagcgtgttcgcgaagttgttcatattgttgctgaagttggtgagcgtggcctgcgatttcggtttgtcaagctcatcggccagctgcgaggcgatgttgagcgcggtgctcgtcaacgttgcggagaacatttcgttgatctgtgctgccacggtgtcggctccctggccggtgatcttcggagcgagtgcgttcttcttctcgttgttgtagtaggtgagtgtggcatggtcgccgtccgcggtgaagaatgtcatcatgcgggtgctgaaatccttcggaatcaccactgctgcatagtatttgccggatttggtgccgtcgatggcctcttttttggtggtgaaggtccagtccatctggtcgttggcgcgcaaggtgttgaccacctgatcgccgatactgatcttcacgggaatgagatcggacttgtagccttcatcgtcgttggcgacggcgaatttcagattgccggtgttggcgaatggatcccagcttgcgctcacgttgaaccaggagaacaggccaggaattaccaccagtccgatgacgatgatgatggagacgatgttgctggtcaggcgtcgaacgtcgccgacgaacagtttccagatgtttttcatgcattgctcctttcgctgttaccgttgggattggtgttgctcgctgtgccggtgttgccggtcgcgttcatggcctgtaccagtgttgcgatgccgtcggcatcggcttggctggtgtctgcgacgttggcgatcgcctgtttggtttcgtgttttcttcgttgtgccttgcgcatcagcttgtctcgcctgatttgttgcgcacgcttcttgcggcgcagccttgcagcttggcgttccaccagttgttcgcgaatcgcttcgtcgctgaggctgccgagttccacctggcgttgcaggctgaaacgcatatattcgatgaccatcaggaatccgatgatgagcagcacccagatgatccaggtggcaagcaccacgatcttctcgccgttggtgaaggagaagatcagcaccagaatcaccggcacaatgaaaccggcaaccagcgcgccacgcttgagcttcggatacagttcggcgaagcggctcgcacgttcctcgatcgcctcacggtagccgcccttatcggcgagcacttgaatggcctgggacacgttgtagccgcgttccggaagctgtacctcctcgccgatgatcatgtcgctttccttgatctgacgggcgaacaggcggttgagattgaccagcagcgggcgaatcgcaagtccgatgaagaacgcggccacggcgaacatcagtagcgcgccaatcgacttgagccaatgcccgtcgtagaagccggcaatcgtctcacggaacgcgtcaatcgaataactgaatggtacgaacgggtagaccatgcggaagaatttcggcatcatctcaatcggatacaggccggaagcgcccggaatctgcacgatgatcagcgcgacgcacagtcccttgccaatatgcatgaacgaggttgacagcgcgaaggtgatgctcagatataccagcgacgtgatgacgccggtaagtatgtacagcggcgcgttcaccgtctgcacgccgatgatgaggttgccgatggtggtgatcgcgccttggatggcgcccatgatgccgagcagcatgtagcgggcgaaatatttttcggaagtggtcaggtcgaggtcttcgaggccttcatcgtcgacctccaccttgaagatcaccacgaaggcgaacgcgcccacccacagggccaggttggtcatgagcggagccatgccggaaccgtaggagttcatcggatacacgtttttcgtgtcgatcaccgtgggggactgcatgaacgaagcgattttctccgtgttgagggagctgtcgccggtcaggcttttcagcatgtcaacgctgccgagcgctttcaggtcggtgctgacggtgatgagcttgttctccacctgctcgagctgcttgtcggtgttctgcagcgtggtgcgggtgtcgttcgccacctggtcgagttggtcgagcacggcggaggtctggttgaccacggtggtctggctggttacggtgccggacagtgtgccggcggtcatggcgagcgagctcagaccggagttgagctgggggagcgcaccggaattcaacgtgttgcgggcatctcccatgcttttcagcgaattttgcgtgctggtgttgaagtcggtggcgagtttggacacgctgtcggacgtggattgcgtgttctcgctcaacgttttgaggtcgttgagcgtgccagcggccgtgttgttggtgtcttcgagcttcttgatgatgtcttggtactgtgcgttgtcgctgacgttcttgagcttctcgatgagccgggcgttgctgtcggtcacgctttgcatgttgctgacggcctgctgtgcggtgccgcttgcggacgagacggccgtggtcaccttgttgatgctggtggtggtgtcgctggcggcctgcgaaatcaggctggaaccgttttccaaagcggtgttggcgttggacgtgaaggtattgaggccgttttgtgcggtgccgatggcggtggcggtgttcgccaggcccttgcccgcgcttgctgcggccagctgcacgtcgttcattgcctgacgggcggattgcgtttgttgcggcacgttggcgagctgtgcgtcaagatcttcgatggtggagcggatgaggcttacgttcttctgggttttgtcgagttctgctgtggtttcgttgacgaaggagttggttttgccgttgatggtgtcattcgcggagttcacggctttagtgagtacttcgctgacggtggagacgaaggtgttgttgacggtacgatcaacggtggtcgcgccttggtcggtgattttcggggagatcgggctcgatttttcgttgacatagtattccagcgtcggccggttcttgctgtcggtcacgacgttggcgagatcctcgctgaaatcggaggggatgatgatcgccgcatagcagtcgccggactgtaccgcttccatcgcttcggccttgcccatgaattcccagccaagctggtcgttgtctttcagcgtgtcttcgatctggtcgccgaggttcattttgccgagcagggcgttgtcggtgcctttgtcgacgttggccacggcaactttgatgccttgggtattgccatacggattccagaatccgtagatgttgaaccatgcgtacagcggcggaatgatggttataccgatcatgatgacccaggcggcaggtacggtgacgagtcgtttgaggtcacgacgcagaatctgcagtacgttgcgcattgtctccccagtccaatggatgttcgaccgtgttcgcgcgtagcgatacgttattcgtagcgctacgcctcccgtatcgtaatacccgctctcggacaaatttgggcacaggcgtaaatgcgctccgtccatgactgaaataaacacgacaaaccgcggcaggactgtgaatcttgctgttggagaccgcgcaacttgccttctgtgtctgcgcaagtcgagtctgctgtctgcgcatcttgtgattgcgggatgacatgtgacttgcgcaggcagaaatcgcaggttgtgcgcgttgcgcgcaaacaatcatctcgtgtagcgcactgcgatcgggttttggtagcgttgtgcagggaaggacgaacaagcatgagcaagattgaagatgtgagcgaagccatcgccgacgaaaccgaaatcgcagcaatcgaagaggccggcatcattgcgcaatcgcaatcggcggaggatgacggcaatcctgctgaccgcaggctgccgctgattgcacgtatttacggcatcgtcatgttgatcgaaggcgtggtgacgttgccgatcatcgtgatttcctgcctgtatgcagtccacgccgcgctttccggcaaactggcgtttggcgcgctgaatctcaccactattctgtcggttattcatgctgcagtgctgccggtctccaccgcatgccttgcgattttcggcatgctgctgattctcaacaagcgtcggcatatcgcgcaatggacgtatctgatgattccgctcacgcttgcggaaggcctattgtcgttgtcgttgcagggtttgggcgtgaatctgatcagtccgaccgtgcagctgcttgtattggttgcgttgcatatcacggctgatccgtcgctgcgcgaggagcgacgtttgcagttcgcgcttcgtcgtttggatgcgcgcagcgagtatgagacggctgtttcgaagggtatggccggccgtgatctgaccggcaagggctatatttcgcttgatttcttcaacctgttttggctgtttgtggtcggatgcgtgttcggtctggtagtggagacgctataccactatgtgctgttcggcgaatggcaggatcgcgccggatttttgtgggggccgttctcgccgatctacggctttggcgcggtgatcctgacggtattgctcaaccacttgtggcggtcgaattggatgctgatcttctgcgccagcgcggtgattggcggcgcgttcgaatatttcaccagctggttcatggaggttgcgttcggtattcgcgcgtgggattacacgggtcaatggctgtcgattgatgggcgcacatccggcaaatacatgtttttctggggaatactcggcttggtgtgggtgaagctgattctgccgcatttgcttgcgatgattcagcgtattccgtggaagattcgctatacgttgacggcggtgtgtttcgcgctgattttcgttgacggcgtgatgacgttgatggcgctggattcctggtattcgcgtatggcgggtattgcgcaggattcgcccgtttcgcaattcttcgccacatattttgacgacgacttcatggccaatcggttccagaccatgacgctcgacccgtccacggccagccgcatgtagtgtctgactgttttatggatgactgctttatgggctagatggcgaagctttgtggaagaacgtgtatggtgcgtccgctattggttgcgccgtgcacggctgcatgtgacctgtgcccgcactgcctttgtggactcggtgccctgcgacttctacgcgcttaggcggcgaagctttgcgcgagctggcggatgagatccggcctatgtccactccatgaggagttcggtgagatgacgaccggaatctgcttgaagccagcgtttttgatctgttcgaaggtggacgggttcttcgtcagatcaacggtgtcgtaacgcacgcccagctttgcgagctcttgttcggtggcttcgcattgcgggttgctcggattggtgaagacggtcacggtcattcgatttcctccctatgcaaaaatggcttccgtcgtttgcgaaagccgtgtcggccacgttcttcggttatgctcgcttacgcaagccactatctagcatacacactaccggtagtggtgtgtcgtgagtttcctcactgtatatagtggggaattccccagaattccccaaaatacgaacgtttgttcgaatatgtctagtgtaccccaaaccacggaattcacgtccgcgcgcatgtcgtgcgtgttttatggagagggttgtatataggggggtggcttggtgacgtcaatgcctgcctgatggcacggcgaaaactgtttattcatatgtaaaacaccggtaatacaccgcaaatgacctcagttgtcacccccccccctaaaatgatgagtatgcgtagcgtgaatttgcgtgggcgtgttgaacaaccttgatgattccgatttgcctactgtcttaaggactgttgggctgacaggaaattctgagggggctgtgagcatattcgcgggaatttgctctacggtatgctgaggttcggcggttttccgctgaatacaggaaacccctggaaatcgtacgattcccaggggtggatggttggtcgctggctagggcagcgcatcagggtgaagaagtgttttcgaaggctcttcctcacctatcaactgcgtttgaggtatagccctcgccggcagccagccaagtcttatcttatacacccttagctatgtcggcgaccttattgcagggtgtgttcaatgaagccataacgtgccattaaatacggcaatttggctccgcgcaagtactccaggggaagtcgttgcacggagccaaattaatcgctttcaggcgaatgccaccttggctgagttagactcaggcgcgcttgcggagcacggtgatgccagcgaagccgagcagggcgatcacggcgaacaccgcaacgccaccaacggtagcgccggtgttgccgagaacggccttcttgatcttctgggcaacggtcttcttggtgttgcccttggtgtcattcttcttggtggtgtcggccggcttgctgtcatccttcttggagtcgtcggtcggagcgtccttgtacatggcgtacacggcccagttgccggtcacgaccatgtctggatcgaccggaacgtcgccgtcgttggaggcgaagccccatccggtgaagatcttgccttcgacggccggtgcctggatgcccagcgcgtactgggagaacttgaccttgtccttggcgtagtagccgacggtctggatgagcttgtcggtgccggcgtagaaggagaccacgttctgggtggtgtcatcctcggtcggagcgtccttgtacatggcgtacactgcccagtcgccggtcacgaccatgtctggatcgactgcgacgtcgccgtcgttggaggcgaagccccatccggtgaagatcttgccctcgacggccggtgcctggatgcctgcggcgtaggtggagaacttgacgtggtccttggcgtagtagccgacggtctggatgagctggtcggtgcctgcgtagaaggagaccacgttctgggtggtgtcatcctcggtcggagcgtccttgtacatggcgtacactgcccagttgccggtcacttctgcgtccgggtcgactgcgacgtcgccgtcgttggaggcgaagccccatccggtgaagatcttgccctcgacggccggtgcctggatgcctgcggcgtaggtggagaacttgacgtggtccttggcgtagtagccgacggtctggatgagctggtcggcgcctgcgtagaaggagaccacgttctgggtggtgtcatccttcttttcagcgttcttgtacatcgggtagacggcccagttgccggtcacgaccgtgttcgggtcgactgcgacgtcgccgtcgttggaggcgaagccccatccggtgaaggtcttgccttcgacggccggtgcctggatgcctgcggcgtaggtggagaacttgaccttgtccttggcgtagtagctgacggtctggatcagctcgttcttggtgttgtagaaggagaccgtgttcagagtcttatcttccgaagtcggagtgtccttgtacatcgggtagacggcccagttgccggtcacttctgcgtccgggttgactgcgacgttgccgtcgttggaggcgaagccccagccggtgaaggtcttgccttcgacggccggtgcctggatgccgagtgcgtactgggagaactttgccttgtccttggcgtagtagctgacggtctggatgagctggtcggcgcctgcgtagaaggagacggtgtactgggtggtgtcatcctgtgtcggggtatccgcgtacgtcgcgtatacggcgatgtccgcgaacacctgatcggtgtccttgagcatggtgccctcggagtaagcccagccggtgaaggtcttgccctcgatggtcggtgcctggatgccgagtgcgtactgggagaaggcggtgcctttctgccaggtgactccctggatgctgtgtccgtcagcggtgtagaacgtcaccgtggcgtattcttctttagcctgcgaggaagttgcagaattctgattctgggcagtatcagccattgctactgccggtgccaaggcggccagagtcgctacagctgcaacgcccgcaataatctttttgccaaaagacatttggggaaaccctttcttagttacgtaactagttgccccaaagcgatgccttcgaaataccgccctgaatgcgtggagttccccctcataagaattccgaaggaccatgatagctgccccctagcgactttttaagagtctagggcgtgttcgttggaattgcaatcttttctcgatttcccactttccgattgtggctggttgaagggattcctttcgggattggcaggggccatatccgggatgtcatgtctgtgatgggggcgtcgtccggtgttcgggaagcggcaggccatgtatggttcgggaacggcaggtcacgtagtgctcggagacaaatacaccacaccatacagcgtggcaagcgtcccattccctccactcgctggattttttgcccgctaaaaggtccgtcaccgggatgattcctccaccggctggaggaatcgggacgttgataggcctaccaacgggttgattcctccactcactggagtttttcggacgctgagaggtcgatttgcgtcccgtttcctccagtgactgggagttttatcccgctggaagactggtttacgggaagattgttccactgactgggggttttggacgttgggcgtctgccagtgggaggattcttccagtgggtggaggttttgtctcgctggaaggcgcgttcgccgatagtatggcagggtgtttaccggcgcggatgatgatgtgacgatccgtgtttggggcgcgaacaatgtgaatgcggacactccgagcagcgcgcttgacgcatactgtgcgaaacatgacgtcagttacaaaagtttgggcgaaaacagttttgtgactacttgggaggaaaacggcaccattgtgtacgtgcgcgagctggtaagcgacagcgtggtgcacgcggtatggatcgagtatccgtcgtccacgtcagatcggggcaatgcgattgtggaacaggtggttcccacgcgtaaggcgctcggctgaatggacatatgtgctctggatttcgggctttgagccgtgggtgcaattgtgggctatgaggattgcttgagcgtcttggatcgtgcgggtcgcttggtctgcaagctgtgggatgcgagttgtgttgcggtgagtatgactaattgcgtctggagccaaaaatcgcgggaatcgaaaaacccctggaagctaatgtttccaagggtttcgcggtgcccccccccgtgggattcgaacccacaacccacgacttaattaggcgtcctctagatccggaatcggaaggccggcagaaacccacggcatatgaacgccattcgtattcgagctgcgggtgtggcgatgaagtggaaaagacgagggaacgcccacgtgtcgccgccgatcgcaccaactgcatcgtatctttccttgtaccgcgttacctcatgctgatggtcgtgggagccgcggcgaggaaacgctgagaaccacgccggacatacgcgccggccattcattggccggctttttgtttacaaggaagtaaaaatggaattctcggatcatagacaaccgccccgtgaatggacaccctggctcgacgaatgggtgggcgcgatgcgcgcgcagggcaattcacccagaaccatcgagaactggtagtacgtcgtggggcacctcgcgctcaagacgcgaaaaagccccgaggacatcacaggcaaggacatcatcgactggctgaaccggggcgtgggcgccaactccaaacgctccgacgtcaacgcatgcaccgcgtttttcggttgggcatgcaggacggggcggagaaaagacaatccaatggatctcgtgccgaccgtccaccgagacaggcgcaagcagatacccgcccccgtcgaggccgtggagaaggccaaacattgcgcggacaagagggcgctgctgaccatcatgctcatggacgaggcgggactacgcagatccgagctcgccgcgatgcatacgcgcgacgtcatcgacgatctgacgggcaaaagcatcatcgtccacggcaagggaggcaaggaccgcatcatcccgttgagcgaccagctcgggcggatcgtgtcctccctgccggaaggatacttcttccccggcgaacatgacggccacgtatgtcacgacaccatctaccggatcgtgaagaacgcgaccggatggccgccgcacgcgttccgccgcaagttcgccaccgacctgtggagggcgaccgacgacgccatgaaggtcaaggagatgctgggacacgagtcgctgcagaccacgcaggactacatctacgcgaccttggacgacctgcgcgacgcggtggacgagctccgcgcgtaccggggaacggacgcacgggaaattcaccccgaaaagatactcgaagcgtacaacgtccctcccgccatcacgagactgctgctcgacagcatccgcaaccaggaatgaagcacgccgtccctctggtccaccggaccagagacgggaactcgtggtcttccccgtgaatcccattcggtcggctcgttgtcgcgatttccggggtatatcccgtgtggagcatgtcagtgtgcggcgctgcggcgggacacgcgatgcccggtatgggtggaatgctcctgattttttgcgggaacggcgttcatcggcctccccggcgctgggcggccaatgccgtatggtttgtcggcaagagacatgacaggctcttacacgacattacaccgggatattgcatagatctatcaattacccgctacaacatattaggttttctctggctccggttgtttggcgtcgggtgcatggttagtatggattggctacaatgtattagacagtccgatgagggacgaatgacatgagattggaggccgacgatggccggcccgaagcatccccgccactacgacgaggcgttcaaacggcagatcgtgcagctttacgagaacggcaagccggcgcgcgaggtcaaggacgagtacgacgtctcgcattccacgctgcaccgttgggtccagggcatccgcaacagcggctccacgaaagccgccgacaaccgcacccctgagcagaacgagccggtcgagctgcgcaagcgcaacagacagttggagatggaggtggacgttttaaaacaagcggcgctgatattcgcacgaaagtagcagtgatacgggccaacgcctcccgttatccgatatcggcgcagtgcagaatactgggcgttccccgctccacctactactggatgatcgaacatcccgaagccgagcgggtggacccgatcgccggcgacgtgcacgcgatctggcgcgacagccatgagcgttacggcgccaggaagatcaaggccgcgctggagcggaggggcgtcaccgcctccagaaggcgcatcgccagcatcatgaaacggcggggcatgacgagcgcgtacgcgcgcagaacgttcaaaccacacaggacgcgggccgacgaggccaggctcgcgaacatcctcgaccgcgagttcgacggctacgagccgcgcacccacctggccggtgacctgacgtgcgtgcgcgtcggcggcaagtgggcgtacgtgtgcctgctcatcgacctggcgaacaggagcatcgccggccacagcgccgacacgagccgcaccgccgacctggtcatggccgcgttcgccacgctcgacttccctctgaccgaggtggaggtgttccacacggaccggggcagcgagttcgacaacgcgaaaatcgacgagctgctcgacgtgttcgacatcagaagatcgctgtcaaggaagggcaacccgtacgacaacgccgtggtcgaatccaccaacaggctcctgaagaaggagctcatatactggaaccactacaccagcctggaacaactacgctccgacctcaacgactatgtgtggtggttcaacaaccaaagactccactccaccctcggataccggagccccaacgaattcacacaacaaggactcgtcctctaaagaattgttcaacacgccgttgccaatccagacccacgggggcaccagggccggacgcgtgacgacccatcccgaccggtgatatataaccccggaacaggcggaatcacatgcgatatgttcttctggggtgtgctcggcctggcatgggtcaagctgatgctgccgtggctgctgcgcctgatccaacgcattccatggaagatccgccatttgctgaccgccgtgtgcctggcgctgatgctcgtcgacgcggcgatgacgctgatggcgctggacgcgtggtattcgcgcatggcgggcatcgagccggattcgccggtgatgtcgttcttcaacacatatttcaacgatgatttcatggcggaacgtttccagacgatgtcgctggatccgggcaaggccggccgcctgtgacgccggggacggccgcggtgggtgttaggaaaccgttaataatccgtccgcgggcgtatgggttccgttagattcggagcatgacttcgctcagggccatatcatcaagatgcttattggaaataggtccggccgcgcccgcgaacgcggcggcggccggaccgtgcatctgatgattggagaagagcaacatgccttggtgggttgatgccgcctatgtcgtgggcgtaatggcgctgttcattgtcttcgacctgatcgcgaaggcggtggatcgtctatgatggctgttttctgcgccatcggcgtcgtattgggaatcgccggtgtggtgtatatgggggtcgccctgtgccgcccggagcggttctgagggccggggaagagtcttaaggttccgaaatggtatatctctatgcttttatggcgttcggtttgatcgccttgatcctggcggccatataccggccgttgggcgattacatgtatcgcgtgtacacgaccgataaggatctgttcttcgaaaagtggatctatcgcatcatcggcgtggatttctcgaagggacagtcctggaaggcgtatttccgcggagtgcttggcttctccgtgatgagcctgctggtcctgtacctgctgcagcgcgtgcagtcctggctgccgttctcgctgggcttcgacaacgtgccggctccgctggcgttcaacacggccgcatccttcgtgacgaacacgaactggcagtcctattcgcctgaccagacattgggctattccgtccagatcgcaggcctgtgcgtgcagaacttcgtttccgccgcggtcggcatcgccgtatccatcgccttggtgcgcggcttcatgctgcgccgctccgacacgatcggcaatttctgggtggacctcatccgcggcacgttccgcatcctcatgcccctggccatcgtgatgggcaccatcctcatcgcgctgggcgtcgcacagaacttctcgggcttcaccaccgtcgccaccgtggctggcggcgaacagaccatcatgggcggcccggtggcctcccaggaggtcatcaaggaactgggcaccaacggcggcggcttcttcaacgccaattcgtcccatccgtacgagaacccgaacatgtggaccaacctcattgagatcctgctgatgctggccatccccgtcgcgctgacccgcacgttcggccgcatgatcggcaacatccgtcagggctatgcgctgctcggcgccatggtcgtcctgttcggcatctccttcttcgccgtcgtgagcttcgaatccttcgtggacgatccgctcacctccctcactggaggctccatggaaggcaaggaggaccgcttcggcatcgtctggtccgcgctgttcggcaccacgtccacaagcacgtccaccggcgcggtcaactccatgcatgattcctacaccgcgctcggcggcatgatgtacatgttcaacatgatgctgggcgaagtctccccgggcggcgtcggcgcaggcctgtacggcatcctcgtcatggccgtcgtggccgtgttcatcgcaggcctcatggtcggccgcacgccggaatacctcggcaagaagatcggcccgcgcgagatgaagatggcctcgctgtacttcctcgtcatgccggtcaccgtggtgctgttcgtggctctgagcttcgccatcccgggcatccgcgaagacacgttcgcggccctgaacaacagcggaaaccatggcctgtccgaagtggtctacgcgttcgtgtccggcgccaacaacaacggctccgcattcgcgggcctgtccgccgacaccccgtggttcgacacgatgatcggtctggccatgctcatcggacggttcctgccgatcatgctggtgctaagcctggccggctcgctggccaagcaggatgtcgtgccggagaccgccggcacgatgaagaccgacaacaagctgttcgttggcctgctcgttttcgtcattttcattatttccgcgctgacgttcttcccgacgcttgctctgggaccgttggcagaaggtttggtggcataacatgtcttccgcgaccgcaaacgacgtcatcaacgacgtgcgtaccagcaacaacgcatcgttgccggcgatgctgggcaagagtctgccggcggcgttcaggaaattcagtcccgccaagatgcggcacaaccccgtcatgttcgtggtatgggtgggcgccgcattcctgacgctcctcggagtgttccagctgttcattccggaactgcgcgcgggcgagccggtgtatttcacctggatcatcgccgtgtgcctgtgggccacggtgctgttcgcgaacctcgccgaagccgtcgccgaagggcgcggcaaggcccaggccgacgcgctgcgcaagacccgcaccaccacgccggcccacctggtccacggatacgatgaaaaaggcgatcccgacgcacgctcgttgtccgtcgccatcatcgaagtcccgtcctccgacctcaaactcggcgacgtggtcgtcgtcgaagccggacagctcatccccggcgacggcgacatcatctccggcatcgcctccgtggacgaatccgccatcaccggcgaatccgccccggtcatccgcgaatccggcggcgatcgctccgcggtgaccggcggcacccgcgtgctgtccgaccgcatcgtcgtgcgcatcacccagaagccgggcgaatccttcgtcgacaagatgatcgcgctggtcgaaggcgcgaaccgtcagaagaccccgaacgaaatcgccctcgacgtgctgctgagctcgctgaccattatcttcctgatcgtcgtgatgtgcctcaacccgcaggccggcgcggtcggcacctccgtcagcctcaccgtgctggtggcgctgctcgtctgcctgatcccgacgaccatcggcgcgctgctgagcgccatcggcatcgccggcatggaccgtctggtccagcgcaacgtgctcgccacgtcgggccgtgccatcgaagcggccggcgacgtgaccacgctgctgctcgacaagaccggcaccatcacgtacggcaaccgtcaggcatccgaattccacgcgctgccgggcatcgaccatgacgacatggtccgcgccgcggcgctgagctccctggccgactctacgccggaaggccagtcgatcatcgccctggccgaacgcgaaggccatcacttcgacatgatgccgggggcggaagcggtggaattcaccgccgagacccgcatgtccggcctggacctgcccaacggcgaccgcatccgcaagggcgccacctccgcggtggaagcctggatcgaacgcgaaggcggcgtcatgagcatcgaagtgcgcgacgctctgcacgaccgtgtcgacaccatctccgcgcaaggcggcaccccgctggtcgtggccgaacagctgtccaccggcgaagtcaaggtgctgggcgtcgtccagctcaaggatgtcgtcaaggaaggcctgcgcgaacgcttcgccgacctgcgcaagatgggcatccgcaccgtcatggtcacgggcgacaacccgctgaccgcgaaggccatcgcagaagaggccggcgtcgacgatttcatcgccgaagccaagccggaagacaagctcgcctacatcaaggccgaacaggccaagggacagctggtcgccatgaccggcgacggcacgaacgacgcccccgccctggcccagtccgatgtcggcgtcgccatgaactccggcaccgccgcggcgaaggaagccggcaacatggtcgacctcgactccgacccgaccaagctgatcgacatcgtccgcatcggcaagcagctgctcatcacccgcggcgcgctgaccaccttctccatcgccaacgacatcgcgaagtacttcgcgatcatcccggccatgttcatggacaagttccccggtcttgccacgctgaacatcatgggactgcacagtccgttgtccgcggtgctgtccgccatcatcttcaacgccaccatcatcgtgatcctgatcccgctggccctcaagggcgtgcggtaccgcgccgagtccagcgacaagatcctgtccaggaacctgtccgtgtacggtctgggcggcgtggtcgccccgttcgtcggtatctggatcatcgacctgttcgtgcgtctgattccgggattctaaggaaattaggtaagggaaacgattatgaaatccgcattgtcattgaatctgcgcagctactgggccgggctgaaggccgtgctggtctgcacgcttgccgtgatcgtatacacggcgttgatgaccggcatcggcgctctgggattccccgagcaggccaacggctcgatgattacgaactccgaaggtcagatcgtcggatcgtccctgatcggacagtccttctccgatgccgacggcgaagccatcgacaagtatttccagccccgtccgtccgcagccggcgacggatacgacgcggcggcgtccagcggtgccaacaaggggcattccgatgaggaatatctcaagaccatcgaagagcgccgcgacgccatcgccgaacgcgaaggcgtggacgtgaagcaggtccccgccgacgcggcgaccgcctcctcctccggactggacccgcacatcagtcccgaatatgcggccatccaggtcgagcgtgtggccgaagcccgtggcatggacgtcgaagatgtcgaacggctcgtcaaggagcacaccaccggccgtggtctgggcttcatcggagagcctgtggtcaacgtcgtcaccctgaacctggcgttggacgacatggagtgaatccgactctgaggcgcatcggatacggtgcgcctcggatgtcatcaggccaaaaactgggataatccgtagatgaaggacatcccggacggatgcggcgccgtcgtgcgcggcggtgccgcatccgtccggcttgaggccacggaacgtatggcatgcggcggaacttcggaatggagggaatatggcggtgacgaagcggggtgcgctgagggttctgctcggtgcggcgcccggcgtgggcaaaacatatgcgatgctgtccgaaggcagacggctggtcgaggagggcaaggacgtcgtcatcgccctgttggagacccatggccgcaaagccacgcagaacgccgccaaaggcctggagacggtgcctcggcgctgtatgaaataccgtggcatgtggttcaatgaaatggatctgttcgccgtcatcgcgcgccgcccgcaggtcgccctcgtcgacgagctggcccatacgaacattcccggatgcacgcacgaaaaacgctggcaggacgtggtcgacctgctggacgccggcatcgacgtcatcaccaccatcaacgtgcagcatatcgaatcgctgaacgacgtcgtgcggtccatcacgaacagcgaacagcgcgaaaccgttcccgacaaggtgctgcgttccgccgacagcatcgaactgatcgatctgcccccgaagaacctgcgcgaacgtctttccgccggcctcatctattcggcggaccgcgtggacgccgcattgagcaactacttccgtgtgggaaacctgaccgcattgcgcgagctggcgttgctctggctggcgggcaacgtcgacgaagcgttgcaggaataccgcaacgaacaccacatcaacgcgaaatgggaggcccgcgaacgcgtcgttgtcgcgctgtcgggcggtcctgaaggcgaacagctcctgcggcgcggcgcaagggtcgccagggcgtccggcggcggcgatctgatcgcggtgcacgtcacggccgaggacgggctgcacggatccagcccggggctgctggtgcggcagcgcgaactcgtcgaaaaactgggcggcacataccatcagatcgtcggcgaagacatctccggcgcactgatctccttcgcccgcgccaacaacgcgacgcagatcattgtgggcgtctcccgacgcccgcccctcgcccggtggctgggccggccgtcgtcggcgaacggcatcatcgcgaattcgggcgacatcgacgtgcacgtcgtcacccacacgttcgcggcgaaaggcatgcgcctgccgcgcatgaaacgcaccatgacgatgcgccggcgcatcgcaggctgcatattctcattgctgtcggtgccgcttctgggctggctgctcatgcaatacagcggcgtggatgcgttgtcccgcgattccctgttcttccagctgctcgtcgtcatcgccgcgctgatcggcggcgtctcgtcggccactttgtgcgcgttgctgagcggtctggtgctcgactacgtctacatccagccggtgggctcactgcatatgctcagggcgcaggacgtgatgaccatcgtgctgtacatcctcataggcatcatcgtgtccttcgtcgtcgaccgggccgacgagaaggcgcggcaggcccaacgtgcgaccgcggaatcggaagtgctcgccagcgtgtccgacgctgtgctgcgcagctccaatccgttgcaggcgattctcgaccgcacccgcgaggcgttcggcttcacctgcgtgcgcctcacccatgacggcgtcgatgtcgcggtcagcggcgtatgccccaccggggaggagccggacgtcatcgaccttgacgcggtcatcacgccgccgtccgacggcgccgatcagaacggcgaatcccatgacgggcagacctccgcctcacgtgatgccgcatcctccggaacgccgcggaaaacagagccgattcgccttgaactgtacggcagcgaaatcgacgcggccgaccagcggttgctgcaggccatcgtctcccaggtgcagaccgtgctggaacacgacgtgctgcagcgcaaggccgacgaagtcaagccgctggccgccgcggagaagctgcgcacggccctgctcaacgcggtcagccatgacctgcgccgtccgctggcctccgccacggctgcggtgtccggcctgaaacaggtcggcgacgcccttggccccgaaggccggcgcgaactgctcgacgtcgccgacatcggcctgcacgatctgacacgactggtcaccgacctgctcgacgtgtcccgtctgcacgaacgtgcgatgccgatatcgctggtggcggccgacgtcgcggaagccgtgatgcagacgctggacgagctgcatgccggtccgaatgccatcaacctcgacctgcccgtggacctgccgctggcggtcgccgacccgccgctgctgcgtcgtgcgatacacaatgtgcttgccaacgcgcaacgctacaatccgccggaccatcgcatccgcatcgcggtctccacattccgttccgtcgtgcagatccgcgtcgtggactacggcccgggcgtgcccgacgaccgcaaggacgagctgttcgcgccgttccaccgtctgggcgacacggacaacaccacgggccttggcttgggaatggcgctgtcgaaaggcttcatcgaatcgatgggcggcgccatcgacgcggaggacactccgggcggcggcctgaccatggtgatcatgctgcgcgcggcggacgagcgctatgcgatcggggaaccgttgtccgaagaggacgcgcgcgcctgcgccaccgcattggactcggacatgtgggacgtgaccgccgccgtcagcggcgtgatgctgcccctgagcgtggacgaatcacgtgacggcgaattggggcgtttcgccgacgccgaatccgataccgcggtcgccggtgacacggccgctgcggacgagcataccgacgttgccgacgtgacggctgctgagaagggagaatagacgcatgaaaatcctgattgccgatgatgacccgcagttcctgaaggcgttgcgtatcacgctgcgctcgcagggctacgagatcgtgactgcatcggatggcgtgcagtgcatttcggcggcggtggagcatcatcccgatctgatggtgttggatctgggcatgccgaaaatggacggcatgggcgtgatccagggcgtgcgcggctggacggacgcgcccatcctggtggtgtcggggcgtaccgatgcacgcgagaaggtcgcggccttggatgccggcgccgacgattatgtgaccaaaccggtgtcgatcgacgaactgctggcgcgtatccgtgcgctgacccgccgtatcctgcaggagacggagacgccgatggtctcgttcgggaacgtgaccgttgacctgtccgcgcatgccgtgttccgcgtgtaccacgggcggaaggtgcgtgtgcgcctgacgccgacggagtggaaggttctggagatcctggtgcgcaacgccggacggctcgtgacccgtaaggatctgctgaccggcatttggggcgcggagcatgtgaacgactccggctatctgcggttgtatgtctcgcagctgcgcaagaagatagaggacgacccgtcgcatccgaagtatctgaagacggagcagggcatgggataccgcctggacctgccgtctgcgggcggcggcgaatagaggccggggacgggtgaaggcgggtggaggctgggcgggcggcgtctgtccgcccagcctcgcgttatgcgtcgtatgggaggaatcatcgaggttgcggaaagcggagaggaaaacagccgataaacctgcgccacacgtcgtatgggaggaatcatcgaggggctgggcggccggttttgcccgctttgtttgccggtcccgcccgcttcaatcggggagaccgctggacacgatgcgtcgaaatggctttcaggctgcgagattctgcgcgagctgacggatcttgtccggctggtggccgctccatgatgcgttcggggagatgacgacaggaatctgcttgaatcccgcgtccttgatctgttcgaaggtggacgggttctgcgtcaggtcgacggcgacatatcgcacgcccaaacgggtgagctcctgttcggtggcttcgcactgtggattgctgggattcatgaagaccgtgaccgtcatcgggcatcctccttaaagcacgtagtcgatatgcggttgtcggccggcgtggacgtaaaatccgctccctctagcgtacccactgtttgtagtggtgtgtcgtggggctattcactagatgtagtgttcgacacgtctcgaattcaagtcattcgaacatatgttcgaccattttagcacctttgcggaccgtccggttgtgacctaaaccacatccttcgtctcacctgtcggtcggtcttctcctcttgctcgctctcctgacgcttttgaccgcagattccggcgtgttgcggtcaaaaccgtcaagatgtaatgcgcactgcagcggttggcggagtatggggtcggtgggttcgatccagcgggtgcaactcggcgggtgtggggctgccaaggtgtggggttgacaggatgtgggactggcgcgtcggcaggtgtgggaccgaaccgccggcaggcgtgtgccagagtatgacaaaagcccgaaaaccattgtggcaaacggctttcgggctttcaggcggtgccccccgtgggattcgaacccacaacccacgacttaaaaggacgctgctctaaccgttgagctagaggggcaacagtgagacagtatacagcatatttacgcaaaacgccacacgaatcagctgtaagtaacaaaaaacgtggattatcaccaagtcatcgccgaatcatcatcgaattctcgcgaatcgcagcgtcatttctgcatatctgctcgtacagtggaacgcatgtcatgtaccacgattcttgtaggcaagaaagccagctacgacggctccaccatcatcgcacgcgacgatgattccggttccggacgttacgatcccaagaaattcattgcggtagcaccgcaagaccagccgagacattaccgcagtgtgctcagtcatgtcgaaattgaccttccagacaatccatgccgatacagcattgtgccgaacgtgctgccgaaccgcggaattcttgcggaagcgggcgtcaacgagcgcaatgtggcgatgagcgccaccgaaaccatcgcggtcaacgagcgcgtgctagccgctgatccgctcgttgaactgcaaccggcgaacgaagccgctgatacccctgaaattccgggcggaatcggagaggaagacatcatcacccttgtgctgccttacgtaaccacggcacgcgaaggcgtcgcacgtctcgccgaactgcttgaaacatacggcacctacgaatcgaacggcatcatcatttccgacgtaaacgaaatctggtacgtcgaaacaatcggcgggcaccattggatcgcccgccgcgtgccggacgactgctatgcgaccatccccaaccagctcggcatcgacgatttcgacttcgacgacgccttcagcacccaacgcgagttcatgtgcagtgccgatctgcgcgaattcatggacgcgcaccaccttgaccgcactatgagtgcgggtgcgagtagcggcttcggattccagccgacgagcgttttcggaaacgccagcatgaacggcggtggcaatagcagtagcggcgcggcgctgggtcacaaccatttcaatccgcgcacggctttcggcaccgccaccaccaaagaccgcatctacaacacgccgcgtgcctggtatatgcagcgccacctcaatccaagcgaggactgggattcgccggccgcccgctacacgcccgcatccgacgatattccgtggtgtcgtgtgcctgagaacgctgtgacgctcgaagacgtcgacttcctgatgagtgcacacttcgaggggaccccttacgatccgtatggtacgctcgggacgccggaaagccgccatcgctaccgtccgatcggcatcaaccgcaccgggcatatggtggccatgcagattcgtccgtacgtgccggaaaccagccgctcgatcatgtggatctcatacggttccggccccttcaccgcggccacgccattctatgcgaacgtcaacgatacgcccgcctacctgcgcgacaccacgccggaagtctcgaccggcaacctgtactgggcgaaccgtttgatcgccgcgctcgccgacgcgcatttctacgaaaccagcaatgcgatcgaaggatttgcggaatcggcccgcgcttacggccatcgtctggtggaacgtactgatgccgaattgcgtgagatgtccgcgcaaacgagcgcgtccgaatcgcaggagcgtgcaggggccgcggagattgcggaaaacgcaagtattgcaattatcgcaaaactgcagcagtccaacgaagaaatggcggaatatttgcacactcacgttacgaaactgctcaacgacgtgctctacacgtccagcaatctcatgcacaacagtttcgccatgtccgaccgctggaactaagcataaagccccgaaatccggcaaaacccgtcccaatgagccaaggtttccgcgctcggagcattccgcatgaacgcaggctgttggaagcgtcagtactgctcccgacagcctcacggctgcatccgcatcctcgtacgtcagtttttgcccatatctcgcttatatatggcagatttcaagagctgacacgaggcatttcgcttatatatatggcactcgtgcttgtaggcaaggcgatttcgggggtaaaatataccctctaagtcaccttgctatcaagggcatctgccatatatgaggcagatagtgctatctagaccgtcgattgaccatcaaatcgtcggaaatcgcgatcagttgaacccgacgacgtgttccgccacgaaataccccttgcgaatcacgaaacgaccgatcgacccgcgcaaattcaacgcacgagacatggccttcttgcgcacatccttgtaaatagtgggggagtacgccttaatgtcgtcccacatatcctttttcttctcataattttccggatcgcgagacaaaatcatgaacacacttgccacggaactttcaatcgccaggaagtggatcatataacggtacaggccgtccggcaccgtgccgcgttccggagttgcacgcaccatgcactggttgacgaggcgcagctggtcgacgcggcggatcatcacgtcggtctgcacgctctggccgtcgcgaccgatgaaatagtggtagaacggcgtatccaaatacttcatggtcttcacccacgggaacggctgatacgcgtaaatgaagtccacgtagaacgtgtgctccggcagctgcatgcaggactctcgcaccacggcggtgcggtacgtcagcgcgtgcatgagaatgtattcagccaagccgaaatgcccaagatcgttccaggtcaggcgctcgccggccttcatggcatggcggaagttcaccacatgcttgttgcgtttgccaaccttgtcatacacataattagtgacgagcatgtcgatcggctcggtggaatcggcctcttcgcgcagcacggccatgacctgttcgagcgattcggggccaacccaatcgtcggcgtcaacaaccttcacgtacatgccgcttgccgccgcgatgccggtgttgacggctccgccatgccccttgttctcttggtggatggcgcgcacgatgcctggatagcgggcttcgaatttctgtgccatttccagcgtgccgtcggacgagccgtcatccacgatcagcacttcgatgtcgtcgttgcgcttcgctgcgattaacgacatgacgcatcgttccaaatattcggtcatgttgtacgcgggcaccacgaaggtgagcgtcttcttctcctgcatagtcttccttggtaggacgaggtgacctgccgcgcgcggcgcgtggtcactgcgtaacgaaactaacgtagcaccttgttcgcttcaggggaacggtttgtatgcaataggcaccctgaatagcgcaatctgcacctgaaatttcccttaagggtaccgttgttgacaatttgtaagttttcgtcgatgcttgttggcttgtgcgatgcttgcgattcccctgttgtgggcactgttcgattcttgcgtctggcgcctgttggcgttggctgcgatgcttgcgatgactgggggcggctgggttttacgactgctgttcggcttgcgtgccttggcttccggctgcgccttgttcggtattctgttcatcgttctgctcggctgggctttccgtattgttttgtgattgtgcctcttttgcggccttgcgctcgcgtttcgcgatttccttgatttcgcgcctttcctgcttttccgcctcttttgtggctttgtcgctttcgaaacgcagttccggcttggcttccatgcggctcaagccatgccaggccagattcacgatgtgcgcggcaatctgctctttactgagtttgcgctggtccgcccaatactggcaggtatatacggtcatgccgatgagcatctgcgcgtagtatggcacgcccttggccggcagatgctggcgtttgaacgcttcggcgagaatgtcttccacgcgcagggcgatgtctcccaaaagcgaattgaacgagctggccggatcggttttcggcgaatcgcgggtgagcactcggaatccttcagcattctcctcaacataggtgagcagtgccagcgccgtgcgttccacgatttgacgggggtgcgcttgtgggtcggagagcgcgttgacgagcgtgtcggtaagggcgcgcatctcacggtccaccaccacagcgtacaggccctctttgcctccgaaatgctcgtacacaatgggtttcgacactttcgcggtggcggcgatctcctccacgctcactgcttcgaaccccttcgacgcgaacagcgaacgaccgatttcgatgagctgctcgcgccgctgatacgacgtcattctggatgtattggccatgccgtccagtttttcatgccccgtggatagtctgtccgattctggtgaatcggacaactgtggtgcgtatggcgttgtctacttgtccgtttctcccgaatcggtcatctgaacgtcggattcggatggtttgttgtccgattctgcagaagcggacattcgtggtgcgtccgcggggcggagccggtgtgtccgttgcgctttttaggctggagtcatggatacgaatgtgattattgcgattgtcgccgttgtcgttatcgcggcaattctggtgattggcggttggtggctcggtaagacccgcaagaacgccgtcgataagtccacggaggatgcgaaagccaaggctgacgcccgtcttgccgcggaagcaaagtcggctgcggctgattcttccacggtgaagccgtccgttgattccaatgttgatgcagctgaaaaagctccggctgaaagtcagcagaagtcctcagctcaagcttcctcttccgaaacggcagctcctgcaccagccaccgaagccaagcccgaaccggttcatgaaacccccgaatccgccggcacgcgcatgcagcgtcttaaggcgcgcctgtcgaaatccggcaatccgttcggcaaggctctgttcaacattcttgcgaaggatcagctttccgaagccgactgggaagacgtcgaagacacccttctgcttgccgacgtgggtgcggaagccagcgaacagctcgtcgaggaactgcgcaacgacgcccgaatcgcaggccagtccgatccggccgaagtgcgtgccgcgctgaaggacaagctgttgaagctcgtaggcactgacacggatcgccgcctcaatgccaataaggaagacgcgaacaaaccaagcgtcatcatcatggtcggcgtgaacggcacgggcaaaaccaccactgcgggcaagctttcccgcctgcttgtttccgaaggcaagcaggtcatgttgggcgctgccgataccttccgcgcggcggccgccgaccagttggaaacttggggtgccaaggtcggtgtcccggtcgtgcgttccgacaaggacggcgccgatccggcgtccgtcgcattcgaggccagtgccaaggccaaggaagagaacgccgacgtgctcatcatcgacactgcgggccgcctgcagaacaaggcgaacctcatggacgagctcggcaagatccgccgcgttaccgaaaagaaccttccggtcgacgaggtgctgctcgtgctcgacgccaccactggccagaatggcatgacccaggccaaggtgttcgccgaagccatcggcattaccggtgtggtgctctccaagctcgacggctccgcaaagggtggcatcgtgatttccgtgcagaaggagcttggcgtgcccgtcaagctcgtcggcctcggcgaaggcccggacgatctcgccccgttcgatccggaaggcttcgtcgacggcatcctcgcctgagctgattgcgctcccgagaaagcctccccgcgtgggaggctttctttttacccccgaccagtcctatttcgcctatatatggcagatttgccggttcgtccgctggtttctcgcttatatatggcagatgcttttggagaaagtcgacttagaaggtatatgtttacccccgaaagcaccttttttgcgagtgagagtgccatatataggcgaaatgcctcgcgtcagtcctccaaatctgccatacataaggcagatacgctgaaaaatgggctgatagtggtttggcctgagagcggtgcgcaatctgaaacaaaacgtgccagccgctttattccgccgttttcggttgacgtaatggcgagatggcgttaccttgctgtaacacgtcgtaacgttttcaaaacgcgggcggcgttccataccgttttgtcagccccatacgatggggccggaaatgtgaactcaaaaagaaagaaagaggagggtgacatgggtcagcttgattctggaaatgccgcgtggattttgacgtccgcgtcccttgtgttcctcatgacgccgggtgtggcgttcttctacggtggcatggtccgcgcaaaggccgtgctgaacatgatgattatggaggcggccgctctgtccgtcacaatggtgatctgggtgctgtggggctggtccatcgcctacgcaggcacttcggtcggcggtgtcttcggtgatccggccacaggcttcctgctgaaggattccatggtttccgacggcggtgtcttcacgtcggcttcgctgaactccaacaactacccggtcagcgtcgatgtggcgttccagtccgcattcgccatgattaccgtcgctctgatttgcggcgctatcgctgaacgtgtcaagtactccacgtggatgattttcgtcgcgctgtggattaccttcgattacgctccgctcgcccacatggtgtggaatggcggtctgctgagcgctgacggcgcgatctcccaggctatcggcgctgccgcccacgatttcgcaggtggtacggtcgtgcacatcaatgctgcagtcgccgctctggtgatcgtgttgatcatcggcaagcgcaagggcttcggcacccagccgttccgtccgcacaatgttccgttcgtgatgcttggcgctttcctgctgtggttcggatggttcggcttcaacgctggttccgcgtttgccgccaatggcaccgcaggctacgcttgggtttccacttccgctgcaaccgccgccgcaatgctctcttggggcttcactgagaagatccgcaccggccactacaccgccatgggtgccgcttccggcatcgtcgcaggtctggttgccatcactccggccgccgatgtggtttccccgctgtgggccatcgtgctcggtgccatcgccggcgtgctcacctgcctcgcttgcggcctgaagttcaagctcggctacgatgattctctcgacgttgtcggcgtccacggcgtcggcggcttcaccggcactgtgctcatcggcttcttcggcgaaggtaccggtctgttcgcgggcggcgactggaagcagctggttgtgcagctcatcgttgccctcgttgccatcatctggtccgctgttgtcaccggcatcatcgccttcgctctggagaagacgattggttggcgtgtcaccgaagctcaggaagtcggcggtatcgatcttgccgatcagggcgaacgtgcttacgattttgctggtaccgccagctctgttctcaaggaggtgaagtgagatgaagctcattaccgctatcattcagccgcataagcttgacgatgtcaaggaagccctcgctgccgcaggtgttcacggtctgaccgtgtctgaggctaacggttacggccgccagcgtggccacaccgaggtttaccgtggcgccgaatacaccgtggatctcattccgaagattcgcgtcgaggtgctgtccgatgacgccgatgccgagactctggtcggtgtgatcgtcaagtccgccggctccggcaccatcggcgacggcaaggtctgggttgccccgcttgattcggtgacccgcgtgcgtaccggcgagaccggctctgccgctatctgataattcattcggatagatattaagggcccccgggcttgggttcgggttatcaatagacagatccccgtacgtgcttcgcgccgtgcggggattttcatacgtttttcgcgtcagattgtctgcttcggatttccccgctttcgcttttatctgctcagatttgattgtttttgcgaagattcataaggatttgctatgacttcagcggttgatggtcttaaacaacgtttcatggatatgagtcagccggatgtcgacggcgtgtaccgcaatggtgcggcgaaacgtaaggctcgtacggatctggccatggattgcctgacgaagttgtggcaggaggcctgccagacggtttcttttgacgttccgcaagctggtattggtcttggcgcggtgggttcgttggcccgcggccaagtgggaccgagttccgatcttgatttggtggtcatttatgagcctcacgcgctcactgaccggcagctcaatgagcttgccaacaaattgtggtatccgatttgggattcgggtcttgatcttgaccagtcggtgcgtacccgcgtgcagtgcgaggcggtcaccgaccatgatttgcctgccgcgatgggttggctggatgtggtgccgatcgcgggcgatacgcagctgatcgaatccacggccgtctccattttggagcgttggcgtagggccgcccgtaagcgcttgcccgaattgttgggctccgccaagtctcgtttggatgagttcggccgtatggcgtatagcaatcagcctgatattaaggagtcccgcggtggtttgcgtgattccgtgctggtctccgcgcttgccgcttcttggcttgccgaccgcccgcacggccagtatgacgatgccgtcgaacggttgctggatgtgcgcgattgcattcatttggtggccaataaagacacgaacatgttgcttgctccttatcaggcgagggtttcggcgatgttgggtttggctgatccgacgttgccgaatggcgagcgtgaggcgaagtcgattgatgatttgcagacgttgcttgcgcgtgttggtcgccagatcgcgttttcgcttgattccacggcttctcgcgctgagcattcgttgactcatgagaagcctcgttttgcgtttttccaggtgttccagcctcgtggcggcggtaagcgtcaggcgcctacgtttgatgtgattgcgcccggtatcgccaagcatgaggaggagatcgtgcttgcgccgggtgccgatccgaagtccgatccgtgtcttgcgttgcgggctgctgttgctgcggctgagtttggtctgccgatcgcgcccggcacgttgcagaatctgaagtcgtgtccgatcgatgatcgcacgtggaatgatgagtcgcgtagtctgttcttgcgtttgcttgcgagcggtcccgcgttgttgcaggtgtgggaggagattgattttgtcgatattccgggtcgtttgattccggaatggttggcgattcgtaatcgcccgagtgcttcggctgcgcatcggtatacgattgaccgtcattcggttgaggtggttacgcggcttggtcgtgaaacacctcgtggaaaccgttatgatgatcggcattatcaggcgttgctgttggctggtattttgcatgatgtcggtaagcgtccgggggttttcgatcatgcggcggagggtgcgcgtcatgcgtccatggtgttgaagcgcatgggttttgaccgtgacattatttggtgggtcacgttgttggtgcgtgagcatcttacgttgtcggagtttgcgactggtcagaatccgaatgatcctaatgttggtgacgagttggcttctcgtcttgatcatgatccgctgctgcttgacatgctgttcgatctgactcgtgctgacggttcgtcgttgggtgccacggccggcgagaccatttccaaacagtacggctggagtaaatggcgcgaaacccttgtccgaaccatgtacaacgccacccgctaccacatgtgaggccgcgtaggctgtgagtgaatgcccggcaaagcgacatggctgccgatgcggtacctgccgcgtcgtcggaaacccatcgtttaagaaaaagtggggaacatatcaccttcggttcacttaagcaagtcacaaccgggggaatgggcacccgtacgaaagatgtccccaagttgtccacttggttatccccatttggtggataactcgatatgttttccacatagttatccccagtatgtggataactcgggttttttcggctttcttatccacagcgaaccgattcgcgcgtgtcgggtgattccgatcctgccaatgcggagattcctccagaatctcatcgcaacatcattcgtgaagtggcacaggtattatggtttttcccggtacaccacacatcgaagagctggagaagcatggcggagagcaattcttggaacaatggcctgaatcaagggcaaaaccgcggtttttcaggcaatggcagcatttccggcgcgtcgggaacggctattcgcgacgccatcttcgaccgtgtgccgccacatgacgacgccgccgaaatggcggtgctcggcggcatgctcatgagcaaagacgccatcggcgaagtctcgcagatgattgacatcaccgacttctaccagccgcgcaaccaaaccgtgtacgaagccatcatcaacctgttctccgcatcgcagcccgtcgacgcggtgctggtggccaaccagctgctcaaagacggcgacctcgaaaaagtggggggatccgactatctgcacagcctcgtcgcatccgtgccgaccgcagccaacgcaaccttctatgccgacatcatccaccagcgtgccatcctgcgcaatgtgatcgcagccggcaccaaaatcgcacagctcggctacaccgccgaaggatcccaagccgaagacgtcgtcaacctggcacaggccgaagtctacgaaatgtcgaccggcaaagtgaggcaggattacgcgccgatcggcaccgtcatcaccgacaccctcgaccaaatcgaccgactgcaaaacggcgaggtttccaaaggcgtgccaaccggattccgtgacatcgacgacgtgacgcaaggcctgcagccgggccagatgatcgtcgttgcaggccgaccggccatgggtaagtccacgcttggcgttgatttcgcgcgagctgcggcgctgcaccacaatatgacgtccgtgatcttcagcttggaaatgagcaaaaccgaacttgcgcaacgaatcatttcggcggaagcgaatattccgctgtcagccatgcgccgagcggaagaaatcacgcaggaacgttggaatatcctcaataatctgcaggataaactgcagaacgcaccattattcatcgacgatagtccgaacatgagtttgatggagatccgtgcgaaatgccgccgattgaagcagacgaacgatctgaaattagtggtgatcgattacctgcagctcatgacttccggcaaggccgtggaaagccgccagcaggaagtgtctgatttctcgcgtgcattgaagctgcttgccaaggaattggaagtgccggtggtggcgctgagccagctgaaccgtggccccgaaatgcgtcaggataaaaagccgcagctttcggatttgcgcgaatccggttctatcgaacaggacgccgacgtggtgttcctcgtgcacaggccggacgcctacgacaaggaagatcgcccgggcgaggccgatatcatcatggcgaagcatcgtaacggtccgacgcagacgttcaatctcgcgttccttggcgcatactccaagttcaaagatatgccgcaggactaccagagccaacaggaggtatagcatggcgtggaactcattcgcaacgccgttgatcggcaaagccgtgcgtgcggcctcccgattggcgcatggcggcggcagcgcgttccccggcaaaatcgtggaacggatcgacccgcaattcctcgcacgcaccctgcagcagctgccgcttggcgtggtgctcgtgtctggcacgaacggcaaaaccaccaccacgcgcatggtggcaagcatgttggaatcgttgggattgaaggtattcaccaatccgaccggatcgaatttcacccgcggcgtggtctcgtcgctgctggccgaagtctcgctcggcggcaaactggacgccgacatcgccgtactggaactcgacgaagcgtacgcggtgcatttcgtcaaacaagtgcaacccgactactgcctgctgctcaacgtgatgcgcgaccagctcgaccgtttcggcgaaatcgacaataccgcacgactgctgagcaaagccgccgaagcgaccaccggaaccgtagtgctcaatcgtgaggatccacgcatcgcacgacttgctgacgtcgcacatactgaagatggtgtggaagtgcgctatttcggtcttgacgggtcgttgcgcagcttcttcccgtccgacgacgacatgcgcacgacagtcgatactgcatcgtccgctgatactgcatcgtctgaatctgcagaatcgtccgcaaatattgagattgacgatgcttcggcaatcgcgaaaactggggaaaatgcagaaaaatcggaagatgcggcaattgcggaacagctaccagctgacgtgaccttgcttgccgtgggcgaccatcgtgccagtttcggcatcgacggtgaaacgtacgaaaccggtgtgagactggaaggcgtgtacaacctgtacaacgcggcggccgcgctggccgtcgtgcgagcggtcgtagccgatgcgcaagcaatgttcctgccgttcgagcagaacgtaaccgacgaactattgcgacaagtgggaatctcacagcgcatgatcgacttcgcgcattccaccacgcaagccatgatcgacgcggcagccgaagtcactccggcgttcggacgcggcgaggtcatcgacgtgaacggctcgccggtggagctgctgctcgtcaaaaaccccatgggattccgtctgtcgctcgcatccttcacccctgaaggctgcgacaccatgatcgccatcaacgacgaatacgccgacgggcgtgacatgagctggctgtgggacgtggacttctcctcgctgcgagacaccggtgtggccatggtttcgggcgtgcgtgcctgggacatggcgttgcgcctcgaatacgatcaggtgccggtgaatagcgtcaacacggaacttgaagaggccgtctcaacgttcgtgaacgcgaatccgggcacccccaagcacatttactgcacatacacggcaatgctcaaaacgcgagccgcgctcggcaaaatcgccgaagtcgccgacgctggcgtgggcaaataacagcgcgaatccgcgcaacgcatgaaaacgcatgaagaacgtatgaaccgcatgagggagacgatatgagccaggtaatcgacatcgtgtcgctatatccgaaagacatgaacatttacggcgactccggcaacgtgctcaccatccagcgccgtctcgccctatacggctacgagccgcgcgtgcacgcctacaatcagggcgacgcgtggcccgaacacgtcgacatgattctgggcggcggcggccaagacaccggccagaagaaaatcatcgacgacttcttcaaacgcgccgacctgctgcgatcgctggccgccggcggcacccccatgctcatgatttgcggtctgtaccagctgttcggcgaatatttcgaaacggtggatggctcccgactcgacggcatcggcgtgatcggcgcgtacacggtcgggcaggaagtgcgcatgatcggcaatctgaccgagcattccgccgatttcggtgacatcatcggctacgaaaaccattccggccaaaccttcctgcgcgaaggcgtgcagccgctcggcaccgtcgacgcggatagcaccggcaataatggcgaggatcatacggaaggcgcccgcgtcaacaatgtgatcggcacatacatgcacggctcgctgctgccgaaaaaccccgcgatcgccgattttctgatccgcaccgccgcagaacgccggtatggttcgttcgatccggccgctgcagggcagacggaagcgcagcgtgcggaacttgatcgcatcaacacgattgccagcaacgcgcgtcgcgtggccatgtcacgcccgcgctgattgtcttcgcgctgtttcgtagttttcgcgttttcgtacgctgtgagcatacggcagcgagtcttccgcagaattgtaacgattgactagtttcgttgacgttatttgtgaagaaaatgcgatagagtgggtaccaccatcacctaaggaggtaatcatggctgattttgattttggtgacggcctgcgtaaggtcttcctcgccggcgttggcgctttggcgaccacggttgagaagagccaggaaatcgttgacgatctcgtcaagaagggcgagctgaccgtcgaacagggcaaggccctcaacgccgaactcaagcacaaggtcgcggaggtcaaggaatcctctgaagccaaggctgcagaggaaaccaaggaagccgaacctgaagccaaagccgagtaacgttcaatcgttcacatcgccgtctgctcgtcgcatcacgttcagacggcgatttgttatgcggaacttgcgaaacatgcgaacggccgtgtgcggaacgtaagaaacgtgcgaaacatgcgaatcgcatgaaatacgcgggacgcaagtctcctcatgaatcccactcatcgtaatccgaccaacgtttgcgagcagcgatatgtctttgaattctccgatcgagccggatgcggcccgacccgaaagcgtggagccggtcacactttccgaccgagtcaacgcggtgatcaatccgacggcgaacccctcgtccgacgcggctgcggcaacggcagccaaatccgcgggaaaaacgggaatcccgcaatcgcaaggcaagcagaacgacgcaacctttacgcaatccgaaaccatcggactgttcggcccgcgtaaagactcattctcgcagcgctaccacctgactcgtcgaggcaaactgaagcgacttgcgcaaatcgcgcaaatcgtcaaccaattcgacattgtgcacggcctgacccccgtcaaaatgcggctcatgttcgaagcgcttggcccaactttcgtgaaagtcggacagatcctgtccatgcgctccgaaatcctgccccaatcgttctgcgacgaactcgccaaactgcgcgccgacgccgaccccatgccgtacggcaccgtcctgcaagtgctggaagacgaatacggacgcccggcaggcgaaatcttcgaccatatcgacgccacaccgctcggatcggcaagcctcgcgcaagtgcatcgtgcgaaactcactaccggagaagatgtggccgtcaaagtgcaacgcccgggcgtgcgcgaaaccatggcacaggatgtgtccatcatgcgcaccatcgcacgaatagccgccaaaaccatgcccagcgcccaagtggtcgatctctccggcgtggtcgaagaactgtgggacaccttcgaagccgaaaccgacttcatgatcgaagcgcgaaatctggcggaattcaaacgattctgcgaacactacaaatacatggactgcccgaagccatactccgacctgtgcaccgaacacgtggtggtcatggactacgtcgaaggcatttccgtctcgcatcctgatgagctcatcgaagcgggctacgatctgaaggaaatcggcaccaaactggtcgacaattacgccacgcaagtgcttgacgaaggcttcttccacgcggatccgcacccgggcaacatcatggtgcgcggcgggcggatcgtgctgctcgacctaggcatgacgggccggcttaatgccaaaacccgttccgtcttgaaagacatgattttcgcggtcgccaaacaggattcgcccgcgcttgccgacggtctgctgcgtttcgccggtgccgaggccgatccggaggattatccggcgttattggccgacttggatgtgatcgtcaaggaattcggcacagtggatttggccgagctggatatcgccgccatgctcaccgcgttgacgcaaatggcgcaacgacacggcattgaagtgccgagcaccgtcaccaccgtcgggcgtgcgctggtcactttggaaggcctgctcgacgagttcattccagacgtgaatatgattcagatcatctccgaccatatcgccgcaagcacgtcgaagaaggatttcgccaaggatgaggcgaaatcgctggttatcgaaggtcatcaggcgctgcacagcctgctcgctgccgccaatgagctgaaagtggcctcccgtatgcttacgcgcggccagttgcgcgtgaatatggagatggtcggttcgcaggaaccgatccatctgcttgccaacatggtgaacaggcttacgatggcgctgatcgtcgtcggattgttcatcggctcgtcgatcgtgtactatgcgggcatcaaaccggtgattttcggtattccgatcgttggtttcctcggctatgtgatcgcgttcgttttgtccgtctggatcgtgttcgacatttacttcaagggacgttccaacaaaaaacgatgacgctaggctagggggagggtggattcgcgttggatgaggcggcagggaaggtattccgtgccgtggtggggctggccgttgatggcgtccatcaggtagcgggcggctttgcggccgatgagttccgtttcattgtcgatgctggtcagcggcgggcgggagctcttggtgagcacgtcccaattatcgtggccgatcaccgccacatcctcaggaatgcgtagatgctgcgacttcaacgcgtcaatgcatcctcgtgccagctgatcgctctggcataccacggcgtcgaacttcacgccttggtcgagcagcagtctggtggcggcacgcccccaattctcgtcccaacggccatagcgaatcgggccagccggttccaaaccaacctcggccaacgcttccaacgcgcccttggtgcggtcggtggaggccgtatacgtttcatcgccgccaataatggcgatacggttgcgtccgcacgaaatcaaatgattcacggccatgcgcccggcgtccacattgtcacacgtcaccgaacaatcgttggtgtcggtggaaggaccatacacatacaccagcggcacgccccaatcacgccccagcgacgggcgcggattcgtctcgcactgcacaatcagcaggccgtccactttcagcgacagcagtttctctacatggctgcgttccagcgcatcgtcaccgcgagcattggcgagtagtaccgatgtcgattgtgcgcgcagctcgttttcggcgccaataagaataggcgtggagaaacggccttgcagatcggaagtgaccaaaccgatggttccgcttctgccgcttgccaacgattgcgccagcttgttcggggaatagttgagttgccgcgctgcctccatcacgcgctcgcgggtgtcttcactgacgcgcggtttgccatgcagcgcctttgaagccgttgccaaagacacgttggccagcgctgctacatcttcaagccttgctgttgagtgagtatctgcagttgccatgatgttccccttttttacggtgtgacgaaaacgttggctgcgcgtcgatgcgcttcgccgcccttgtattgcgtaatattatacgacaaaactgcgaaagttttcgcattgtgtcaaaaagtggacaaaacggctttatatagccgattgctgacattttcacttgcaaattgcgaaactttcgcatttgcgaaaatgaacacatttttctttcgcattttctgcatctcacgtcattttttgctgtcataaacgattcttaaaatgctaagaatcgtttatttataacggttttatcgatatgaatacctttgcattctgatgtgcgaaagcgattttgcaaaatctggagaaaaccatatactgagaaaaggctttcgcactacggttcaatcgaaggagaacaaccggaaatcgtgaaggcagacggcggaaggcccgccggatggctcaaagctgagcgatacatagagaaagaagtagacatggtgtctttcaacaaggtcactcgcgttattgccggcatcgcggcaaccgcgttgcttattccgatggctgcatgcggcggtggttccagcagtggtggatccgcggctccggccgatattccggcagccggcactgatgacggcactgagatcactctgtggacccgttctccgctggagcgtcaggccaagaacgcggtgaaggcctacaacgcctcccacaagaaccaggtcaagctggaaatcattccgaacgacgatatggaaggcaaggttggtggtgcttcccagaccgattcccttccggacattctcgccggtgacgtggtgcgtattccgtactgggcttctgaaggcatcttcaccgacatcaccaagcagatcgacggactcgacaacaagtccgacctgcagcagggccacattgaagccggtaccgtggatggcaaggaatacacgctgccgttcatcaccgacgtttccgtgatggtatggaacaagaatctgtacaaggaagcaggtcttgacccggagaagggtccgagcagcatcgacgagttcgttgagcaggccaaggcggtcgcggccctcaacaaggacggcgtggcaggctcctacttggccggccagtccggtggcgctctcgtgttcgacctgttcccgtccgtgtgggctgacggcgaatccgtgatgaacgcagatggcaccgaagccaccctcgacaacgattccatgaaggccgtgctcgacgcctacaaggaactcgccaacaccaccaacggcttgggcgcaggttccaaggaagaaaccggtgccacctggaccgctccgttcgccaacggcaacatcggtgtgatgccgtatccgaacacctcctccaccgcactgttcgaagctgagaaggacggtggcttcgaagtcggtgtcaccccgatcccgggcaccaaggaaggcaagacctccacgttcctcggcggcgatgccatgggcatctccaaggactgcaagcacgtcgctcaggcttggaacttcctcgcatggctcatgagcgatgacgcccagaaggaagtcttcgcagccaacggcgacaccgcatccaacatccagaccctgaagaccgcctacgacgatgccgatcctcgcgtccagaccatcaactccgtaatcatcgacggcaatggccagaccccgaagtccgcagctttcaatgaggccttcaacgcagccggttccccgtggcagctgctcatccagaacgcagtctggggcgatggcgatctcaaggccgacaaccaggccatcaccgacgtgctgggtcagtgaggtgagccactgaaaacaaacttctcctcctttttctcctttccccgatttacataacttaagaacaactgaatatcgaataactgaatatcgaaaacaaaaatcgacagaccacagttgtggtctgccatggagatcgacaataattcaaaaacaatgtcggtcttcatggcggatttcaacggccgcacgagacggaatcgcacttccaaacgcatatccaatcgcttggccatttatgtcgaaaaccccgaacgattcaagagagagtcgccaaaagtgttccaaggagggaatatgactactgtttccaagaacgctgcgccagtgaagacgcatcgttccaaggccaaggcggaggcaacccgtcgtggcctgctgtatgcgctgcctgattggctgatgatcatcatgctgttcttcgtgccaatcgtgctgctcgtcatcatggccggttcccgctggtcgttgatgggcggtaaccgtggttggaatttccctgagaatttcgtcaaggttttcgaaaataaactgctcggacagtcggtgttgttcacacttgaatacaccgtgatcgtcacgattttcctgctggtgctcggccttggcctggcgctgatcgtgcaggaaagcaccaagtggaacaatatgctacgcacgtgcttcctgctgccgtccgcaaccggtctcgcctctgcttcgctgctgttctacgcgctgtactccccgcaggtgggccccgtcaccaagatcctgagcttcttcggattgatggatgagggcggttccgtgctcgccaccggccagagcgcgctgtgggccaccattattgtgatcgtctggcgtttctccggctactacatgctgctcatgatgatcggcctgcaagccattccgggcgacctgtatgaggccgcgcgcatggacggtgctggcacgtggcgcattttccgttccatcaccctgccgctgatgaagccgaccatcgtgatgtgtctgatctactgcgtcaccggttccatcctcgcgttcgaccagttcttcattctgaccaagggcggtccgaacaattccaccatgaccgtagtgcagctcatctataacttcgcattcgattccaagaaggatctgggcatggcggccgcactgtcgctgatcgtgcttgcggccctcgtggtgatcaattccatccagatgcgcggtatgcgcgacaacaccaagtgagcaaggggagggaactcacatgactactccattgtggaagcgcgtaatcgtctatattctcgaaggtctgctggctctggtcttcatttcgccgctgatctgggtggtggtctgctcgttcagtccgcagcctggttccgcacaatccaagggctggggtgtgaacaactatctgacgttgttcggctaccaggaaggcctgccgaagtacctgttcaactcggtggtggtgacgttggtcgccgtggtgttctccgtggtggtgtgcacgctcgcaggctattcgttctcccgtttcgactatccgggccgcaatctcggattcatggtgacgctgtccattttgatggtaccgtatgcgtctctgctgattccgctgatggtgtggtacaaggatattggtctgaacgattccttgctgggtgtcggtttggttattaccttgttccagctgccgatgagcacgttcatcatgcgtaatgctttcgatgcgattccgaaggatatggaagaggccgccatggtcgatggctgcaactccctgcagtcgttgattaagattctggtgccggtcgtcaagccgtcgatggtcactgtcggtctgcttgctttccttgaggcttggaacaatttcatgattccgctgtacctgtcgagttcgtcgaacgccacgctgccgctcgctttggtgaacatgcgtcagcagactatgggcgtcattgattacggtgccaccgaagctggcgtcgtgattctgatgatccccgcagccatcctcttcctagccctccagaagtactacgtcaaagggtttatggctggagccgtcaagggctgacacctggcgatgtcagcccttgggagacagcccagtggactgtttccaggctccggcctgagcaaaaccgaaggcggagtagccaagagccgtcaagggctggcgaagtccttaatcttaaggaaatatcatgaatgtaactattacttctcctttctggaagcagcgtcgcgaccagatcgttgaatccgtcattccctatcagtggggtgtgatgaatgatgagattgccactgaagttccggatgatccggctggcaatcagcttgccgataataaaagtcatgccgtggagaatctgcgtatcgcagccggtgatgaggccggtgaatttcatggcatggtcttccaggattccgacatatataagtggttggaggaagcggcttacgcactgtcgtatcatcctgatccgcaattgcgggaactgtgcgatgaaaccgtcgacctcatcgcgcgtgcgcaacaatcggacggatatttggacactccgtaccaaatcaaaaccggtgaatgggcgcatcgtgagcgtttcacactgattcagcaaagccatgaaatgtatgtcatgggccactatattgaggctgctgtcgcctatcatgaggtgaccggtaaccagcaggcgcttgacgtggcgtgccgtatggcggattgcatcgatgccaatttcggcccggaggacggcaagatccacggtgctgatgggcatccggaaatcgaattggcgttggcgaagctgtatgatgcgaccggtgaggagcgctatctgaatctggcgcggtatctcatcgacgtgcgtggtcaggatccgcagttctacgccaagcagatcgccgctgtcgacaacgactacattttccgggatctgggattctacaagcccacgtacttccaagccgcgcagccggtgcgcgagcagcagaccgctgacggccatgctgtgcgcgtggcctatttatgcactggaatcgcacatgtggcgcgtattaccggcgatcagggcttgctggatgcggcgcatcgtttttggaacaacatcgtgtcgaaacgcatgtatgtaacgggtgcgatcggttccacacatgtgggggagtcgttcacgtacgattacgatctgccgaacgacaccatgtatggcgaaacgtgcgcttctgtggcgatgagcatgtttgcccgccaaatgcttctgttggaaccgaatggtgaatatgccgacgtgcttgagcgtgagctgttcaatggtgccatcgcgggcatcagccttgatggcaagcagtattactatgtgaatgcgttggagacttcgccggacggtttggacaatccggatcggcatcatgtgctttcgcatcgtgtcgattggtttggctgcgcatgctgcccagctaatgtcgcgcgattgatcgcgtcggtggaccgttatgtgtataccgaacgtgacggcggtcgcacggtgctcgctcaccagttcattgcgaatcaggcaagttttgattccgggttgcatgtggagcagcgttccgattttccgtggaacggtcatattgagtacatgctggaattgcccgctgaggcggctgattcggtacgtttcggcgtgcgtattcccacatggtcggctgattcctatgcgctgacatgcgatggtgttgctgtgaagacggctccggaaaacggtttcgtatatttcgcagttgctccgggaactgcattgcatgtggtgctggatcttgatatggcagtgcgattggtgcgtgccaactctcatgtgcgttgcgatgcaggtcgtgttgcggtgatgcgcggtccgctcgtctattgcgcggagcaagccgataatgccggcgatctgtggacgtaccgtcttgctgatggcgtggatgctgcggatgccacggttactttcgagagtgatttgcttggaggtgttgacgcggtgacgttgcctgccgttcgtgaggctgcggatgccgtggacgccccgttgtacatgtccgctcagcgtgacgcctcagatgagcggacgtcgctcaagctggtgccctactacgcatgggccaaccgcgaactcggccaaatgaacgtgtggttgcgcagctaaacaaaagaaagacttgctacccggcgctatgggtgccatggtgccgggaagcgggtgagcgcggcgtgatcgattggagccgaatgcgccgcgctgactggaatgagagaccggctgccccttatggggtggccggttttgtcatagcccctagtataagacgggaaaatgcgaaaactttccttttcgcataaaagccatcgtatggcagttcacttagaaaagcattggagaaaactgaaagaaaatttgcgaaaccgtattcgcgtcatgtattcttgaaatgtcggtggacgctccaatctcatgtccatcgcacgactctcattcctacagaaagaaagttggatgccagggaacgagccttggcaaccaagggccaacgatggtccatgtaggaggaattgatgacaccatcaacaaggaagaaagggattgtcacgtcattgggcgtgctgacggcagtggccacactgttgtctggcggtgtgacgaccgcatacgccaatgacgcgctggccaatccgaactctgccatggggtatccgagtttcaagggggccgccgacccgattccgggcaccggcgtcgctttcgatccctcgacaagctacctcaagcaggtgttcgatgcggatgttgccaacggtgccggaaccgacaccgcacacgacttctggatcgacaagatgctgacgcgcacaggcaccgcaccaaacggtaccggcaccaacgatgctggcgactacaactatgcgggcgcagacaagaacgaatacctgttctcacgtggccgtgccgcattcatgtacacgcatacgccggaagcacttggtttcgtaggagatgtcgcatactgggatcagaccggcaacgacggctttaccgttgaggtaagcattggcggttccaagcagaccctgcgcgagaacaccgacaagcgcaagcagacgccaagctacttcaccacggaattcaccaacggcgacaagaccattaccgtcaccgaagtcaagtacatcacctacaccaatgtgatggtcgcgaatttcaccatcaccagcaccaccggcggtgacgtaacgctgacagcagcctcgccattcgcacaagacggcaatgacggcgacactgaactgaccggtcgcttcaatgtgaagaacgatctgaccaccatctatccacggttctccggcaacggtttcaccgtaaaggacggcaaactcgcttccaccctcaccttggaagcgaacgtgccacaaaccaccaagctgcagcttggcctgatcgccaacgagttgccggactccaccgcggaatacgaagcccgattcaacggcgatctcaccgatccggccgcttcctacaaggattccgtgaccacctacaaccagtggtgggtcgataacattccttacgtggaaacccaggaacacaatatcgacaaaactgtgttctaccgctggtggctgagccgtttcaacatgttggacgccaatatgccgggcaatacgttccagtatccgacctccatcgaaggcgtgctcggatacaacaaccagatcgtgctgacatccggcatgttcatcaacgacaccaagtggttccgtaacgccgaatactcgtacggcacttgggtgtcggccgggcagacagccaagaaaggccagtccgggtattactactaccacgacaatccgggcgatccagccaattggaaccacagctacacgcagtacatcaccaaggccggttgggactcctacaaggtacacggcggcccgtcatcattggctgaagcgttgggtgattacggttccgaagatgtcaaaggtctgctcaattcgcaaagcgagccagacagcaacgacaaccagaatagcaacggcaacaagctgatcgactggtcgtggtggtccatgaccggcaacgatgccgacgcggtgtcgttctccgaacccggtcgttccggccagcgtatggaccgtgccgacggttccgccaacatgtgggccaacgccaatgccgccgcgcaagcatacaaggctgccggagacaccgaaaaagccgctgaaatgcagcagatcgccgacgccatcaagcaggatgtgctcgacaacctgtgggattccgacagcaaactgctgctgcacaagtggctgaacgacggtcaattcgcgaaatacaaggaactcaacaactactatccgtattccgaaggtctgatgccgatcggcaatgatgattacgatagtgcgttgcgcttgttcgaagatgccgacgaattcccgattttcccgttcttcaccgcgaatcaggcagacaagaaggcgctgaatttcccaggatcaaacaatttctccattatcaatgcaactccgctgctgcaaatctattctgcgggaatccgtgattataatgctgcagacaacggatatatcacgaacgaatcgttcaagaaactgctgtattgggtggcgttctcgcattatcagggaggcgacaaccagtatccggaccagaacgaattctggaatatggataataattccgcaggaagcacgattccggagaagaacgccgacgccagcaagaacggtggaaagatcacctaccgttcctggattcaccacacccagcttggcaccaccaactggacgattgtggaagacgtggcaggtatggttccgcgtgaagacaacaagattgaactcaatccgatcgagattcccggttggaaccacttcaccgtcaacaacctgagctaccacgggcaggatctgtcgatcgtatggaacaacgacggcacctacaacgctccgaagggatacaccctgtatgtggacggcaacgccgtgttcacctccgataagctcgcccacctcatctacgatccggccagtggaaccgttgaggttgccgatgattccggagcggtgatcaccggcgcgaccaccgccaccatgccgaacgccaacgaagtgacttacgcatcgaacagcagggttacgcagatcttcgcgcagtccggacagaacgtggacgaagcgtccaagagccaggccaacgtggccaaggacgccgatgtggaagccacttacgaaaccaagggatacccggcaaccaatgcagtggacggcaagaacgtgatggaatccttctggggcaccaagggatccaagaacgccaaggattcgctgaccgtaacgttcaagaatggcgtgcagaacatcgacgacgtgcgtttgtacttctaccagacctcgtccagccagacgattgccggctacagtgagccgtcggtgtacacgcttgaatatcaggatgaggccggcgcatggcatgtcctgccgaaccaggtgcgtacgcctacttacgcgggagccaactacaaccgcgtgcagttctccaaggtcgtggccaaagccattcgtgccaccttcactccgcaagcaggtcaggccattggcttgaaggagattcaggcctacgaaaccgacattgtgccggaagacgaacctacgaaccaggcgccaagcgttgacgcctacattgccagcagcacctcgtccggtgcgcagctggtgggcacggtgaaggacgacggcctgccgtctgacacgctcaccaccacatgggagcaggtgtctggccctgaaaacggcgaagcgaagttcgtcgacgcaaccgctgccaacactacggtcacgttcaaccgtgagggtgactatgtgctcaaactcaccgcattcgacggtgagaagaccggtttcaaggaagtcaccgttcacggcattccttccgacggcacggtgaatgtggcttcacagtccactgcgagcgccagcttcaccaatccatatcaggcgaaggacaatgccaaaaaggttatcgacggtcaggtgttgtataccaatactccgaatgagacctggaataattggggtgacaataccggtaccgagccgtggctgcagcttgcctgggatggcactgttccgttgaagaaggcgaagctgttcttctggactgacggtggcggtgtgccgatggtcaagtcgtggaagttgcagtatgcggatgagaatggcgattggcaggatgtgaagcttgccgccggccagtcttataccacgatgcagggtgaaggcaatgaggttcgttttgccgaaacggtggagacgaacaagttgcgtgtgctgttcccgaagggtgccattgttggtgctaccgaatttgaggcgtatgcgcttgatccggtgagcgtagatggcgtgaatcgtatggtgcagactggcagcaaggctgccgatgtgaatctgccgaagacggtgagtgccagctatacggacggttcccgtcgtgacttgagtgttgcgtgggatgccatcactgacgatcagcttgcttccgatagcgagtttgcggtttccggaacggttattggcgcgctcgctggaaccaaggccactattggcgtgcgttccgacgcgcagtctcagactgctggtgcggctcagccgatcgaacagacggtgtaccagaattccaagtcggtggctttgccgtctgtggttccggtgcgattccccaacggcatgcttgacgatcgcacggttatgtgggatgaggcaagtgttgccggcgtcaagttggacaccatcggcgattatgaggtgtccggcacggctgagggttcaagctcgcaggccaagattacagtgcatgtggtcgccgatccgaatggtggtgccgatcctgatcctgagccgacgccggatcccaagccggagcccgatactccgttgactggttggattgaaggcagggccattgacaccacggtgagtgccgaggcgagctggtctccggcttccggcaagctcaacgatggtgtgctggttgacgatacgtggccgtctgatgatgacgccgatgtgaatggccgcgtgtggggcagctggggtcaagcttccgctggcatgtacgcgcagtacacctggagcaaggaagccaccgtcgattccagccgtgtgcagttctgggccaacttcgcggagcgtaatgatgccaagggtggtttggatgttccggacagctggaagattcagtacttggcttctgatggtatatggaaggatgtggagaatgcgcaatactccaccgtgcgtaattccccggcctcacgtgcctctgacgatgctcaaggctggagcgtggccacgttcactccggtgaagaccacgtcgttgcgcttggtgcttgatccgccgaccgccgagggcgtcaccttcggtctggcggttgccgagtggggcgtgcatgctgcggaaagcactcctgatccagaaccgactcctgacccggatccaacccctgatccggaaccaagcgtggacaagagcaggctcgaatccgccatcaacgcagccggttccgtgcaacaagctaatttcacgccgaacagctggaaggcattctccgaagccatgggtaacgctcaaaaggtgtatgcggacgagagcgccacccaggatcaggtggatgcggccatcaagcagcttgaagaagcccagcagacactggtgaagaaagccgacaccactgagttgaagacggttcttgaccaggcacagggcgtcagcggtgacctctacaccgaagccagcgccaagaagttggctgaagcagtggatgccgcctccaaggtgctgaacgatgagaacgccacccaagctgatgcggatgccgcagtcaagcagctgaccgaggccatcgccggacttgaactcaagccagcgccgaagccggacgacgacaagaccgaccccaagccgaatgccaagcctggaaacaagccggtttccaagtctgaagtcagtgccgcaatcagcagcaccggcagcaatgtcatcggcatcgccgtcgtaggaatgatcgtcctgctgacgggagccgccatcatgctgacgcgccgcaaccgcgactagcgctagcaattgctcaagtcctcttacggatcgcacgaggaataccaacgtagcctaagcaatccgtaagaggacttttcaatatccaatcgtgaaaacaggaatattcatgagcttttcgcacatctcacatgcgtcgatgaagacgctggtggcaggcatcgcagccgcagccaccttatgcacgggagcaatcgcaaccatgcagacagccaacgcggccgacgcaagtaccgcgcccagcgtcgccggacacgcctacaacgatctgccggtcggcaatcccgacgtcaccgtcacacaaatcgacaacagtgcgttgccggcaactcttcgcaaccccatcgggcagaacgaaggaaccaatacccccaacgacctgtcgcaaaactactattccgcagacgcatccacccttgaatacgatggcaaactcttcgtattcaccggacacgacgaggccgaaccaacctacgggtccttcaatatgaaagactggggcgtctacgtaaccgacaatccggaatccggcaaatggacgcactacaagaccatcgccaaagccgacctgttcgactgggcaaccggcgacggagcctacgcaggacaagtagtagtcgacgatgctggcaccgcagacacggccgacgactggttttactactacgtgccagtcaaagacaggaacgcagccgcgggagccgacccgttctccatcggcgtggccaaatcaaaaagccccctcggaccatgggtcgacgccatcggagcgccgttgctgactaccacgcagacgcaaatcgaaaccatcgatcccgcattcttcgtggacaatgacggtaccggatatctgcacttcggcaccttcaacagcgaactcgccgtaaaaatgcagcgggacgccaacactggccgcacctcatatgttgccgtggaaaccatggacggaacggcggacggagcgccgaaaatctacaatatgcgtgacgccgacgcgctcgccaacatacccgactacgatgccagcaaagacgtgcttggcagcgactatgcgaaccaagtgaacgcgtcgctgaccttgggcaacaacggcggcgcttatgccaacgggcccaaaggcttctttgaggcggcatgggtgttccgtgaaggagacacctactacaacgtgtacgacggtggcaaacccgggtcgggagtggcgacctgcgtggaatccaactatcaggcgtgcgtgcaatactccacgtcggcaagccctcttgggccgtggacgtaccaaggcgtaatcgtcgaatcgggatcgtccaccaccatgcatccgtcgattcaacgattcggcggcaaatggtgggtcacctaccacactggagacaagactggtggtactgacttccgccgtgcagtctgcatcgatgaagtgacgtggaatggcgggcgcataaacgccgtttcgcatccgaccaaagccgaacggttgcaaccctcacgcaacgtggccccctatgcgtcagtggacgcgacctacaccgaaacacccgcctacaagggttccgtgaacgacgggcgagtgctggaaactgctgtagtaccgccgaaccattggacgaactatcgaaagatgccacaaacacaatcctccgattcactgatctaccagtggaatggcgctgtacgtgtgaatggatcgaaagtctggttcgataccgatgcgaacgcattgcgtgcccctgcctcatggaaactgcaatatcttgacgcagacggttcctggaaggacgtgcccaattccagcgaatacggcgtggatacaggcaagaacgcgcctaatgaagtgacattcgacgcagtgaccaccactgcgctcaaacttgacatgaccgcgcaagccgttgacgggggctatgcttccgttggcgttcctgaatgggaagtatacgcgcaacagggagcagttgtggctgaacagccagccgacgtctacgccaagaccggagacgcgccggaattgtcgaacacggtgaaagtcgcgtacggctcggaaacagtggaaactccggttttgtggcgcacggtgtctgcttcttcgtatgcgcaggcgggtgagttcaccgtgcaaggtgtggttgctggcattgaaaccaagcagcaggctgatgatctgacagccggcaacgtagccgtgaccgtacatgtttccgacgattacgtaaaaccggctgataccattgctcctgccgtgcgtgtggcattggctggcacggctggcaatgatggttggctggtcacttcaccgatcgctcttattacggcttccgacaatgcggctgcgccgatcgcaaaactcgaacttgcggtcggggatggcgcatgggtgaccgtcggaacgaatgtgaacactgcggtacaggctgtgactggcgagggtatagtgagtgtgcgtgcgcgtgccactgatgcggccggcaatgtgagcgaaatcgctgctgcggaagcgcgtgtggatgctacggctcctacggtagccgcctcggtagatacggcttcccgcactatgacattgaccgcctcagatggtgctggatccggtgtgaaaacggtggaataccgggttggaaacggcgaatggcagcaatatgaagaaggcgcggcgattactgcttcttcgtcgaagcgcgaaacggtgagctatcgggcttcggacattgctggcaatatgtcggctgcgggcgtcaaagatattccatccgatacgtcggtgccgttggccggctatatcgagcaagatgccgttgctactgacgtggacaaaaaagcgtcttcttggacagctggtgttgccgcgcttaacgacggcaaaaccattccgggcgattgcacggttgataacgcctgcatttggggtacgtggccgaataccggtgaaatgaagctcgactacgaatgggatcgcgaagtcaccatcgattccagccgtgtgcaattcacctccgatggagggggcttgggaatgccggcgtcgtggaaactgcagtattgggatgctggaacgaatgcgtttgtggatattcccgatgccacatatacattggtcaccaatgctcccggcgcttacggtaccgataacggcggatggagcgaggcaacctggactgacgcggtgaagaccactaagctgcgcatggtgattcaatccggcagtgcatcgccggctgccgccgaatggcaggttcatgcacctgaaccgactccggacccgacccccgatccgacgcctgagcccgagccggaaccaacgccaactccaaagccgactccggatatcgataacaacggcaagcaggacggtaataatgccaagccttctgcgaaaccgcaatcatcgcagcaatctcagtctcaacgtaagaagaagctaagctctacaggcgtcgctactacggcaatcgtcattgccatgacggtgctggccacggcggggtgctgcatcttcgtagccaagcggggcaagctgcgtaactgaatccaacataaaagtggtaagttctcagcctcggcctctggactgaatatgtgtgcttgacgcactcaaggtaccgttacgcggtcttcgcggcaagccgctcacttcgcctgaggaaaacccactgggctttcctcttcacggctcagtggccaagtctacgatcaagcacacgtattcagccgccgacctttggagtccgacccctacgtttgtgtgaactcggacgtcatcggaccccattttgctcataactcgcctatgtatggcagatttgcgggtctgtcaggaagcatctcgcctatatatggcagaagacttcgctaaaaagccatataggggggtatgaaaacgcatgttttctgactccagtctgccatatataagtgagatgcctcgtgacgagactcaaaatctgccatatatagtcgagatatggctcggctgttggtggcttgagacggcgacatacgatcgcggatcgcgtaggtggtcgccgtttttgtgatttatgggctaatctcagaagagacagattcgatggccgcgaacggtgagaaccaacgcgagagaatgcgcgagcggccgcgtaagggaggaaagcccatgtccaaatcattcgtcaacaaggcgctgctcggcggcgcagtcgctgcaggcgccgcagtgtgggcgatcgcgccgcgtaccttctccgataagcgccgcaattatgtgccgtccattcccgacgtgtggtacgcgcatcgtggcctgcatgacgcgggttccggtctgaccgcgcagtatgccaacgagagcggcgagtatgtggcgctggcacgtcgcatggccatgaaggccggctatggcagccccagcgtgactggtgcgatcgctccggagaactcgcttgcggcattcgcagcggcttgcgaagccggctatggcatcgagcttgacctgcagatgaccgccgacggcgaaatcgtggtggtgcatgacggcgatctgatgcgcgtcgccggagatccacgccgtatcgccgatctcacgtacgatgagctgacccgcatcccgctgttcccgaccgacgcccccggtgccgccgtggcagcgccgttgccgggttcgcttgaaaatccgccgctggtcaccacacctgacagcgctccggaagggtatttccagcatgtgccactgttcgccgacgtgctcaaggtagtggcgggtcgtgtgccgctgatcgtcgaatacaagttcgacgacaattccaagtggggttcgcgcgatgtcgagctcatggaaaagggcgacgcgctgctgcaggcctattccggcgcgtatgtgatcgaatcgttcaatccggctgccgtcaactggtataaggagaaccgtccggaagtgtgccgtggccagctttcctggtggccgcagggggaggagaagccgtctgatccggcctcgctcgccaaggaatatgcggccggtgcgctgattttcgactggatttcccgccctgatttcgtcgcctacgattggcatggcggcaacagtccgcaggtacggttggctcgtttcatgggtgccgttcccgtgtcgtggacggtgcgcagccgcgacgagctcgcacagtgcgatgactggttcgaccatcatattttcgaagcgttcgtccccgacgagcagtagaggttttacatatgatttcggcctgccgccgcatgatttgcgttgtggcaggccgtttttattcgatttacttgattgactgattgggttgattcggttgagctctgatgcggtcagtcgatcacgccatatagacggtcgccggcatcgcccaagcctggcacgatgtagcacttgtcgttgagcttctcgtcgacggcgcacagcaccagcttgaacttaatggatgggtcgaggttctcctcaacgaacttcaggccttccggagcgcccagaatgcacacggcggtaacatcctttgcgccgcgctcggccaggtaatgtgttgctgcgaccagcgtgccgccagtggcgagcatcgggtcgatcaggaagcactgacggccgctcagatcgtcgggcagacggttcgcgtacgtgatctgctgggttgggttctcctcgtcgcgcttcatgccaaggaagccgacctcagcggacgggatcatcttggtcatgccgtcaagcatgcccaggccagcgcgcagcacaggcacaatgatcggcgccggggaagcgatgtgcttgcctaccatcggagcgacgggggtctcgatcggcttgtccacgacttcgacgtcgcgggtggcctcgtaggcctcaagcatcacgagttcggaaacgagctcgcggaacgtggaggacggggtgttcttgtcgcgaagaacggtgagcttgtggtccaccagcgggtggttcaaaacatgaatatccatgtcttctaagcgtagtccataatcgcgaggaaaagcgcgggaactgggaaaggagccaagaaagaaactgaaaatcgtatgaaaaaagcaacgaaacttaagaagagggaaagcgccgaaccacgaaagcgcctgtcggcgcaaaggccgctcgcagcggcaaaaaatggagcccggggctatgcatggcccggcgcgagttcctattctacagatgctgcagaccgtacgttacgtcgtgtcgcgaattgatggtgcgagcgccgtaaaacacttccggtagcggtacagaggtgggtgcagaggcaggtgcaggggacgggtacggaacgcgcgttactccagttttccgcgacgccacagattcgccccatggcgaaaatccttggccgtgacgaacagattgccggccgtgtgcatcaaacgggacgatttcgtacgtacctgcttttccatggcggaaatgccggaatcgctgctatcggaaccttccgcagctttcaatcgtgcgatcatattgcgtgcctcgatgcgcaatcccaacgcaaccacgtcggtgaacgcggccgcacgttccagcgcaaccgcaaaatcgccggtgaacgcgcctgcgagaatcgaatcggcaatatgcgcaatgtcatcttccgtgggcgcctgatcgacgccggcaatcgccgaggcggtagtggcaaccggctctccagcgcgccacaaccgcgcgatcgactcgcgattcttccgcatccacgtgcgcagcagatacagccgccacagaatgcccggcagcgaatccggctcggcgctgctccacagttcggcgatcacgtcaacgccctcgcggtccaccagcgtgagcacgcgctccaccagttcggcatcctgcgtatgatgcacgcggtccaacagtgcggccgccgaagcgtggctcatctcgttgatttgcgccggatcggcacctcccgcgatattgtcggccatcatctggtcgagttgccccgggcgggccggacgcggcgatccggtgttggtgaaaccggcggaacggcttggtacaaccgatccggaaccgtaatgcatgctagtagacaatgggcgaaaccttttgaatatcgataatgctgggaccttgcggcgtatcgattataaacagcgctacggcggtgccggtaggcatgaacggcgttttggcgatgagctgcttggagagcgctttgcgggcgcatagtccgcgcaagtgatcgaacatgcctccgataaccggtcggtgcatgcagatcgccgtggtttcgcgggtctcgagcgtgagctggatctgcttgaggaacgccagccatgcgatggtcgggtgctcggcgaaggcgtcttccgtgagcgcgtcgatgtgttccatcgggcgttcggtctgccagctaagcacctgcagtgtttcctggcagcgcagccatggtgaggttgcgaggcgggttgggttgtagcaggcgagttcgcggttgagtgcgaatgccgcggccgcgcctttcggagtgatcggccggttcgcgtcggtgcctttccaggatttgcgcgattcggccttggcatgacgcacgatcatcagattctgcgcggtcgcggcaccctcctgtacgcggtccacaaaaatggcgagggtgtctttatcggtggaatgcgtgaggattttacgtgcttcacgtacggaaacccacacgatatcgttgatttcgcctacatccgcgcgatgcacggggccgaatgcgtcaagcagatgttccgcatcatctccggaaatcggttgcgccatccaatacaacgtgtgcttggtgtcgacggcgcgatcgtgtgaatgccgggttttcttgccttcttcggacagtggatattcgacttcgcacagatacgggccgagtgcgatggaaacgcctgtctcctcgccgatttctcgcactgcggcatgacgatgcgattcgccctgctcgagtttgcctttcggccagctccagtcatcgtactttggtcgatgcacgatgcacacttcaatgctgttgagttgttcctttggagttttctgcgctgcgattgctggattttccgcgatttcgctaccggttttccaccgccatacaatgcccccggcggcttctacgacacgtctcatgctctcgctcatatctttcattgtaagtggttgggcacgggtttccccatgattgcgcgacggcaatcgtgccatccgagttttcctgcgttttcccacgatggtgatcgcgtatgccgcaacataggaaatggccgattctgcaacagcagaatcggccatttcctacggtttagtgccttgccggtcggcgcgtatgcttcttgatgagatattcctgggaatcgaccagcgggcgaccctcctcatccttcgcatgacgcacgtaggttccgtcggctgccatatgccacgaggtggtggaatcggccatttgcagatccacgtacttgatcagctcgtcgatctgctccggagcggtgatgcgtaccagcgcttcgactcgacggtcgagattgcggtgcatcagatcggcggaaccgatccacacttccggacctgcggccggaccttcaccgatctgcgggccatcggagttcgcgaatgcgtagatacggctgtgctcgaggaaacgacccagaatggaacgcacgcgaatgttctcggaaagtcctggaacacccggcttgagcgcgcagatgccgcgttccacgatgtcgatcttcacgccggcctggcttgcacggtatagcgcgtcgatggtcttctcgtccacgatggagttgaccttgatcttaatccatgcttccttgcctgcgcgtgccgcatcctcttcgcggcggatgcgctgaatcagaccggaacgtacggtacgcggcgctaccagcagacggtggaagctcgacttcggcgcataaccggacagctggttgaacaggcgggtcatatcctggccgaccaccggatcgcaggtcagcaggccgagatcggtgtagatgcgggcggtcttcggattgtagttaccggtgcccacatggcagtagcggcgcaggccgtcggcttcctgacgcaccacaaggctcagcttgcagtgggtcttcaggcccacgatgccgtacaccacgtgcacgccggcgcgttccagcttgcgtgcccatgcgatgttggcgtcttcgtcgaagcgtgccttgatttcgaccagtgccagcacctgcttgcccgcatgcgccgcgtcgatgagcgcgtcgatgatcggggagttgctggacgtacggtacaacgtctgcttgatggcgagcaccttcggatccgccgcagcctgcgctaggaacgcctgaacggaggtagagaacgaatcgtacgggtgatgcaggaggatatcgcgttcgcgaatcgctgcaaaaatgtcttgcgcgcgggacgactccacctcggcaatctgacgattggtggtcggcacgaacgaacggtacttcaagtccggacggtcgatgccgccaagttcgaagagcacggtcgcatcgagcggtgccggcaggcggtacacctcatcggcactgacgcgcagctgatcggcgagcagctgggaaaggaacgggctggtctcgtcggaaatctcaagacggatcggcggtccgaaacgacggcgcagcagctccttctccatggcgttgagcaggttctctgcatcatcctcttccacgtcgatatcctcgttacgggtaacgcggaaggatcgcgcttccttgatgatcatgcccgggaacagggattccaggtgcgcgatgatcaggttctccatggtgatgaagccgtagcgcacgttggtggcatcgtcgtcggtcatgtcgtcgacgggcacgagacggttcaggtttccaggaatcttcacgcgagcgaagtgggacttgccggaagccgggttctccaccagcacggcgaggttgatggaaccgccggaaatgtacgggaacgggtgggccggatccacggcgagcggcgtcagaacagggaacacctgctgacggtagtagcgagacaggcgctcctgttcggcggcggtgagcttgtcccagctcagcagcacgatctgttccttcgccaggtcgggaagaatgtgatcgatcatgtagtgcgcgtgctcgtcctgcaggcggtgcgcctgctcgctgatggcgcgcagctgctgccttgggctcaatccggaggcggccgtcacggcgatgccggtgtcgatgcggcgcttcagacctgcgacgcgaaccatgaagaactcgtcgaggttgttcgcgaagatcgcggcgaagcttgcgcgttcgatgatcggcagatcttcgtcttgggcaagttcgaggactcgcttgttgaacttcagccagctcaactcgcggtcgaagaagcggtcgttcggcaacggctcttcgccggcctgaagctcacgcttgtcgtttttatcggtctcggcgatatgctcagctatctggctgcgcaagatcgccttcgagggtgcgtcaaaaatctgtgccatactttcctactttatccttaagtagctggaaatgctgtaaaaagccggcaaaatttagctggagttaacattcgttcgctcattgtgcaaattagggtgtcgacacgccgtgtttttgtcgcaaacgcacgcaaacgaacaaacacgccttgcgtttcgcacacgatggagcatttttatgattcttgcgatcgtaaagcaacagttgcgacaaatacggaacatcagccggtttcggtttgcgattgccggattgctgagcataattacgaagtacaagaacaacttaaagagcagagcccacaaagagtgtatggccaagataggtcgttacgttgaacgggcattggatagacttaccgttacgacgatgttgttgtgcagagattctgcccttaaggttcttgcaaggaaggcccgctcggcgggccttcctttttgtttgcctgttctcagggagttttttgggaaaacgacggacgccgattatcgtcgttgtgtggataacggtgcataacacgccggggttgtggataactcgcgtcctccgaccacagggccggttcagcttgcaatggtgctcgccgaagcttttcaatcgacggtatgagtaatgcaacgtctttttcgaatgttcctccggtgccgctgccgtcgggcgggctgttgccggtcgccggcgcgatcgcgccgcaagcgtcaccgccgacacaacgcagaaccgtctctgcgcaacggttctatacgccgccgggatcgaatcgcggtggaacgcaactggttggcgctgtgcctggaacgtatggcatggttgcgcaatgcggtcgcgcatcggtggaggaaccctgcgatatgggcaatgtggtggttatcgattccgtggtggcaggagtgggcacgagcactctggccgccttactggcccgcgagctgagcgaacgcggcctcaaatgtgtgctcgtcgacgccgatctgcaaggaggtgggctggatgtgcttcttggcgtggaaaacgaggacggctcacgcttcggggaaatcagcgctccgcttggcaatatcgacggcaaagcgctactgcgggagctgccaatctgggatggtgtgccattgctggcatgcgatccttggaaaaccgaaaatccgcaatcgtgggaagtgcaagcgtgcattcatgcgctatcgcaggtgcgaagcgtggtcgtcgtcgatatggggcaatggaacggactgcaggatttgacggaactgcgcaaggccatccgcattaccgtggtcgaactgacggtacttggtcttgcgcgggccaaagcgaatctgcgggcgcatcacggttcgatcggagaacacgatgccgcaacacaggaacgggagtttctcgtaggcgtgcaaccgcgcggaaccgtacgcgaccatggcacgacggcaatcgaggaagcggcggaatacctcgactgcgatatcaccgcggtcatcaaaccggatgccaagctttgcagcgaactcttggaagggcttggactgcgcaaacccaatcgtacgaacgcgaaagccatcgcaacgttggcggatctcattcaggaagcgttgggagaaaagagcatcagtcatggaactcgggccacttagcgacatcgcatccgagccgggcgtcaccgacatcgcggtaacctgcgacggaacggtgtgggtggatcgcggccaaggtatgcggccacatgcattgcgcgtgccattcagcggtccccaagccatccgcgatttcgccgtgcggctgtgctcgcagcttggcagaaggctcgacgacgcctgcccgatagccgacgcctccacggtggaaggcgtgcgcgtgcacgcggttatcgcaccgctcgttccgcaaggcgccgccatcagcatacgattgccggacgttgttgcgcccagtctggaatctttggcggaaaacggcatgtttccaagcggatggatgcccttgctggaaggattcgtggaacgaagggccagcgtgctcgtgaccggcggaaccggagcaggcaaaaccacgctgctcaaagcaatgcttatgcgatgcgcgccgggggagcgcgtcatcaccgtggaggaggtgcgcgaacttggcatgctcaaccatgccaaccacgtgtcgctggtgacgcgcggcgccaacatggaaggcaaaggcgccatagggctgtcgcagctgatatgcgcgacgttgcgtatgcggccggaccgcattgtggtgggcgaatgcaggggcggcgaaatcgtggatctgctgcgcgcgctgaattccgggcatcgcggaggcatgaccaccttgcatgccaatcaggtgacggcggttccctcacgattggtggccttgggattgctctccgggctgaatccgcaagccaccgcggcgctcgcgcaagacgcgttcgacgtagtgctgcatgtgggccgagtgggaggcaggcggcgcatcacgcaaataggacggcttgaattcgcagaggggaaactgcggggaaacctattggccgggtggaacggcagccaaatgcgggcttcgcaacagtggcctgatttcgtgcgcgtatggagtcgttgaatcgaggtgggcagatggaaagcctcagcattatttgcgcggtactgtgcggactggccgtatggctgtggcctcgccgaaacgtatgcgttgtgggcgaacgggcgggaaacgtagtggggcgcgcaggcgaaagccttgatgaaaaacctgatggaggattcggcgggcggtctgacggaatcgaagaggcgaacatgccgacgaaaccattgcccgccatcggatgtgtggcgtgcgtggcttccctccgcgcatccgtgcgcagcggagccacattggtgcaggcgttcgaagaattgggtggaacgccgttcgccacacccgaacttaccaggcttcgcataaccatggtgatccgcagccgatgcccgcccaaagagcaatgcggccaagtcgaacggctgagcggcgagctatatgcggcctgtcagctgagcctgacgctcggatgcgaaaccggccgatgcctgcaggcggtggctgaatcgttgaaacggcaacgattattggatgatctgcgtaccaacgcattcgccatgcccaaagcgacggtgaaactcctgatggcgttgccgctgctcactgtgctcttgggagaaggtatgggtgcgcactcattggccttccttgtttcaggggtcaaaggcttggcatgcctcggatttgccctctgttgctacacgttcggacttatctggatacgtgcgctgatgcggcaggatgatatgaaaggagccatgtgatgactggcttatggatgctgacggcggcggtgtgcgcggccgaagcgatgtggctgaagcagtggaggccggtccgtgtgccagccgaccttgcgcccgccggacgagtgcgggaacttccgctgccgctggtattggagatgctcagcgtcgccatacggcagggatcctccattccacgcgcgctgattgccgtgggcgatatcgctgcgggagaattcggcgcgggactacggtcggccggagaacagttgaacaaaggtgtttcctgggatgatgcgtggccagatgatggcgatcttgcggtggtgcgcgatgcgttcgcctcgtcatggcacagtggcgcctcgccggtggaacgtttggaaacagcggtcgaacaattggattgggatgagcgctcgcagatcgaacaggctgcagcgaaattgtcggttcgtttgttgctaccgaccggattgtgctttcttcccgcatttgttgcggtggggattattccggccgttatgtcgtttgtgggatgacggcaggaaagcaacgtgggaaatatggctcgggaaatgtgggaaacggacaatcctcgaagaacgatgttttgtggataaatgtggatgacacgccgtggttgtggataacccacgtcctccgaccacaaccctgaaaaaacgttccgacgggcacgatgatgcgcaacactgggtgcactcggccatctggccgaggttgttcgaacgaaaggaacgccatgaacaacgaaacgccaatcaacgtcgatggctcgccagacctgatgggcaaggcaggacagctgctgcatgccatgcgtgaacgggccggcaaagcggtatgcctgctggacgcgcgtatgcgcacgctgaccgtcgaaccggaggaaggcgctgccactgccgaatatgcggtggttttggttgccgccaccggattcgcagccgttttggtgggcattatgaaatccgatgccatcaaaacgctgctgaccaacatcatcaagaaagcgctgagcgtcgggtgattcatgctgaggcaatggtggaaacgccataccgatgatgccgatgagggagcggccaccgcggaattcgcggtggtgctcccctgcgtggcggcggtggcgattttggtgttgtgcttggggcatgcgtctgtggtgtccatgaattgccaggatgcggcggcggccggtgccagggctttcgcggttgatgatacgggcggcgaatcgaaggcgaggaccgcggtcatggcggctgcgggaggttcggcgacggtacggttcgagcgtggggcggacttcgtcaccgtcacggtgcaatgccctgtggtgccggatccgaccggtgtgctgcccactcgagttaccggcaaggcgacccgctacttctagcgttgctccgaagcgtgctggtctctgcgcagtgagatgcgggattgttggttgtggcctgtgcatggaggtctgtgaggtttggagcttgcgacatacgacgtgtgaaacatgttgtgaaacactattggcaaccatttgatggatgcgggtcggaaaggaatggataatgtgaaacgccttgtgaaacattggtttgcttggattcgcgggtccgatgagggttcggggaccatatccggtgtggctttgatcgcagtggccgccatcatgctgggcgcggccgcgtcggcgggcaatctgctgctgtgcttgcatcgcgcgcagaatgcggccgacctggcgtcggtagcggcggccaatgcgttgtattcgggatcgtccgatccttgttccgtggcggaacgcactatatccggcaataatgcgacgatcggatcctgcacgatagaaggcgaggatgtgctggtcgaagcgcaggtcggcacgcaaatgccattcgtatcgcatgtcggcaaacagtcacgggcggggccgattgtctgcgaataagcgtggtgcggaacggtacattgtgcgggaaatcgcgcttcgtaaaaagggatctttctacgtaaaggaacattcgttccacaaaacacggccatttgtatggaaagccgttcgcatgtggcgtgtggagcgaatcgcggttatcgtactgaagtatgagcgaaacgtcatgtgtgaatgcgaccgttgccgttgtcggcaatccgacgtcaaacaaaggcaagggtgccgaggtcggcaagcaggtggttgagctgctgcaagaggccgggcgcaagcatggcttcaacgtgatcgacgtgaccggcgagagcttcgacgattccttggcgaatgccaggaatcgcaggaacgaatacgactacctggtggcggtcggcggcgacggcatgattgcgcttggagccaatgccgtgggctgttccggtaaaccgttgggcattgtggcgacgggttccggcaatgatttcgcccgcggtcttgagctgccggtcaatcgcgtggaaaccgctgtcgacggcatcgtcggcgcgattgtgcgcggcacgcatattgacgttgatatgggtttggccacgtcgttgcagggcgggtatgccgtcgattccagtaccggcgatgatctggtcggcgattcggacgtgccattgcgcccggcggtcaaccgcttctacgcgggcatgctgtcgtgtggtttggatgcgagtatcaacgaccgtgccaaccattcccgcttgcccaacggttcggtgcgctatttcgtggcggcgattgtggaattgacgcatatgaagcggtacggataccacatcaaagccacgttggccgatggaacggtggaagaaagagacattatttcaccgttgcttacggtggccaattcacggcatattggcggtggcattgagatttcgccatattcacgattctcggatgggctgcttgacctggtatggctcgaccacgtgcccaatgtcgccgaatgcgtggatgcggtgtctcacgcgtatagcggcaagatcctcgggtgcaaggtgtttggctggaagcgtgtgcgcgatatcgaaatcacccgcgcgcaagagggtgatgagccgccggttttgatggcggacggtgaatatgttggtcgcctgcctgtcaaggtcgtagttcaagaccgtgcgttgcgtgtgctggtgccgccggccgtggcggaaagccaagctgccaacaccgaagaaaaagtgctggaagccatcaagcgtgatcaccgtgatcctgtcaccggcaaaaccgacacctactacgcgaagcgctcgcggtagtgcgtgcacatgccggtcaaaccgcaacattgcatatcgaagatggcatgtatgcaactgattgcgtgatcggcaatcgtaagcaatcgcaaataatttcgcgataataacgaaaaatccagtacccgcaagatctttatcttacgaataccggattttctgtaactagcgaacgccgtaactatcgaacacggattgcggtcaggcggcgacttcctggcgggcgatggcctgctcgtagtcgcgggtgcccttgaagacttcctgcagccacgggttgacgtgctgcttcttcgcgcggtacatgatgtagccgagtgcgagcacgttggccacgagcgcgatgatcgacacggtcaggttcacgttcggattgttcaccgactgcacggcgaacttggactcatcctggaacatggggaacacctgcgcgaacatgcaccagatggcgagcgtgttggcgcggttctgaatccagccgcccttgttccagaagaagttcgccacggtcggggcgagcagcagcgcgaggccgcaataccaggagtgggtcggcaggcagttgtaggtgtagcagaagttccaaatatcgtatgcgacgatgaatacccaagtcatgtcaggccacagcatgtcctgcttcttctttgacacgtaaatgccgaaccagccggtcatgcaggcgatgttgatcaggccggcaacgccgttgaacacattgtgccagccgccatacagcgtcacgccttcggtggaaacccatgtggtgccccaagcgcgaatggccgattcgaagtcggaggccacggcgataagaatgttgatggccacgatcacgaacgggaagcacttgaaccattcggatttgccgatcttgccccacttgtatttgagtgccatgaagccgatgcagcctgcggtggccgcatatagcttggcatagtggaaccagctggtcatatgcacgtaggtcggattgctgagcgcccattcggcacccatcgcggcggccacgtaaatggtgatgaagtagatggtcagaatggccggcacgatcaggaacgcgatcacgccaccggtcttggtgcgacgggccagctcattggcgccgatcaggcagcagaatacgaggatccatccgatccactggtatatggcggtgtcgtcatagacttggaacaacatcgctcttcctttctctcaacacgtatgcgcgcggggtgagctgcgtttacatgtattcgttcagatgcagcgtctgtgccgcgacctgtctgatgacggtgtcttcaatgtcgggatgcagtctgatcagcgaaatcaggccaacgatgagcgtatagaacgtctcatgctcgttggtgatgggcatgccatgcaatttctcgaaatcgcgcactgtcgaattgcagatgtattccgcaatgcgatcggccacgcggtcgatgaatttgatgtacagtcccgcgttgccgtcttcgatcatgcgttggctgaacgggccctcatcggcgatgagggaacgggtcagtcgcaccacgtcatcgagcgctttcgagatgttgccgacttctcgattggcgttccactcctccaattgcgagatgacttcgtcgatgacgtcgtcgagcacggcgtccgcaacttggtctttgtcttggaaatagtggtagaagagagatctggtcatgcctacgcgacctgcgatatcgctgatcgtgattttcgaaaagcccttttccaggcagattgcgcgggctgcatgcacgatttgcgcgcggcgtgcgtctccgactgttgttgcggaagcgttgtgctgtccgtccatggctttctctccttcgttcgagtggcgtctctcacctgcgcgacacgttgacactctgtcaatttcttgactgccctcagtctaaaccgtaaattgacacaatgtcaatttcgtagtgtcgatgtcgtcactcccagcttaaacgttgccgcggcgcttgtctttggggacacgcgcttcaccgttacgggcaggctgtgcggccggtctttgagaaaaaacgtgtcgtaattaatcggtagcctagtgacaccacagcggaaggaattgcgatggcactggcactctatagaaggtatcgtcccgacacgttcgacggcgtgatcgggcaggatcaggtcacgattccgctgatgcgagcgcttgatgagaacaaacttacgcacgcttacctgttttccggtccgcgcggctgcggcaaaaccagttccgcacgcattctcgcgcgttgcgtcaactgcgcgaaaggcccgacctcgcacccgtgcggcgaatgcgaaagctgcaaggacctcgccacaggcggccccggttccatcgacgtggtggaaatcgacgccgcttcgcacaacggtgtggacgatgcccgcgaactgcgcgaacgtgccggattcgcccccgcccgcgaccgctacaagattttcattctcgacgaagcccacatggtcacgccgcaaggcttcaacgcgctgctgaaaatcgtggaggagccgccggagcatgtgatgttcatcttcgccaccaccgagccagacaaggtgatcggcaccatccgttcgcgcacccaccattacccgttccgcctagtgccgcaggaggttatgggcccgtacctcgagcagatctgcgaagacgagcatatcgaagccgagccgggcgtgctgcgccttgccatgcgtgccggcggcggttccgtgcgagacaccctttccgtgcttgaccagctcatggtcggtgcggtcgatggcagcatcgcatacgactccgcggttgcgttgcttggcttcacgcctgacgctctgatcggcgaggccgtcgacgccgttgccgacaaaaatggcgaagcactgtatggcgtgattcagaaggtcgtggtcggtggcttcgatccccgtcgatttgttgaggatttgcttgcccgcgtacgcgatctgctggtgctcacgttgggcggagagcgtgcggaaagcgtgctttccgacgatgcggccgccgagaacatggatgatttgcgtcgtcaggcttccgctttgggattgtctgcgctgacgcagatggctgacacgatcaatgcgacgcttgccaatatgaccggtgcgatttcgccgcgcatgcgattggaattgcttgccgcgcgcttgttggccgggcgtgaggaagggatggctgtcgttgcgtcatcttccggtgtacctgattttgccggcgatgccggaacttccgcggctgccgaatcgtcgcgtggatccatggccggctcccgtcgccgtgcggcacgacatgccgcaggaaatgtgcgggcgcaggattctgcgcctgtgatcgataccccttccgcgcctgtgcagccgtccgtggcgccgacgaatcctgccgatgccgtcgcatccggcgtggcttccgtgcttgctgacgtgcagcaggcgatgaatgcgacgacttccgtcgcttccgctgcgcctgccgcaacttccgtaccagctcccattcatgacgatcgcacccccgaccagaagtgggatgcgctggtcgcagcccttccggaagacgtgcaacgttacgtaagccgtgaaaaagtgcctcgcgtgctactgagcggcgaccgtctgtggatcaaattcgacaaggcgctcagcaaatacgcgtttgccaaagcggtggcaaaggaatcggtggacggcaataccgaagtggtgaaaatcgtccgcgccgaagtgcataaggcgttcggaccgagcgtcacgctcgcgcctgccaaaaagctggcggacgggtccgaatcggtgccgtggagcaaactcagcccggaagagcagagcaagatcaatgcgcaactcgtgcaggaacagcttaaagcggccacgctgctgacggccaatcttggtactgctgcaggtctcgaatcctccggcaaggagccggccggcacaagcgcgaagagcgccgaagacggtggcaatgccggagattccggcgatgaggagggccatcgagctgctgccggtggagccgaggaagtcgatccatgggcggccccgacgcaggaagttcatcatccggaacggcctgttccggatgatgacccttgggttgcatctgcacagccgatgcaaccgcaatcggtggtcgcaagcggcgtcaacgatgtgaaagcgccggaacaacatgcgaaacgtgtggctgttcccgatgtcagcgataacgttgatccttgggcggcaccgatgcctgtaccgcagcaagcgccggtggacgacgatccttggggtaaccccatgccgattcaggcaggaccggtggatcccatgcctgctccaacggaacctgaggtggctccgaagcacgccaatcaccagcatcgcgcaccgcggcaggacgcggcaccgcagcaaggccagccgaatgccgatccgtggagccagcagttctccgcgccggcgcagccaatgccgcaggtcgccgcggaagatgacgaatattccatgagcgacgagtcgatcggggcgtcaaccgcgttaagcgtggacgatctgacccgactgttcgaggtgaaaaaagtcgaggatttcgggccggacgatgcaaaaaacccgcgcaacatgcagcagaagaagaatctcgacgactgatggcggtgcagtcgcaagcaaaaatgcgaaaccgagcaaaatcgacgaatcaacgcaatcgtaagcactgcataatcgcgaatcttatggaaaccaaggagaggtgaaccatggcactggcctatgacggcgccatccaacgactgatcgacgcgttcgcgcacctgcccggcatcgggccgaaaggcgcgcaacgcatcgccttctacctgctcaacgcatccgacgaggaatcacaggggctgatcgacgccatcgccgaggtcaaagagaaaatacgattctgtgacatttgcggcaacgtgtgcgaaaccagcccatgcccggtctgcgccgatcctcgtcgcgaccacagcgtgatctgcgtggtcgaagagccgaaagacgtgatgagcatcgagcgcacgcgcgaataccgcggcctgtaccacgtgctcggcggcgtcatcaacccgatggccaacgtgcagcccagcgacctcaacatcgccaaacttatcgaacggctcaaagacagcgaagtcgccgaagtgatcctcgcgctcaacccgaatgtggaaggagaggcgaccaccagcttcctgtcgcagctgctttcgcaaaccgacattaaagtcacgcgattggcgagcggcctgccggtcggtggcgaccttgaatatgccgacgaaatcacgctcgggcgtgcgctggccgggcgtcgcgcggtctgacgctacattgcctgcgcgttgcttatgctggcttgcgctggcatgtattggattgcgcaagcgtcgtacgggcgatctgcggaagatttgacggaacgtacgccgaaaaaatgtgtggatcccatatattgttccgcatgttgggcgtgcaggggcttgacaaatcggatttttcctataattgaccagcctgcttagtatgttggcgggcaacacattgaagaagattggataagttgtggctctcatcgtgcagaaatttggcggctcttccgtagccgacccagaatcgatcaagcgcgtggcccgacgcatcatcgaaacgaagaacgccggcaatgacgtggccgtcgtggtctccgcaatgggagacaccaccgacgacctgatcgatcaggcgctcagcatcgactctaacccgccggcgcgcgagatggacatgctgatgaccgcaggcgagcgtatttcgatgagtttgctcgcaatggcaattcatgcggccggctctcacgcctactccttcaccggctcccaggctggtttcatgaccgacgcccagttcggtaccgcgcatatcaaggccgtgaagcctgaccgcgtgcgtcgtgcgctcgacaagggttccgtggccatcgtggccggcttccagggcgtgaatgagggtggcgacgccaccacgctcggacgaggtggatccgatacctccgcagtggctttggcagtggcgctggacgccgacgtatgcgagatctacaccgacgtcgatggcgtgttcaccgccgatccgcgcattgtgccgactgcacgccgtatccccgtcatcgactacgagtcgatgctggaaatgtcttcctgcggctccaaggtgcttgccctgcgttgcgtggaatacgcgcagcgattcgacatgccgttgcatgtgcgcagctctttctcccaccgtcgcggcacgctgatcgtgccggaagacgtcgatccgcgcacattgccgaacatctgagatatctgagattcgcattcggcaatcgcgagacatcgcaggcaatcgcaagaaaaccaagactttacgaacaaaggtaagaacatgagcgaaaacaacaaccagtccttgggagatctgttccccgatctggggccggaagtcccgatcatttccggcgtcgcacacgacaacaccgaatcgctggccaccgtgcgccgcgtgccgaacgagccgggcatggccgccaaggtgttcacgctgctggccgaggccggcgtgaacgtcgatatgatcgtgcaggcttccgcttccaccggcaccgccgatatttccttcaccgtgccgggttccgccgctgccaaggtgcgggatgtgttgcaggagaagcaggacgagctgggctaccagtccttcgacatcgacgccaacgtgggcaaggtggccgtggtgggcgtgggtatgaagacccactccggcttggctgccaagttcttcaacgcgctgagcgacgagggcgtgaatgtgctgatgatctccacgtccgaaatccgcatcgccgcgctggtcccgctcgagcagctgcaggacgccgtccgcgcgctgcacactgcctacggcttggatgccgagcaggtggaagccgtggtgtatggcggtactggtcgctgacgcaataccgcgcaataacaatcgaaaaaagacttgactggattgcttgaggcgtctcagccaagtcttttttattcccatatctgttttacagataatctgcaaatgaaaaagcggaggattgctgaataatcaacaatcctccgcaatattatgttctgcagaaatcagatatcaccatgtacaatcatgcatgatcatgcgtaactgcagaacatatgcagatcgttatcacttcttggtgatgtagccgagtgccttcagcatttcggcgctttccaaagcgccgccggcagcgccgcgcaaagtgttgtgagcgagccccacgaacttccaatcgaaaatggaatcctcgcgcagacggccgatggaaacacccatgccaccctcgtagtccacgtccttcttgacctgcgggcgatcgtcgtcggtcaggtactggatgaactgcttcggcgcatgcggcaatccaagctcggaagccttgctcgtgtagttgaccaggcgatcgacgagctcttccttggtcgggttcttgccgaagttgatgaacacggtggcagtgtggccgttgagcacaggcacgcgaatacactgcgaggtgatcttcagcgggccgtcgaacggcacgatctcgcccttttcctcatcgacgcggccgaacaccttcagcggttccttctcggacttctcctcttcgccggagatgaacggaatgatgttgcccaccatttccggccagtcgttgaacgtcttgcccgcgccggagatggcctgataggtgctcacgataacctcgcgcggctcgaattccttccaagcggcgagcgccggggtgtaggcctggatggagcagttcggcttgacggcgatgaagccgtgcgtggtgccgaggcgcttgcgctggtgttcaatcacctcataatgctccgggttgatctccggcacgaccatcggcacgtccggagtccaacggtgggcgctgttgttcgacacgaccggcgtttcggtcttcgcgtattcctcttcgatggcgcgaatctcagccttcggcatgttcactgcggagaacacgaaatcgacgtttttgaccacgtcttccacgtcggccacgttcttgacgaccatgttcttcacgaattccggcatcggcgtttccatcttccagcgaccgccgatggcctcttcgtaggtcttgccggcgctgtgcgcggatgcggcaagggtgaccaattcgaaccacggatggttttcgagcagcgtgacgaagcgctgtccgaccatgcccgtagctccgagaatgccgaccttaatcttttcggacataacaacctctcgcttatgctggaacggtttcgtatgatttcacgcttgaggtcgaccagccggccccaaacgacgtcgtgggcggccacatgcgttgttcaatcttacgaaaacccgccgtcaagccgttcccgctatccgcatgctggtccggcgcgcggcgtcgcgtctagcgtggatggtttcgcccagtgcctactgtccgctacttgtcgtcattgcgcgaccatgcgaacaacaatacgatgagcgagatggcgttgagtatattgctgacgatatccacagtcgagcctgagaacagacctcccggggagatatgtgaatacttcaagccgagtgtgagccaatccaaggtgcagatggccgtcgtgcaaacgatgaacgccggcggataggttctggaaaaccacacgaatattggaatcatcaaaccgagcgcacaccatagcacaagccaaaggtgcgtgcccaaaggcaaggatgattgcgactgaacaggaagattcccaatgacctcaagcccgcacaccagtgcgatgacgatgatgaaatatgcgatccattgtgctgtacgccgaaacatgccaatctcctcatccttgctggttggacaaaactcattgtgctccgtaccaaatattcggaatagtcgtagtgcctgttgtcgagtactgggtgaacataatgatacctctgcctggtttcgccgcttgtttagcctgtgcaattgatgatgcagaatagagtttggccatgcttcccacccagccagggacaaatttgctaacatttccgccggtctctagccctcgtatgtaggcttttgtgttgtcgctatccatccagcgctcggtgaggccgttccaatggactatatatttgttcacgcctcgtgcccttgctgaggattggtaaatggtcactgtcagcgttgtggaatctacgacagaatttttcgaacgggaaaggtcattcatgatgaagagctggtgttctaccatattgatggcttcttgcgagtacccatccgtgagtgcggcatcttcattgagagtgaaggctcctgttggactggttgatatgtattcgtcaaggccttgaattgcggcaggtgtcgagatcgtcggagattccactgcttgtgcgaaaggttggaatgctgtagttaggaggaggccggtcagcaacgccatcatgaagaagacgattctctttttgatgattgtcattgttatctccttgatttgttgtgttcgcttcaatgcgaacacaacaataatgtggttgggaaagcgctgaggcaatgatgattccagaaaaaatggaagccgtataggtgactccccttatgggaactatgctggaaaatatgggcgagaagcagagtggttttcacattgatgtggggattctcgataatgatgcgtgcgcgttagaaatgatatcgctcctgttgcgtcagagggacgcggcgatacgtattggctggagcgatacgaatgcgcaatacacgttggaacgtatggtatttggaccgttgtctgacgctgtaacggtcaaagttatcgttctagatcttgcactgaatggtatttccggaatcgatgtctgtcggcagataagattacgagactcaagagttggtattctcggtgtgagctcgtacgcgcttgatcaataccgtcaacggttagctttggcgggggcgcaaggtttattttctaagcaagaaatcctttcgccggatttcgtaaatgcggtacatatcgcggcatctgggaaaagtgcggatgtcgaccatggttttctttccgttgaagaagcgtatgcgcgccttcatgctgttccgaaagtagcgcatgcaggcatttctgctcgtgaattggagattcttggaatgtatgcgagggggttaactactggtgaaattggtggccgtctcaatatctcatgtgctacggtgctttcgcatgttaatcatgctgctcagaaacttggcgtcaggaaacgggtggaggccatccggatatgtagacagagacatctgattcagggttgaatcaaccggaaatgattaataacgtatacgggataagtcgatgcatatatggagatttggcgtggctgctaattcgttatcaggcgacttaaagcatatgtcgcaccttcagaagacactgatgccttttgttctcgtatgcctattggttcatttatgcggagtaagcgacgcactactccggtcgtcatgcgccatgactgattgtgatttatttctgatcggtttctcgtttggatcattggtttgcactgttttttctccatggcatggcagttgggtgacgcttattgtttggtgtgtttctctattcccgagtgggttgtggaactctttgcctccggaatattttatggcttgtgccatggctctcggaataattgggtactttcagctgaatcaggggttggcgctcgccgctgtggtatcgggaatgagttggtttcttcctctgattggacatgaggagaaagacattgacgcagggagttgctctcaaaggttctttttgatactggtaatgtgtcttgtgccagcattgataggtggattaatgcaacagactcaacgtcagatggaactgcgtgatatggtgcggaggcaagaagaaaaactggagattgcccatacgctacatgattatgtgaccaatgacgtcgtcgatgcgattttattgctcgggcaagtgcaggatgccgattcggtcaagctcgacgaagcaaagggatgtcttcggaaggcgtcgctacgttcccatgctttgattgagcaacttgaagatgttcatcatgccaacgatgaggatagtggcataacagatgtctcaagaggacaggtggacggcgatgaggtccttagggcgttatgtgaaattgcaaggacgcatcaatcacgattagaactgttgggatttgatggcgcggtgcttttgcctgaattgatttctggggatgattgcatggagcgtgaaaccatattgttgggattggtgagagaactttttgcagatgtggcgaagcatgccgatgctcgatacgggtatgtgttaaccgttgaagcgtctcttaatgaatatctaatacggttacgggatgtcgctgctgctgatgcgtccattgaatctggaggcacggggttgagcagatatgaagcacaattaaaacggcagggcggttatttgcgaactcaatgtgaagatgtggagagtggtcttcattggtggagtttggaggccagagttcctaggaacgtcggtaatcgcgctcgcgtacactggtagacatgtcgaaggcatcagaagaagcgcagaagcagctggatcgtatcgtggcgttgggatatccggatgtggccgatatgtcggccgccgcgttccgtgctttggcacgcccgctcatccgcgcgctggaggattccgatttgggtacgcagattctgttggtgcctacgcgcgagttggtttccccggaatcgttgatcgcgcgtacgtcgatcaatcgcatggctggtttcaccacgatgccgccacgcgatatcgccagtttccttccgcaggatggtttcgaacctccggaaggtccgttttacctggtggtcgaaccgcataccggcacctgctacatcaatcgcgaacccgatgtggcgcgcaagttgatcgattccgacgagcgtttgccgcttacgttggaagagggacttgctattgctacgcagcatccggagtggttgttggagaagaacggtttcaatttgttgggatcgcgttccgcggatggtcgcgtcccaagtatttggatgagccagaatgcgcctcgattgggtgcggtatggccgaattcccgtcatacttggcttggcaacgcgttttgcgtgtctcgtcgcggcgtcagtttgttccactgacgttctgctgatatttcgcagattttccacagattttccgcattccacagattggcgattgtccgactgttgcgacggccacgccttgcgtcgccgcacctagcgcttgaatagtttggcgatggcgtggccggctgcggcgcacattaccgatccgatgcccagcagtgtggcggtgacctgcgggcggcgcaattcgttgcggatgccgatcagatcggtcacgcaatggtcttcgaagaacacgcgcaattcgttgctggagtagcgcccgatcaagtcgccccacgtgagcatgcgcgtcacgtagctgaccggattgttttcgcggaattcgaacagtcgaatgcctcgcagccgcgatttcggaccatagcattcaaagccgcaggtcggcgcgtagccaagatcaatgtcatgcacgtgcccgacgaacgcgttcttatggtcatgcccgcagaacagcgcgaaatagccgcccgcatcgcgcaatgcctgcacttcgccaacgttctcatccgcacagccgatcgcctcgccaagcctcgagccaggtctgcacacgtcacgattcaacacatagcaatgccctgcgaacgttcgcgcaccctccaccgcattcggcgtgtatgcgggcacctcgcgcaggcaatcgtagaactcctgcggcggaatatgctggaacgcgatcgccggaaccgccaaaccgtcgccattgcgctcgcccaactcgcgttgcacttgcttcagccattcgatcgcttccggcgaaggcgtgccatagccgtcggaatcggccaaatcccatccgcgcgaattcgacgcgtattttgcgtaggatgtcagcgattcccgtcctcctgcagcatttccagtatttccggaagtatcgccagatttgccagcatttccagtatctccagcatgctcgcgatcgccggaattactgcgatcgccgtcaaacgcattatccgcatagtcgccggaattcaccatcatcacgctcatcgcaatgcgcccagacccgtcggaagcctcgatcggaatcgcaaacgtgcctggttcgagcgccaaaggagacgacccggcaacgggattcatgcaaccggaaaactctcggtagatgtcatcctgttcgtcggcgagaatgccgcactggaaatcgtggttgccgtaggttgcggcaaaggggattcgcgcttccaatgcaggtccaaggaatgctgcgaacgtgtctcgtactttctgccgcgtgctgccgagtatggtcgcggcggtcgcgcgattgatggattgcgcccatgattcaagcttgttggcggatccgttgcgcccgtcgcgtttgttgcgtttcacgagtttcggcgagtcggtgccgatgccgtcgatcatccaattgtcgtcggtcgggggctgttcgagcaacgctttagtgaagggatgtcgtttgatgccgcggattttcgcttcgatttcggtgaccgctcgtatgtgcgtgcccggctgctctccgcgacggcgcaggaacgtgtcgatgtacgcggggtcgtatccgcgaatctggtcgccggtgaagacgatcagatcgggatgcgttttcttgatggcggcttcgatgagacggatcgtgtcttcgcgcacgttcggtccgtcctgaatatcggccatctgcagcacacggaaggtgccgtcgctgttgaatcgcaaggtcatgatgctcactgtaatgcgcgaaatctggatatggggtgaaaaagagacgaaaatcgcggtctgcccgtcatatggcggaatgccggcgatatatgggattggttgccgctactatgggcggcagtgcaggtaggtaacatgcacgtaacaatgtgggccggcagaaggcctgcccagctttacagataaggaggagtgatgggtcaggatcaatcttcagtgtttgatctcgcggcagtggctgcagcgtccaacggagggaacaacgacccgctgctgcctccggcgcgttatattggagctccgcaaaagcccagcaagatgccgtacaacaagtacgtcgcatacgataagcaggtgccgtttgattacccggagcgtacgtggccgggcaagcgactgcagcgtgcaccgcgttggtgttccgtcgatcttcgtgacggcaaccaggccctcgtcaacccgatggattccgagcgcaagctgcgtttctggaatctgctggtgtcgttgggcttcaaggagatcgaggtcggcttcccgtcggcttccgaaaccgattacgatttcattcgtatgctgatcgagcgtgagctcattcctgacgatgttacgatcgtggtgctgacgcaggctcgcgagcacctgattcgcaagacttacgagtgcctgaagggtgccaagcgcgccgtcgtgcacttctataactccgtgtccgtgctgcagcgtgaggtcgtgttccgcaaggataaagccggcatcaagaagctcgccaccgacgcggccaccctgtgcaaggagcttgagggcgaagcccagggcatcgacctgtattacgagtattctccggaatccttcaccggcaccgagccggagtacgccgttgaggtgtgcaatgcggtgatcgacgtcatcaagccgactccggagcatccgatgatcatcaatctgccggcaacggtggaaatgaccactccgaacgtgttcgccgatcaggtggaatacgtgtcgaacaatctggtgccgcgcgacgccgtggtgctgtcgctgcacccgcacaacgatgagggcatgggcgtggccgccaccgagctggccgtgcttgccggtgccgatcgtgtcgaaggctgcctgctgggcaacggcgagcgcaccggcaacgtcgatctggtcacgcttggtctgaacttcctcacgcagggcatcgatccgcagatcgattattccaacgttcctgagattcgcaagacggttgagtactgcaaccagctgaagatttccgagcgtcacccgtatgccggcaatttcgtgttcaccgccttctccggttctcaccaggatgccatcaagaagggtcttgaggctcgtcaggtggccgccgatcgtgccggtgccgatttggacagcttcgtgtggctggtgccgtacctgccgatcgatccgaaggatatcggccgcacgtacgaggccatcatccgcgtgaactcccagtccggcaagggcggcatggcctacctgctgaagaccaaccacaatcttgatctgccgaagcgtctgcaggtcgagttcgacaaggttgtgcaggcgtacgccgatgagaccaagaaggaagtcaaggacgaggatatttggcgtctgttcaaggacgagtatctgccggtcgaagagtccggcgctactgcggctggtgccgtggtcggcgacagcaaggacgactccctcgagcagtggggccgtctgaagctgctgaaggtgtcggtgtcgtccggtgaagatggttccgataccgtgctgaaggccaggattcttgaccgtggcgtgaacgtcggcgttgatgagccggtggagcgtgaggtttccggcatgggcaacggcccgcttgccgctttcctgaacgcgctgagcaacttcggcatcgaggcttccgtgatggattacgtggagcacaccatgtccgtcggcaccgacgccatggccgcctcctacgtggaatgccagatcggtgaggaagaggatccgcggatcgtgtggggcgtcggcattgacacgtccatcgtcaccagctcgctgaaggccattatttcggccatcaaccgttccgagcgctgatttccgcgggttttcggttctcgtagctgaagggcttgtgatgtacttgcgagtacgtcacaagccctttgctttttgatttcataggattcccgagtttccggattttccagtttttccggattattcggaaactcggaaattcaggattgcgatccccaaatgcagacattgttgccgattgcggagaacgtcgtgaccggcttgccgtcgatctcgcgggggagcgttgcgaaccgtgcaatgtaggtcacgtcgtccaatcggatttccgcgtcgcttgcgcaacagttgaatccgttcacggcgccggaaagcggtttccacgatccgcaggtgatcggcccgtccgtcgacctcggcagattcgcgtcgggagtatcgaagaaacttacgatttcaccccgggtgattcgcccgtcctcatggaacgtatatcgcgtcggacgattgatgccaacgtacgtgccatcatcctcttgcttgccgttgaagaacgtatgctgatcatgcagtacaacgttgtaatcgcctgtgatatcggcaatgccggtcggcgcgacggcaacggaaccgcggtattcgtacggtgccgcaaccagccagccgtcggaagttggcagtaattcgcgtacgtgagattcgtaatcttcatcatcgccctcgctaaagcgttccgcgaaacgggtgtggtagacgaggaacatgcgaccgtccttcgaccgacgaatggcggaattatgcccctgcgagacttcgacatcggcaagttctgccggaccgccatcccactgtacggaagacgtcaatcgaatgccggtgccgcgctcctgattgtcgggaatctcaccgtacgaaatcgcgggattgccgttctggtccacgtacgggccaagcagcgattttgaacgaaacagacgaatctgatatccgccggtgcgcccaagccagccgtacgacatgaacagataccaccatccgttttcacgaatgaagtacgatccttcgccggaattccagtagcctccggccactttcacgccgtaataaggatcggaggaatccttgaccagcgggtatcgcacggaataatcgcgcaagccggttttcggatcgagcttgaacatccagatgccgccgaaccatgaaccgaaactcatccacatttcgccgtgctcgcacaatgcgggcgccgcgtcgatggcgttgatgcgcgtgtctttgagcgacaggtagcgggtcaggtcatagccgacggtgccatcggttttgggctcaagttccagcactttcggcacgtcggtgttccacaggttgctctcgtcgaaaccggaatataccaccggccccacgtacgtccagtcgccgtccacatggtcggcggtcaacagcacgatcaccgagcggaactggtcgccgttcaccgacaggtacatgcaccacttgcccatggtctcgttccagatcacgtcgggcgcccacgtgttgccgagcaggtcgggattggaatcctgtttcggccatgcctgccaaatatcgccgagcagcgcgtacgggtcgcggctcagattgttatcgaaccgctcccaatgcaccatatccgtgctgcgcgcgcaccgacgatgcgtgccgaacagatagtagacaccgttttcctcgacgattgcgggatcgtgcacggccacccgaccgttggcgagcgtgtgctcgatgccgttgggcgaggtggccggtgccgcagatagtggttctgcagacgattgcactgcagcattcacggttgttgtgccgttttcactcacttctgcgacccccaaatgcacagattgtttgtgcccagagcgctgaaggtcatgactgccttgcgatccttgtctcgcggaagcttgtcgaacgcgccggaatacgtgacttcgccctcgttgccggtgagcttaagcgtcatctggttggcgccttccacggcctcccaagtgcccgtctggtcgccggtcacggtgccgtcttccttcagggtgatgttgatgggcttgttcacgccgcgatagacggtgctcgtcttatcggtgaccttcttcgggcccttgaaatagctggacttgtcgtgcgtcaccatctcgtaatcgccggcgatgtcggcggtcttgtagcccttcttgtcggccttggtgcccgtgtattcgtacggtgcggccaccagccatccgtcggcggtcggcagcagctcgtgcacgcgcacctcatgcttttcgccggaaccggagaaacgggtatggtacacgaggtaagcggtgccgtcgtcgtcaacgaacgcggaattgtggccctgggagacctcgatgttcgcgttgtcgttgccgctccactggatcgagctcatcaggcgctcgccgatgtcgctttgccagttgttgccgatggccttggtggaaatcgcggtgttgccggcttcgtcaacgtacgggccggtgatgtccttggagcggaacatgcggatctggtagccaccggtctgctgcagcgcgccgtaggaggcgaatagataccagtagccgttgtcgtgcagcaggtaggagccttcgccggagttgccgaagccgccgccgagcttcacgccatagtaggcgtcggacttgttcgcttcggtggggtaggtggagttgtagtcgcgcaggccggtcgtcgggtcgagcttgaacatccacatgccgccgaaccaggagccgaaggtcatccacatgtcgccgttgtcatcggttttcacgcacgggtcgatggcgttgatgccggtgtcggtctgcgaggtgtaacgggtgatgtcggcatcctcgccaagcacctgcggcacgtcggtcttcttcacgttcacgcgttcgaagccggaatagaccaccgggccaacgtacgtccaatcgccttcgatgtcgtcggcggtgagcaacacgatcacagaacggtagttcgcgccgttgatcgacatgtacatgcaccacttgcccatggtctcgttccagatcacgtccggtgcccacatgttgcctttgacgtcaggattggaggactgcttcgcccagccgtcccaaatgtctttgaagatcttctcgtagtcggtgctcagattgttggtgaaggtgctccagttgatcagatcgtcgcttttgagccaagcgcgatgcgagccgaaaatatagtattttccgttggctttgacgatggagggatcatgcgattcgccgcgcttgacgctggcggtgctggtttcggctttcgacgatgcggacgattgcttcgtcgaattgccggagcatccggcgagcgttccgaccagcatggctgcggcgatgatgcctgccgcgatctgctttgctgttgtacggaatttcatttttccccttccttgcggatgacattgatttgtacaacgatgtaatttcttatatagtgtacaacgttgtaaagaaaagtcgaatcataaggggtttctcgatgtcgagttcctacgaattgctgtgctacacgcgcgaagctaccggccgtgaaaaggcgaataatgaggacatcgcctatagcatgcaccttgcgttgcgtgccgatggggccgcccaatgggagccgctcaacgagaattacggtattttcttcgccgccggcgtgcctattcaggccgccaccgccgagtcgcgccgagcgtgcgtcgcggcggcgcatttcgtcgccgatccgttcgatgaggcgcatccggccaccgatgccgtcgcatatggcgcggtgatgccggggatcgacatcacgttgaaatccctgaagaacccgtatctgttccgccttgcggatggccgattcgcgctcgccgctacccgtaccgcgcgcggcggcgagccggatggctccgagcgatcggcgttcctgttggccgtcagcgacgatctgacctccttcacgcagcttggactggtgatgctgcgtaccggcggtggcgtcaatcgtccgtctgtcgcattcgacgcggacgcctcccgttatgtgatttcctggacgtcgaacgacggcaaatcgtatgtcgcgaccgttgccgatattgtcgccgtggccgaatccggcgagccgatcgatattgcggaagctgtggtaacggcggaatcaagccgttcctgcgattgcagtattcccaatgccattcctggcaacgtgattgccgtcactgaagaagaagcgtcgaaactgatcgaacgattcggtcgtatttacaacgttgaaacatcggtggcgacgcagcatatcgacatggcggcaagcagggaagcgtcccgtgaagccgtgcaggcactcgccaaggtccgcgccgatctcgtctacagcgacggttccggtgccacccgtgccgtggattggaacaaagacgaacttgaggcgattgcgcaggacgccgccgaaggcaagttccagccgggcgacacgcgcacggtgagcggccgcatccgccaaaccgtatacccggtgccatttgccgtggagcgtgcggacccgtcggtgttcgcttggaatttcaacggcaagccgatgttcatgttcatcgccaccgacgataccgacggcaactgcgtcgatccgaacgatggcgccacgcatatgccgttgcgcatcgccgactccatcgaagcgctttccgacgcggcgggcggccgtgccaaggaaatcgatctgctcaaatgcggtgattacaacgctgaaggacgcgccatgaccggctgcttctgggcgccggaactgcatgtcatcgatggaaaactgtcggtgctcttcatgccatgcttcgatgggccggccaccaatccagacggcacgcccaacgatcgcgcgggcaagccggacatgtggacgggcagctgccatatcatgcagctcaagcagcattccgacggcacggatttcgatccgcgcgaacccgaaaactggacggtgccgaagccgattctcacaccgaccggcggcgtgctcaatcccatccaacgtatctcgctcgacatgaccgtcatcagcgattccggccgctggtattacgcgtggcagcaggtcggcagcatttggatcgccagcttcgatccggcccgtccggaacggcttacctgcgagccgaagcaggtcgttgtgccggaattcgcgtgggacaatatgatcgccgaaggtccgaacgccatcgtgcatgatggcacgatctacctgatttattctggctcgctggtcggcattgactacaccaccggtctggtcaccgccccggccgggcaggacgccgatctgaccgatccgaacgtgtggacgaagctcgactatccgctgcagaaatccggagtatacaacgggcaatggcagctcggcaccggccatggcatgtggtccaacgacgaggacggcaatctcatctatgtatttcacaatgcggaatacgagaatggacggtatggcggccgcgacgcccaggtgcgccgcgtgcactggtccaaggagggtatgccgatactggacatgcaggcggcggaagagctcaatccggactatgctgatataacgatgaaaatcgtggtttccggcaataaaggctgatttcgttggcttcagcgccgcaaggggcgaaagtcggtgttgggtccgaatgtatgagacgtttttggtgaaaaggggttgacatgccgaagcagaatggcgccaacggcgagcacgtggtgaccatgcgcgaggtcgcgaaggcggccggcgtatcgatcaaaacggtgtccaatgtggtcaacgactacgagttcgtgtcgcaggccacgcgagacaaggtcaacaaggccatcgacgagctcggctacacgctgaacgtgtccgcgcgcaatctgcgcagggggcggaccggcatcatcggcctcgccgttcccgatctgcagatgccgtacttcgcgcagctttcgtcgctggtcatcgaagaggccaagaagctgggcctgcgcgtgatcgtcgagccgacgcaatactcgcgcgaaggcgagattgaggcgttgcacggctcccagcagacgatgatcgacggcctgatctacagtccattggaacttgatcaggatgatgtcgaccaattggacgtggactatccgctggtgcttgtcggcgaacgcatcttcaccgacaaggtggaccatatcgccacggaaaacgtggaaggtgccaagcgcgccacgtcgtatctgctgcagaccggttgcaagcgcgtggccgtggtcggcgtgcatccgggcgagaagatcggctccgccgcgctgcgctatcagggctaccttgaggcgttggaggaggccggcgtcgaattcgacgagcgtttggtggtcgagtcgggcatgtggcatcgtagcgatggcgtgcgcgtgatgaacgcgctgcttgattccggcgtggttcccgacggcgtcgtcgcgctgaacgacatgctcgcctccggtgtgatgcatgcgatccagatgcacaatctgcgcattcccgaagatatttcggtgatcggtttcgataattccgacgattcgcagtatttgtctcctgcgttgacgtcgattgctcccggtcttgaggcggtggcgcgtctgtcggtgaaattgctgaaggatcgtatcgacggggtttcgccgtcgaaggatctcaggccggagcagaaggtgttccgcaaggtttcgtcgtcgttggtggtgcgtcagtccaccaagctgcccacgaattccttggtggtgtgatcttccttccttctttttcttcttcttttggaaggaaggaagtgactggtgcctcggcgcttgcgtccggttttttacggattgccggtgccgaggtttttgttttccctttctggcgagtgtctgttgccgggtactgcgattcgattcttccgaggagtcggatgcgagaaacacgcggtgcgttcctccgatttgttacaacgttgtaatagtgatatattcaacgttgtaaattactggaacagcggattgaaaaggaatagacatggctgtttacaacaatccgatcgtgcttcagcgcgcagatccttgggtcctcaaagttgacggcgagtactacttcactggctccgacccggaatacaactgcatcgccattcgtcacgcatcgaacatcaacgacctgcagaaagcccccgaaacggtggtgtggcgcaagcatgagtccggaccggcgagcatctatatctgggcgccggaactgcaccgcatcaatggcgcttggtacatctacttcgcaggcgctgcaacggatttcgaggcctccggcctaccgacccaccgcatgttcgtgctggagaacaccgatgacgaccccaccaccgacaactgggtggaaaagggtcagatcgtcaccccgatcgactctttcgcgcttgacgccaccaccgaggtgatcgacggcgtgcagtacctggtgtgggcccagaaagatcccgccatcgaaggcaattccaacctgtacatcgccaagatggcaaacccgtggacgctggaaagcgagccggtcatgctcaccaagccggaatacgactgggaatgcatcgacttcctcgtcaacgaaggcccggccttcctgttccacgagaacaagatctacatcacgtattccgcctccggcaccggtgtgccgtatgccgtcggtctgctgaccgccgagcgcggcagcgacctgctgagcaaggattcctggaccaagagcccggtgccggtgttcaagacctgcgccgaaaacggccagtacggccccggccataactcgttcaccaagtccgaagacgattccgaagacctgatgatctatcactgccgcaactatacggaaatcaagggcgatccgctgttcgacccgaatcgtcatgcccgggtcggcgtggtcaagtggacggagtacggccccgacttcggtgtgccggaacccgacaatctgtggactccggacacgacggatgtgttgccggccgacggcggcgctcttgcgggaacgccggtagcgaactgacttgcgtaatcgtaagaaacgttgcgattccaacaaaaacgaataattgaagattataaagaaaacagcttttccatcggcgtgtttccgatttgtacaacgatggaaaaagctgtataatcaaaattacaacgttgcaaacggcagtgcagctgacgaagcgtgaacgacatcgcaaacaaggttgttgatgaatgtcactgcaacggttggaggaaatgtcttgggagaccaagaggaaaaggagaaatccatgaagatcaagaagagcaccaaggctctcgcggccgcggcctccctggctatgatggccaccgtcggcctgtccgcctgcggtggcagcagcaacgacgccaagacgaccgctgacggcaaggtcaagatcacgatgtggcacggcttctctgaggccgatggcaagactctcgagtccatcgtcaaagacttcaacaagtcccaggataagtacgagatcgatgctcagctgcagccgtggagcaccatcggcgagaccatggtgaccaaggtcacctccggcgacggcccggacttcgtgaccaccggcgccgacaacggccagggctggtccatcgacggcaccttccagtgcgtcaccgatttctatgacgacaaggacagcggcaccgatgagtacatcgagaacgtcgttgaccagatcaccttcaacatcgacggttccgaagagaagtgcggcgtcccgatgggctacgcaccgaccgccgtgtggtacaacaccgacatgtggaaggctgccggcctgaccgacgccgactacccgcagacctgggatgagctgctcgaagtcgctaagaagctcaccaagtccgatggctcccagtacggcatcgctctgccggatctcggctgggctccgttcctgaagggcaacggctccggcatctacaccaccgatggcaaggtctccatcaacaccaaggagaacaaggccttcctcgagaagatgcgtgacttctacaagggcggttactccgtgtctggcatggatgagaccgctgctcgtgaatccttcgaatccggccagtccgcaatggtgatcgtcggaccgtgggaggatcaggcctccaccgacaagggcatcaaccacgacctgttcccggttccgaacggcgacggcacctatgtatacccggacggcaccaagggctccaacaccggttccaccggtctgtactggtgggtcacctcccaggttggcgactccgctaagaagcagggcatctacgacttcttcaagttctacaacaaccacgacaaccaggtgacctggtccctcggttccgcctatccgccgaacaacaccaccgtcactgccgatgagctctccgagcgtccgctgatcgccaagatcggtgagaacaccagcaagtccttcatcggtatcgcaggcctcaagggcggcttcggtgacatcgccgcctccgtcgacaccctgacctccaacaccgcccgcaccgacgacgacatccagagcctgctggacgacgccgaatcccagatccagggctacctcgacgagtacaccgagtaagcgaagcgggattcacctacaatcaacaagtgagcggggctaacccgctcaccaccccagcaaaaggccacggtgctggccctcacgccagcgacgtggcctttgctgtcttaaaaaaacacatccctggtgtcattaaaggaggagataatggcacaagcaactgccgtcccaggatccgcgcattccgcggtggccaaggagaacaagaaggcgatccaggcccgtaacctgcgcaccggcctgctgttcaccgcaccggccctcatcgttctcgcaatcttcgttttctatccggcaatcaagacgttcatcacgtctctgacttccgaccgcatcaaccgcgccggcaagttcgtcgtcttcgacaactacgtcaagctgttccaaagcgccgacttctggaccgacgtcaagaacaccctcgtctacgcagtggcctacgctccgatcgttgtggtcgtcgcactcgcgttcgcactgctgctcaaccgcaaggacctcaagttcgtcggattcttccgtacctgcatgttcctgccgttcgtcatctccctgactgtcgccgccatcgcatggcagttcatcctctccccatcgctgggcttggttccgtactggattcagcagttgaccggcatcgcgcacgtcgatctgctcggtacccgtgaaaccgccatggctaccatcgtcttcatcaccgtgtggaagaacttcggctacttcatggtcatcttcctcgcaggtttgcagggcatctccgccgaactgtatgaggccgcctccctcgatggcgcctccgcatggcagaagttccgctacatcactcttccggcactgcgcccgaccttcaattacgtggtcatcttcggcctcatcggttccttccaggttttcgatcaggtcttcatcctgacctccggcggtccggcacgcgccaccgaaaccatcgtgtatcgcatctacaccgaagcattcggcaacggcaagctcggctacgcatccgcactgtcgtacgtgctgctgatcatgacgctcatcgtgggcctcatccagctatataccaacaacaagcatgagaaggaggaaatcgcatgagcaccgcgactctttccgcacaagagcaagagaatgcccgcatcaacgccgaaaacgagcgtcttcgcaagcaggcgacccgcaagcgccgcatcggcctgggcttcagctacttcgctttgatcctcatcaccatcctgatgatcttcccgctgctgattgtcgtgctggtgtcgttcaccccgaacgccatcacgcagacttggccgccaaagctcgtcccgaaccagttcacccttgagaactaccagtcgctgttcgaacgtctgccaatcggtcgagaaatgctcaataccgtcatcttcgccggtgccgtgaccatcatctccgtgttcttcgactccctggccgcctacggcctgtcccgcgtggatttcaagggccgtggcctgctgctcggcgtgctgattgccaccatgatgatcccgggcatggccctgctcatcccggtgtacaagttgctcgccaacatgggcctcatcaacagctactggggcatcatcatcccgcgtatggccgacgtcggcggcatcttcctgctgcgtcagttcttcatctccattccgaaggacctcgacaacgcggcccgcatcgacggagcaggtgaattccgcatcttcgcgcagatcattctgccgaacgccgtgccagcaatcctcaccgtgggcatgttcaacttcatgggcaactggaacgacctgctctggccgttgatcatgacctccaagccggagacccgcaccatcaccgcaggcctcgcaatgctgaccggccatggttcctccgtcaccccgtacggtgtggtgatggcaggtgccctgatctccgcactgccgttgctggtggtcttcttcttggtgcagaagcgcttcgttgaaggtatcgccatgaccggcatgaagtaaagcccgacttcatccgatcgaaacgatccataactgaacatccataatcaaaccttgttttccttccttcgataactgcgctgttgagtgcgtagaacaaggccgtcggcgtggctcctccccacggtggcggccttgttctgtattctcgtaagaaacgtttggacacgtattttgatacacgcatgtagacgacgcaaaggagcgcgcatatgacttcgcatattctcgaacgggtccccctacagcaggtgaggctactgccaggagaacattttgacgcgcagcaggccggcgcacggtatctgcttgagcttgacgtcgatcgcctgctataccccttccgcagagaggcgggactgccgcagccgaccgatgccgacggcaatccggtaacgtcgtacccgaattgggaggaaacggggcttgacggccatatcgcagggcattatctgtcggcttgcgtcggattcgcgcaagtcgcagacgatccgcaaccgttcatcgaccgcgccgccaccgtggtgcggtcatggcatgaatgccagcagtcgtttgccggcgatgctgtgatgcgcgggtatgtgggtggtgtgcctgattctcgcaccgtgttcgggcgccttgccgcaggcgatgttgaatcgcagaatttctcgatgaacgacgcatgggtgcccatgtacaacgttcacaaaacgttcgccggtttgttggatacatgggccgattttgcttctatcgatgaacagacttcgcagctggcacgtaccgtcgtgcttgatctggccgattggtggtgccgtatcgccgagccgctggacgacgagaccttcgacaggattctggtgagcgaattcggcggcatgtgcgaatcgttcgccgaactgtacgcgcgtaccggcgaggagcgctaccatgtgatggccgaccgcttcaaagaccacgccatcttcgacccgctggcgcaaggcgaggatgtgctcaccggcatgcacgccaacacgcagattcccaaagtgcttggatgggaacgtttgggcgcgatttgcaacgatgaacaggccgacgccgccactaacaccttctgggattccgtggtgcatcaccgttccgtaagcatcggcgcgcattccgtgtccgagcatttccacccgacggacgatttttcatccatgatcgaatcgcgagaaggtccggaaacctgcaattcgtacaacatgtcgaaacttgcggaacgactgtggctgcgttccggcagcgccgactatatcaacttctacgagcgggtgctggaaaatcacctgctgtccaccatcaatccgaagcagccgggattcgtgtatttcacgccgatgcgatcgcagcattatcgtgcctattccacacctcaggaatgcttctggtgttgcgtcggttcgggattggagaatcacgcccgatatggacgattgatttacgcgctgcagcggccggctgcgcaggattcggctgattcggctgctgctggttttgccagttctgccgccgagacgggcaataccgtttcaaacaatgccgaggcggaagctacgcgcctgctggtcaatctgtacatcgattccaccttcgactgcccggagcagggtctgcgcatcacgcagcgcgccgctcgcattgaggatggcgtcgattacacggtgacgttcacgttggaatccacggccgagcatgttcccggtactcccggtggtttgcgggaaaccacgctgtttctgcgccgtccgtggtgggcggagcattacggcgtcatggaggccacatgcgccgtctgcacgcttgatccggcacgcaccaacgatattcccgaaggatatctgccgttgcgtctgcgctggaacggcgttgcggaagtggtgatgcggttgcggccgcggatcaccgtcgagcgtatgccggacggttcgccttgggtcagtttcatgaaggggccgaaggtgatggcgctggcttcggatagcgacgatatggacggcgaattcgcggacgccggccgtatgagtcatattgccactggtccgttgcgtccgctcgtatccatgccgatcatcaacggcaatccggtcaaggcgtgcgcgcaggtttccagaccgtacgtgcatggcctcaccgttgccgcgacggacgtttccggccgtaccatgctgttcgacatgcatgcgttcagcagtatgcatggctgccggtattccgtgtatctgccggttgccgacgatggcaacgtgtgtgcgttgcgcgcgcaactggccgatatcgatgcgcgtcaggccgctagcgagcagaccgttgtcgacaccatcgcatgcggtcagcagcaatcggaagtcgatcatcggtattcgggcgataacgacatgatgggtgccgacggcacgttgcattggcgtcgcgcgttggctggtggcgaattccagtatgcgatgcgcgggcgtggtcaggcgcatcgtttggaaatcgaggtgattgccgattccgcggaaagcgacggtgaaaacgcggcgtatgaagtgacgctcgacggcctgccattgcagcgtggcgagcatcgtcgcatcgacggcgatcccacggcaatcgacgtgtatccgctgccggatgccatagaaactgcggaaaccgcggaaaatattgagaataccggagaaaacgacaatgctgacgacgctgcgatcgtacgcatctcggcttcggcgcatgacggcgcgaaaatcaccgccctacgattgcataagtaggattgcagcgatgaaaatcgcgatatggcagacgactgaccgtccgggggcgtctgccatggcgatccggtgattggaggatgctgatacgcattgtggcggcaacgatggtattcgttgccgccacaatgttttttgcggttgctttgccggttgccgttccggctggcgtcggttgccgtcaatgagtgggtgccttgcctgccgccgacggtcgttgcgacggttattgggctccgttcgactggtcgtctccggagttgtcgccactgctgttgccgccgttgccgccgtccccggagttgtctccgccgttattgccgctgtctccgccgtctccgccggttccggaattgtctccgtctccgttaccgccgctgttctgatcgctgttttgcgtaggatcgggtgtggtctgctcggtgttctcttcggccttcggcatctcctgattctgccgtgtctcggtcttctgcgcgccggtgccccatgtgccgtccgggccgccgatcttgccgttgtcggtcggttcggtgaaggtcagcacctcctgattctgcaatgcgagcgacatgaactcctcgaacagatgcgacgggtagcccgtggaggaaacgccatagcctgcgaacgatggcacttcctgcgcgctgccgtcttccgcaggattccaaatggcccacacattgagcagctgcggcgtgtagcccacgaacgaagcggccttctcgtcgtttgcggtaccggacttaccggccacctgacgtccgagacgtgtcgaaacgccagccgcggtgccatacgtggtggtgccctgcatggccttctgcaccagatggcaatcgttcgcatcgaacacctgctggttctcctgagccgtcttgtacagctccttcgaaccgtcggacgtgagcaccgtgtcgacgatgtgcagcgtgttcttcacgccatcgttcgcaatggtggagtggccttgcgccagatcccacacggtaatgccgttgatgcccagaatgttgtaggtggtgtcttcggcgatgtcttcctcaatgcccgcctgatgcgcgatcttggcgagattcgcggcgccgaggtgcttgttgacctccatgaacaccgtgttcaccgaattcgcggtcgcctgatagaggttgatatacccgtaattggtgttcaacgcgttcggcacctgcgcggtggttcccggcgtcgtttcaaacgtcaggccggaattaccgttgaacaacgtgttgaaattcacaccctcctgagcggctcccagcaaaccgaacggcttcatcgtggaacccggctcgaacgtggcctgcgtggcgttgttgagctgcttggtgaggtaatcgttgcccgcatacatggctttcacggaaccggtcttctgatcgaccgcaatgccgcccacctgaatactttccggcatgccctccggtcgggtgtcgccgacctgctgaatctcgtcctgcatgtccttgtcgagcgtggtgacgatcttgtagccgccggtttccagatcatcggcggtgaacgccttggaattgaccagttcgttcttcaccgtggtcagcagatacccgttcgcgccggccatctggttgctctgctggatttccgacacggcggggaactgcgcttccttcttctcctgggcggtgatgtagccgtcttcctccatgatgctgagcacgcggtcgtagcgcttttcggcctgttcctgattgacggccggatcccatgagctcggcgccggaatgataccagccaacatggcggattccgacaaggtcagatcgctggcgttcttgttgaaatacgccttcgccgccgcctgaatgccatacgcgccacgaccaagataaatcgtgttcatgtaattgcacagcacctggctcttatcttgtgcctgcgcgatcttgatggccaggaacgcttctctcagcttgccggaatacgacgtggtttcgcccaaatagtagcgttccgcatactgttgggtgatggtcgaaccgccctgacggctgcctgtggtcagattcgtatacagcgctcgcgcgatgccatacagatcgatgcccttgttggtgtagaaggaacggtcttccgacgcgacgatggcattgcccacataatccggcaataccgcacagtcgatgatttcgcggttctgttccgcgtagctgccaatttccgtagtgccgtcggcatagtagacggtggttttttcggcgagggcgaacttttccggctcggggatttccgtggtgatatacatgtaggcgaacaggccgattcctgccgcgagtagcgctgcgaagatgccgagtacccacttcagcacgagatgcttgcgcttgttctgctttttcttaggtccgttggcgcggtgcgatccgtggttctgcggcttgggtgcgctatgggatgcgttgctgcgattgctgccggcgccgccgctgcgggcgcttcttgagcgtgagcttacgcttcgtgtgtgtgaaaccataggttccaccgtagctgattgacttgagaaatcaggtgaaaatggggtgagtttgcccttgggagggcattttttgcgcagctcttttacaaatcgacagtttgtgggtcgttgtctcaatatcggctgattttcagggttttatcagtttttcaggtgccttttcgctgtttcgcaggtatgcttgaaatttggtacctgtgaaacgcatatatacatatatataacagaggagtcgtttacagatgagcattcgtgtagctatcgctggcgttggcaattgcgcttcttcgctggtgcagggcgttgaatactacaaagacacgaaggacgaggataagattcccggtctgatgcacaataatttcggcggatatcgcgtgcgtgacattgaattcgtcgccgcattcgatgtggacgcgctgaaggtcggcaaggatctgtctgaagccatcgaagcgtcgcagaacaacacgatcaaattcgccgacgtgccgaatctgggcgtcgaagtgctgcgcggcccgaccaacgatggtctgggtgaatactatcgccagatgatcgaagagtccgacgccgagccggtcgacgtggcccaggtgctgcgcgacaagaaggtcgacgtgctcgtttcctacctgccggtcggttccgagcaggccgacaaggcatacgcccaggccgccatggacgccggatgcgcgttcgtgaactgcctgccggtgttcatcgcatccgatccggaatgggctcagaagttccgtgacgccggtgtgccgatcgtcggcgacgatatcaagtcccaggtcggcgccaccatcacgcaccgcgtgctcgcccgtctgttcgaggatcgtggcgtgcgtctggaccgcacgtaccagctcaacgtgggcggcaacatggacttcatgaacatgctgcagcgctcgcgcctggaatccaagaagatttccaagacccgcgccgtcacttccgtggtgccgcacgatatggatccgcataacgtgcatatcggtccgtccgattacgtggcatggcttgacgaccgcaagttcgcgttcgtgcgtcttgaaggcactacgttcggcgatgtgccgctgagcttggaatacaagctgcaggtgtgggattccccgaattccgccggtattgtgatcgatgccgtgcgtgccgccaagatcgcgctcgaccgtcatctggccggcccgattctggctccgagctcctatttcatgaagtcgccggccgtgcagcacgaggatggcgaggcccgccgcttggtggaggagttcatcaagggcgaggtcgaaggcagcgaagagcagcttgacgccgatgtcgccgccgccaaggcagctggcaaggatgtgtggcgcgcctgatttttagttcgcctgatatgaggaatccccaatctaccgtcggtggattggggatttttaattacgatttggaaacgatgcgtatcgtcacttcttgagaaggggttcgacctgttcctcgtacgcggtcaacgcggtgtcgatcacattgtgcatgtcgtagtacttgtacgtgcccagacggccgccgaacaccgtcttcggctcggccttcgcgagctcctcgtacctcgcgtacagcgccttgtcggcctcggtgttgatcggatagtacggctcgtcgccacgctcggcgaaacggctgtactcctcccataccacggtcctgtcgggattctgcgaggcggcgcgctccggattgaagttcttgaactcgatcgcgcgcgtgtacggcacgtccgcgtcggagaagttcatcaccgggcagccgaaatggtcgccctcgtcgtaacgcacctccttgaagtcgaccgtgcgccacttgagctcgcccagcgagtagtcgaagtagcggtccaccgggcccgtgtacaccaccggcacgccggccgcggccaaagccgccttgttgtacggctgggactcgtcgaagaaatcggtctccagggtcacatggatgcgcggatcgtcgatcatgcgctccatccacgcggtgtagccgtcggccggcaggccctcccacgtgtccttgaaatagcggttgtcgtagttgaagcgcaccggcaggcggttgatgatgcccgctggcaggtccttcggatcggtctgccactgcttgcccgtgtagttcttgatgaacgcctcgtacagggggcggccgatcagcgaaatgcccttgtcgttgaggttctggggatccttgcccgccagctcgccggcctgctcggccacgagcgccttggcttcggcgggcgtgtagtgcgcgcggaagaactggttgatggtgcccaggttgatcggcagggggtagacctcgccgtcgtgggtggcgtacacgcggtgcacgtagttcgtgaacgaggtgaacctgttcacgtagtcccacacgcgcttgttggacgtgtggaacaggtgggcgccgtacttgtggatctccgcgccggtctcctcgtccatgtagctgtacgcgttgccgccgatgtggtcgcgcacgtcgatgatctccacgcgcacgccgagcctctccacggcctgctgggccacggtcaggccgaacaggcccgcgcccacgaccaccagatcgggatattccaccgcttcagtcataagaacaaccttccgaacttaaaacaaacacacaatattcgtgtgcgattcctcatcaagcatacccgtccgccctccttaacgcgggatgctcttggggaagcggcattttgacgtttgatttccctgtgtcgctggtcgtggggctggctgctccacggatcatggcatggtctgtgtggttcgtgcgcggcctgtggcgcgggttgcgctgcggttcgtgcggcttgcggcgcggttcggtccgggcatggtgtacactggtctttgcctccgcgtggcggtacgtcacccaactcccccagggcaggaatgcagcaagggtaagtggcctcttccgggtgcgtggaggttttcttatgtcttcatgccattcgcgcataccgtagagccaatgccgtattctcgatgattatgaccgacgaattcaagccaatcatccgagacccgcacaagtccgcgaatatgctggaacagccggtcgcgcccgttcccgtgccgcagccgccgtctgatccgatcgaacaggtgctttccccacgtgaagtgagcgaagggcttgccaaagccgatccgctgacccgtcatccgcgcgtgtcgagcattatgctcagcgtggtgttcggtctgctgctgcttgccgccgcggtgggcgtctggtggttgggcgtgcgcacgatggaaggccaaagctatgaagacatggtctggtcgaaattcgatgcggccctgccgggatggctggaaccggtcgtgcatgttttcaccatttccaccgttgtaatcgcaacaagcgcgattatgtcgataatcgccctcgccgtacttatcgtaagaaaacgatggctgttgattgctcaactggcggtattcggcggaatctgctttgccgcagcagagttgctgaagccgctgctgccacgtccgtacttaatcaatctggaatcaaatcccaataattccgcgccttccgggcatgtcatactcgccgccgcggcaggaatgatcctactatgcgccgtgcctcgcgtatgccgtgcgctcgttgccgtgatcggctggctgtatgcggtactcgtcggattgtcggtgattgcgggacagtggcaccggccgaccgacgtgatcatggcgttgctgatcgtcggcggagtggcaatgatcacgcttgccgcgacgtttgcgaacggcatggatgagcccggttcgcgtgcgtcgtcgccttccgtgcagatcgtcggcagcgtgctgttgacgttcggcgtgctcggcaccctgtatggcgcatacattatttggcagattcagccgggacttgcgatgagtgcggaatggacgaattccggcgcgcacctttccacggtgattctgacggcttccgttgcgtcgttggtgttcgggctggtgttgaccatgcgtcagctgaccgcctcgccattgacgaaacttgggcttgtcggtgcacctccggcccctccgaaacgctgacggcaaaacgtacgatcacgccgaaaatttccggcaccggtcgctcgcgccacacggacggtttgccaactgcatacggtcagtgagtattattgcgttgcaaacgctagtaataaggagtggctatggctaccggcagcaagctcgtgattgtggagtctcccaccaaggccaagaaaatcggtgggtatttgggctccgaatatacggtgatggcctcggtcggccatattcgagatcttgcgcagccgagccaggtgccggccgccgacaaaaccaaattcggcaagttcggcgttgacgtggaagacggattcaagccgtactacatcgtcgatggcaacaagaagaaaaccgtgtccgagctgaaaagcgcgttgaaaaaagccgacaccctgtacctcgcaaccgatgaggatcgcgagggagaggccatcgcctggcatctggtacagacgctcaagccgaaagtgccggttaagcgcatggtgttccacgaaatcacgaaggaagccatcaaagcgtcgcttgacaatactcgcgacgttgacgacgacatggtcgacgcccaggaaacccgccgtattctggaccgcctgtacggctatgagctttctccggtgctgtggcgcaaggttgggccgggtctttccgcgggccgtgtgcagtccgtcgccacgcgtttgatcgtggagcgcgagcgcgagcgtatggcgttcgtgcgtgccccgtattgggatgtcaccgcaacgttggaggcgccggatgccgatggcaataatgttgcgttcgagtctcgtatggtgtcgttgggtggccgtcgtttggctggttccaaggatttcggcgccgatggcaagctgactgcggccggtgcgaaggatcaggtcgtgcagttggacgaggcgcaggcttccgcgattgcgcaggcattggaatttgcaacgtttactgtcgcgtcgatggaaaccaagccgtaccgtcgccgtccggttccaccgtttaccacgtccaccttgcagcagaccgccggcaatcgtctcggcatgagctcgcgtcagaccatgcgtgctgcgcaaggattgtacgaaaacggctatatcacctacatgcgtaccgattcggtgacgctgtcgcaggaagcgatcgcagccgcacgcgaagcggtcgtcaagcatttcggcgaaaactatctgtcggacgcgccgaaacaatatgccacaaagacggcaggcgcgcaggaagcccacgaatgcatcaggccggcgggcgcgaaattccgtgaccctgcggaaatcgcaagcaaagtgccggccgaccagctcaagctgtacacgctgatctggcagcgcacgcttgcctgccagatggcagacgcaaccggttccacggcgaccgtgcgactgtctgcaccgaccgaatcgaatggggaagccatgttccaggcttccggcactgtcatcgaattccccggctttatgaaggcgaccggtgaaggccgccgcgcatccgccgaatcgaagaagggcgatactgctggaagcgttgaacaggctgcgcaatccggtaaatccagcaaagcggataagaagtcggatgacaatgtgtcgcttccgccgatgaatccgggcgatgcgctcgccgcggtggcggttggtgccgacggacacgaaactcagcctccggcgcgttacaccgaagcgtcgctcgtgaaaacgttggaacagaaggaaatcggccgcccgtccacgtatgcgagcattattttcacgattatcgatcgcgggtacgtgtatgagcgcggtcgtgcgttgattccgtcgtggctcgcgttctccgtggtcaaattgctggaaacgaagttcccgcggtatgtggattacgagttcactgccgatatggaaagcggtcttgaccagatcgcgagcggtcaggagaccggcaggaattggctgacccgcttctatttcggttccggtgagggtgccgcgcagtctgcggacgaggcgcatgccggcttgcagcagcaggtcgcgcagttgggtgaaatcgacgctcgcgagatcaatacgattgagatcggcgacggtttgcatgtgcgcgtcggtcgatatggcccgtatttggaggatatgaaccatctggatgatgagggcaatccgaagcgtgcctcgctgccggatacgcttgctccggatgagctgacggtggaagtcggtcatgatttgatcgagaaccattccggcggtccgcgcgctcttggcgtcgatccggtttccggaggcactgttgaagtgcgtaatggtcgtttcgggccgtatgttgcgctggtgatgccttctgccgatgccggcgatgctggtggtgctgccgagggcgctagtgagaagccgaagcgcggcaagggtgcgaagaaagccgctgccgatcgcccgaagatggcgtcgttgttcaagacgatgagtccggaatcgttgacgttggatgatgcgttgcgtctgctgagcttgccgcgtgaagtcggttcgtatgaagaggtggatgcgcagaccggtgaagtgcagacggttaccgtgcaagccaataatggtcgttacggtccgtatttgacgaagaccggtgccgatggcaagtcggatacgcgttcgcttgcttcggaagatgagattttcacggttgatgtggataaggcgaaggaactgttcgcccagccgaagtatggccgtgggcgtggccgtggcgctgcgaagccgccgctgcgcgaattgggcgtcgatccggaaacgcagaagcaggtgaccatcaaggaaggcttctacggcgcgtatatcaccgatggtgagacgaatcgtacgttgccgaagcagtatgctcctgagtcgatcgaaccggccgaggcgttccgtttgctggctgagaaacgtgcgcagggcccgtcgaaaaggcgtggacgtaagaccgccgccggcaagggcggggctaagaaggctggtgctgccaaggcttctaagacttccaaggcggcttccgtcgataaggctcgtgccgatcgccgtgccaaggtgcgcgagttggccgataagggttgggccaacacccgtatcgccaaggagatcggttccacgccgaccacggtgaaggccgatgtggaatggcttgccgccaacgaaggctacacccgtcccgccgtagttcccgcccggtgatgaacagtctggtggactgttcgtagcagtgagcagcggtagcgttgcgaacgccgcaatgtagagtgatgaatatgcaaggcatattcatctcctttgaaggtgtagacggcgtcggcaaaaccacgcaggttgaacggttgcgtgcgtacgttgaggcgcaggggcgcgaatgcgtggtcacgcgcgagccaggcggtactgtgcttggcgtggcgattcgcgagttgctgcttggcggcgtggaaggttccgatgcggatatcgctccgcgtgcggaggcgctgctgttcgccgctgaccgtgcccagcatgttgccgaggtgattcgccctgcactggaacgcggtgccgtggtaattaccgatcggtaccttgattcttctcttgcataccaggctggcggccgcgaattgacggcaggtgaaatccgcgacttaagtatgtgggcaacgtgtgagctattgccgaatcgcacgtatctgctggatcttgatcctatgcaatcgcatgcacgactacagcatgatgaagatcgcatggaatccgcgggagacgatttccaaaatcgtacgcgacaggcgttccttgacttggcaaaggcggaatcgcaacgtttccgcgtgattgatgccagccaatccattgaagaagtatggtcgcatatccaatctgattttgcgcaaatcggccaatcggaagctcttcaaacgggggctagccgatgagcgtgtgggattcgatcgtcggccagcagcaggttgtcgaacaactcaaagccatcgcaagtggcgatccgaaagccattgcgcaatcctggctgatttgcggccctcccggatcggggcgttccaatgtggcgcgcgcgtttgcggcggcgctggagagctctgatcatggtcttggcgacgagccgaccaaagccgcgcagcaggtgcttgccggcactcaccccgacgtgaccgtgcttgccaccaacaaagtgaccatcggcatcgacgaggtgcgagacatcatcactacgtccgagcagatgccaagcactgcgccgtggcgcatcatcattatcgaagatgtcgatcgcatgctggaacgcaccaccaacgtgttgctcaaggagattgaggagccgagtgagcatacgatttggctcttgtgtgcgccgagtgcgcaggacgtgttgccgacgattcgctcgcgcactcgcatcgtcaatcttgccgtgccctccacgcaggcggtggctgcatttctggagcaaaatggcggattcgagccgaaactcgcggtgcgtgccgcacgtcttgcggaagggcatatcggcatcgccaatctgtatgcgaaaaacgagcaggtcatgtctgaccgcgacgagctgatcgtgggcgtgctgggattgcgccgcgcgtcggatgcggtactgcttgccggcaatcttatcgacagtgcgaaagcgcaggccgaagcggaggtgaaggtcaaggcggcggaagcggaagccgattttcgtagggtcaatgggcttggtgcgaaggatcgtattcctccgaagctacgtggcgcgtacaatgcgatcgccaaaaaagacgagctgaagcgtcagaccacgcgccttacgcgtgacgtgcttgaccgtgcgttgaattcgatcgccagtatttaccgcgatgtggccgtgttgcagaacaatgccgaagattcggttggcttgattaatttggagaatcgttcgtcgatcaccgaactgtcggtacggcttacgcgtgggggagcggtgcggcggctggaggatattgccgtcgcacgtcgccgtctggccggcaatggcaatcccgtactggtctttgaagctctcttctgctccctcatcgccagctagggctagcggcgttggcacatactgttttccgagggcagattcttccagcgggtggggaaatggttgtttggctgtatgattctggcttgctatcgtgcgataactgccggcaaaattgcaaaaattgcgattcagcgctggcagttggtggattcgcggacgatgagttgcggcgcgagtgagatgtgcgcggggctgccgggggcgtcgttgagtaggcgtagcgcttcggagacgatttgtttgaacggcgggcgcacgctggtcagcgccggcatggtggtgcgtgcaatcggcgaatcgttgtagccaaccaccagcacatcttgaggcacgcgaagcccgagcgaatgcaacgccaccatcacaccgaatgcgatcgcatcgtcggcacacaccactgcctccggctgcacgagcggctcggaaaacagtcgcatggcgcagtcgaatccgcgctgcacgctacggtctccgaacttgttccattcggtttcggtggcaagatggtgcgctcgcatctgcgtgtggaacatggcgaacagttccgccgattcgaaggagatttccttgccggccatgtatgccacggatgcgatgccacgttcggccaaatgcctgatcacgatttccatggctgtgttttcgtcgacgctcaccatggatgtgcgggatgagcatcgacggccgcccacctgcacgatcggcagtgtggaggcgtaatgttcaagttcctcggaaaggtaggctccccaggcgggcagtacgatcagcccgtcaacatggcggtccaccaacgattcgatgcgttggatctgcgtggcttgatcgccgccgatgccgagcagcagttgctgcgaatccacgtcgatgacgggttcgatttcgtcaagcagttgcgcgcagaacgggtcggtggcggttggaatcaccagtccgatggtgttggtgacggtgctgcgcaacgcgctcgccgcataattgaccgaatagttgaggtgtgccgcggcggctctcacacgtcgtgcgatgtcgtcgtctttggtgcgttttccggaaagcacgcgggagacggtggcgatggagacgttggccagcgcggcgacgttcgtgattgaactgttcgccgaagtagccgaagccgaggcgttgtcggttgtgcgtgccatgctctcctcccaaaatcattcgaagtattggattattcgaattgctgccgtgtctcaatcgcgtattcaggaataaaacagccacccgtcgaatgcggcaggtggctgaagcaagtatcgcaatcatgcatatggaattgcgattgcattgcgatttcataactgaagattgttgaatatcttgcgaaatcctcgaaaatcttcagaaaagaagatcactcggcgttgacgaggatgttcagcaggttgtctgccacggtttcgtcgtcggcgccctgcacgtcgatgaccacggaatcgccctgcttgatgcccaggcccatgatggacaggatggagcctgccggaaccgggttgccgccttccttggcgatggtgacggtgcagccggaggcggtgacggcctgggagaactgtgcggccggacgagcgtggataccgacgggatcgttgatgacggtggtgcgggttgccatgatggacactcctttgagtcgttattgttgattgttttctgttgtgttatttgaaagtcgtgctgcttgccgagcgaaatgcatcggtgcgccgctggtgattactatagcactttttccacgaaacgcagaaaacgtttactggttgtgtgttgcggtttaaagcgtgtatactgtgggcaggctgaaaatgatttaccggcaaagacggtggaaatcattgcggtaactcaacgcgcaaggcaggcgcggaaatcacaagaacacgttcggctcgcgttcctttcgcgagcaaacaacaaacgcaaacgacaaaacaaggaaacaggtcaaaggagttcacatgatcatcaagggtgttggcattggtcgcggcgttgcagtcggcccggtcatccgtatggcgcagccgctgccggaaccgtcggacgccccgcgtgcggaaggcattgccgccgaaagcgaaatcgcccgcgtggaaaagtccctcgcactggtgaacgccgacctgaaccgtcgcgccgaagaggccgccaatggtgacgaaggcgccaagcaggccgctccgattttgcaggccatcgccatgttcgcttccgatccgtcgctggctgaatccatcaaggggctgatccagcagggcaagaccgccgaacgcgcggtgctcgaaggcttcgccgcggtggaagacatgttccgcgccatcggtggatatcaggccgagcgtgccgccgatctgcatgatgtcggccagcgcgtgatcgccgaccttatgggcgctcccgcaccgggcctgccgcagagcgaaaccccgttcgtgctcgttgccgaagatctttcccccgccgacaccgcggcgctcgacatgagcaagaccctcgccatcgtcacctcgcagggcggcccgacctcgcacaccgccatcctggcccgtgcccgcggcatcgtggcggttgtttccgcagccgaagccgagaatctgaccgacggcaccaccgtggtcgtcaatgcggccaagggcgaactggtcgtcgacccgaccgaagaggagatcgccgcagccgaagccgccaagtcccgcgcggccgcagccaaggaactgcgcggcaatccgggctccaccaaggacggccacctcattccgctgctcgccaacgtgggcaagccggccgacgcagctaaggcgctggaatatggcgctgaaggcgttggtctgttccgtactgaattcctgttcatcggcaactccgagccgccgaccgtcgaagagcagacccgcgcttacaccgagctgttgagccagttcccgggcaagaaggtcgtgattcgtatgctcgatgccggcgctgacaagccgctgccgttcctcactccggaagacgagccgaatccggctctcggcctgcgcggtctgcgcaccctgcgcgcccacatggacgtgctcgaaggccagctcaaggcgctcgccgcagccgatgccgccaccgacgcgaacctgtgggtcatggccccgatggttgccgaccagcatgaggctgactatttcgtgaagcttggcaagagcttcggtctgaagttcgtgggtgcgatggctgaagtgccgtcgatcgcgcttatggccgataaggtggccgacgtggccgacttcgtgtcgatcggcaccaacgatctgacccagtacacgctggccgccgaccgtacgctcggttccgttgccaactatcagaccgcctggcatccggcggtgctgcgtgccatcaagatgatctgcgacgcgggcaacgccaagggcatgccggtgggcgtgtgcggcgaggccgctgccgatccggacttggccgtagtgctggccggtcttggcgtgaactccctgtccatgactccggtggcactcgacgacgtgcgtgcctcccttgccgaagtcaccttcgaagaggctcaggcccgtgccgaagccgccctcaacggcgacttctaccacccggccaactgagccgtactagctgtgcctatcgcctgtaacgccttgtttttcaagcgatgtgaggtctgataggccctgtttcccggaccgacccctgcccgcgtgccccacaggctcgccgcaggggtcgtttcgttatgtttcgttatgccgtcaattgaaaccttgtatgagtcagacgcttgagggatactgggtgcatgaagatttccgcagatttcaccgtcattcccgacgcgtttgccaaggcggcgccgcctgagaactgcatcgacggtacgccgattgtttccttccccttctacattgatgcgcttgatcctgcagtgcagttcctgcattgggaattcgttgatccggattcaattccggtatgcggtttccagtggaatcattggtccctcgcgaacctgcccgtggatgcgctgatgtacgatttcaacgattctcacgcgctcgcgattccggctgatttctcgcgcacggtttctgcgatgattcctgaaacggttcagggacgcacgtccgccgcctcgccgttgctgcagggccgcagcagtgatcccgcagtgacgatgcgttacaacggtccatatccgccagatcaggatcatgactactatctgcatgtgtggggtaccacggctccgctcgccggcctcaatcagggattctggctcaacgaaatggaacgtgcgctgcgtacttccggtacaatcgttgatcagggcgctattttcctcactggaaaagcctgatttgtgaaagaggatctcaagtaaggccagaaatttgatttccgcagcaatataacgatataaagatgcggaaatcagaaatatatccgacgaaaacgtattgacaataatcgaaaggattgctgaataattatggcgtgcaccacgattttggttggcaaagacgcaagttatgacggatcgaccatcatcgcccgtaatgaagatagtgcaaatggtgagttttgcccgaagcgcttcatcgtagtcaagcctgaagatcagccgcgcaagtacaagagcgtgctttcgcatgttgaaatcgatcttcctgacaatccgctgcagtatacggctgtgccgaatgccgatctgaaggaaggcatttggggcgaagctggcgtgaacgaagcgaacgttgccatgagcgccaccgaaacgctcaccaccaatgagcgtgtgctcggtgccgatccgttcgtggaactcacgccggccaaaggccaggaaggcgaagagggctatgagccggaagtcgccggtggcattggcgaagaggatttccttactctcgtgctgccgtacgtcaccaccgcccgtgagggtgtggaacgtttgggcgctctgcttgaggagtatggcacgtatgagatgaacggcgttgctttctccgacgtcgacgagatctggtggctggaaaccgttggcggccatcattggatcgccaagcgtgtgccggacgaagcgtatgtgaccatgccgaaccagctgggcattgacgaatttgatcttgaagatgcgtttggcgagcaggaggaccacatgtgctccgccgatctggccgagttcatcgaacgcaaccatcttgacctgtcggtggagaattccactccgttcaacccgcgtgacgcgttcggctcccactccgattccgaccacgtgtacaacactccgcgtgcctggtacatgcagcgtttccttaacccgtacgacgagcagtgggatggtcaggatgccgaccacaagccggtttccgacgatattccgtgggctcgccagccggaacgcaaaatcaccatcgaagatgtgaagtatgtgctgagctcccactatcagggcactccgtacgatccgtatggaaagcttggcgaccagcgcacccgccacatgttccgcccgatcggcatcaaccgtcagagccagcttgcggtgatgcagatccgcccgtaccgcccgcaggtgagccgtgcgatccagtggatcgcctatggttccaatccgttcaacacgctcgtgccgttcttcccgaacgtcaactccacgccgaagtatttggaagacaccaccacgcgcgtcacgtccgaaaacttctattgggagaaccgcatcatcgcggccctgtgcgattccagcttcgccgacaccgccaacgccgtggaacgctatcaggagaagaccggcgcgatgggccaccgcatggttgcctctaccgacgagcagatcgaacgtttggtggctgacgtgaccgacgaattcgatgcggaagacgaaatcggcgatgttcagcctatggaaccggatgaaatcatcgaagccgtgcgcaacggcgaagcccgtgaaatccttgccgcagccaacgagaccatggccgcgcagctcaaggaggaaaccgacaagcttcttgattccgtgctgtacaccgccagcatgaacatgaagaacggcttccacatgtcggacttctaaaatctcactattcggctctcgtgaccacgttgcgggagccaattattttccgcaatacaacatcgttagaatggcgtgcattccaatttgaagaaaggaaccccagtgaccagcattgaggatttcaccagccagtacggcttggtgcagaagattgatgcgttcggctatctcgattatttgaagaatgatccggatgctccacgcaagcatggcaaggtcgtgctcgtcaccgccgatactccgctgaaggcgtctcgcggcgagggcaagaccaccaccacgatcgcgctgatcgacgcgttgcgtgagcgtggcattgatgcggccgcagtgctccgtcagccgagcatgggcattaccgctgccggttccaagggtggcgcttcgggcggcggcaaggcttccctgactcaccctgagctgatcgactggggtctgtgcggcgaaatgggcgctatcgaagcggcccagaacctgctggtttccttcgctgagaaggccatcgacgacggcaagctcgacgatatcgccgtgccgcgcgtttccgaagtgccgtcccgttcgctgcgtcagatcgcggtggaccgcggcaagggcaatgtggccgagcgtgtggtgctcactccgacctgcgagctcatgcagatcgtggtgctctcccgttccatggatgagatcgccgcgcgcgttgccaagatgattgccggcacgaaggacggcaaggccgttacgttcggtgaattcgttgatttgtggcgtattaccggcattctttccgatgcggtgaagccggcgaagacggaaacggtgaatggttctcccgtgtatgtgcacggcggtccgttcgcgaacgtgtcgatcggcattccgacgctggtttccgtggaaatggcgtgcgccctgcatgatgtggtgatcgtcgaggccggttacggtgctgacgcgggcgctcagaagtggcttgacattgcttgccgcgagtatggcgcacagtggccgtccgccgcgattgtggtgacccgcgcttccacttggcgtgacgatccggcgcttgcctggcgttacccgttccacgtgcagcgtttggaaggtcttgatattcctacgttcccgctgattaacctgtgggatggcgaagacgatcaaattccggcgttgcagcagaccgccaaggatctggagttccgcgagccgattatcggcaacctgtatcgcgatggcggcgatgcgctcgccccgcagcttgacgcgttcgttgacgcggtggtgaatggttccatgccggccacgccgcacagccacaagggtatggctctggtggagaacgtgcgttgggttgccgaaaatgcgtatggtgttccggcagatcgcgtgatcctgaaggacggttttgctgaatcgcttaataaggcggtggacctgtgcgccagcgccggtattgatttcggttcgcttgcactggttgcggtgaagtctccggccacgatgactgacaacgattccgctccggctgaagagcgtacggtgacgttgaagaaggttgaagtgcattccggtgccggtttggtgcatgtgaatctcaccgtttcgctgaccacgccgatgccgaagatcgtgtgataaacgagtcgtagcgttctgatcgcaacattttagggcggtcacttgcgtatatgcgtaggtgaccgcctttttgcaccttaatttcggcggtttctagcgaacgtcgcaacgccatgacctcgaaggaacggaggtgacttcgtcagaagttgacgccccgaaccgtgaggcggggaacacggtgtgtttccccgtaggtgaggtgagaggttcgcaatatgggcgaacctcgaaggaacggtggaaacttcgtcagaagttgccgccgttccagccccagtcggtggtggcggtgtagcggatgtacgtgcggtcggccgggatgcccagttccttctccaacgcggccatgatctgctcggtcagcttctcccaggcggaaccgggcacggaacgaccgaacacgttcacctcgacgtatgcggccggcttggaatcgtcgccgccgaaataaatcggcatattgtcttcaaacgggcacatcagccagccttcggacttgccgggaacggcggtgatcgccttgccgtatgcggacttcagcgcctcgcgctgctcgggagtggtggaaacggaaacatgagtgtggatgactggcatgatgctctccttggattgttggaatcagcctttgcgtgttcatctccagtctaggcgtcaaacggctcagacgtggtggctgtgtgagaaattttgggctttgtctggatatccgccaaggtggtctgcgtgcgcgtgttaaatattcgttgtgagaaaactgattgaacagcttatgaaatttggcctcgttggcgtgatcgccttcattatcgactggggcattctgaatcttctcgtcggcgtgttccatatgcacaacgtgctcgccgcaaccatctcgttcattatttccctgattttcaactacattgccagcatgaaactggtgttcaagcaccgtgatgacatggcccgttggatggaaatcctcattttcgtggtcggcgcggtcatcggcctgttcatgaacgacgccattatctggatctccacgtatggcatgaaccatgatgcctacgtgtcgcagagcaccgaatacctgatccgcaccaacgtcggcaagctcatcgccaccgccgtggtgatggtgtggaatttcctgacgcgcaagtggctgctcgacgatacgcacaccaacgccatgaaccgtttgcgcaaagccgacaaccgcctcacgccggaagagctggaagccaagtggcagaacagcttctcgcacaggctcggtgtatggtcgctggagcacacccccaacggttggcccaagtagtcctgaattcggaaaatctgtctgcacaacccggaaatctgccctgatcaaatctgccctgattcccgactcgcgcagacggccggacagtcctgaatatgaaaaggcggtgccttacacctataaaggtataagcaccgccttttcgtatgctctgcatgctttacgtgcgaaaggtcacacgcttacggcggtaagcatgggctgctcggtggagtccttgatctgcttgaagccgaacagggcgatcgccagcgaggtgagcgccagagccgtcactacaatgaaaccaccgtgtgatcccatacggtcgatgaactggccggcaatcgccgagccgacggaaccgccgattgagttcatcgcacccatccaggccatgccttcggtgaagcgtgtgggcggcaccaagtgcagcatcagctggttgccgttcacccacgtcggtgcctggcatacgccgatgaacaggtagatgatcatgatcacccacagatgtttggcgaacatgaacgagccgatgcctagatcgaccacggcaaggcagaagtagaaacgcttccacagcggaatagtccaattctttgcgccatacacgagcgcgccgatcagcgagctgaacgagaagcaggcgaacacgaaaccggtgtactgcttcatattcgcttccgtggcgaacgcgacgatcgaaatgccggcggccgactggaacgcgcccaaaccgaaccacgtcacgcatacggcgattaggcccggcccccaaatcgactccttgcgcccggcattcacatccgcggcggcctgatccatggcggcctgcacttccgcagccgtcttgccttcggaacgtgcgcgatcgcgagcgtactcaatggccgcttccgcctgcaacgccttggaacgggcggcttcgcgctcacggtattccttgcgggtcatgcccgcttcgcgagccagctgcgtctgcgatttcggctcggtggaaagttcggtgaggaacatgagcgcaccgaccaccacacacacgccagtgaatgagaatgccaacagcccggaaatcacggccagtgtggaggcgagcggattgccgatcacccacatgcattcgtcgaacacgccggaaagcgaaagcgcgcggttggttttctccgtgtcacctttaagcagcgtggtccaacgctgacggctcatcgcgccccacggcggaatcgccgccatgaacggtacgatacagaacagaatccacgacggcactcgggcggtgatgcaggaaaccagtgcggtcgccgcaatcatccacacgatgattgtcggaatcgacacctgacgctggccgaacttgtcaaccagcttgccgagcaccgggctcgcaacggccagcgcgatcgcctgcacggccgtcagcgcgcctgccagcgaataattgccgtaataatgctgcacggaaatcgtgatcgtcatgccgaccatcgggaacggcatgcatgcgatcactgaaccgaccgaaaatcgggcggtgtgcggtatgcgaagaagctccgcgtaccctccgaaaagatgttggccgatgcttttggcgccggcgaggactgaattggtcatgttttgccgctcctttctgctcacggttggtgcttgcgtccgctgcgttgcgttgccgcggaccgcttgacatacccttgttctgtcttgattgttttctctccagccccagtctctcacttcaaccttgcttgaacgtcaatcgattgacgttcaagcgtgttgcatagggggtggagattggttgtgtgccattttcttgaactagacaactttatgcggaggtactgtcgcaacacgcggtgcattgaggttggcagacataattcgattggctattttgtaagtactcaccacacgttcacttggtggacgaaaagatgtccggcgggcgaaagacggttgttgcaaaatggttgcgcaacgcttccaaagcttgcgattgcaggattttcgttccatcggtcaacgtcagcagtccggcagcatcttgcggaaaggcggtagggatgcccgcaacaaccatccatttcgtacgtcacggcaaagtcgaaaatccagggcatttgctctacgaacgactgcccggattccacctgtcggaagtgggtgtgcgcatggcgcaggcgaccgcgcactacattgccgtcaatccacgactcaacacagtttccgccatctactcgtcgccgctggaacgcacgcgcgaaacggccggcgaaatcctcaccgcactcaacgaagtgcgtgaaacccgtggcgaggagccgctggaactcaccaccgacgagcgcatcatcgaagcgcgcaacgaattccgcggcacgcgcatcggctacggcgaaggcgcactctggaaaaacggcaactggaagctggtacgcaacctgtggaagccaagctggggtgaaagctaccagtcgatcgcgcatcgtgtgcaagcgttcgccctcgaaaaagtgggggagcatcccggcgagcaaatcatcgtagtcagccatgaatcgcccatctggagctacaggcacatgctggaaaccgggcacccggaacataatatgctgctacgccatacggcactcgcctccatcacttccattacgtacgattgcgatacacgcaaagtattgtcgatcgcttacgtcgatcccgcggccgacgtgaaatagcgcataatgcggcatggaatcgccggattggaaacttttgaccgagacacgcgacaatgagtgcggcggttgttgaaagaacggggattccatgcaatcatggaagggctggatgctgttgggtccagtgaggaaaacaaaatgtcgaagctgcaaaggggcacgcatggctttcactatcaacaacggagcgctttatcaattattcgataggcctcatatgaaaattgccatcgaaagctgtgttggagtggtggaattatggccgctgcaaaccgttcaggagatggagaatgacgcaaagtacacggaagatctgcaagtaagattctcctgcaccatggcaagggcaatgctgcgattgtcccacgggattaacccgtccgtggcggaagccgtgtacgagggaatggacgagattccgggttgcgatccggaaattgtgcaagcgctcacgcgggccaatcaggcatacgatgtgatgcgcaattattccgaaaccaacaatgccgacctgttcttcgaagcggccgacattctgggcatcttcatcgacgcccatgtcgagacggaagtccgcaatatactgcaaaagatcgtggagtacattcggcagagcgtcagcctgggcttcgacggcggagcgctggaagatgtcaactactgctacgctttcaccacgaccccaaggacgctcaccgggcgattcctcgcggcgctcgcggtgggtgacggtctgatgaatctcatgtgcgaaggcattgacgatgtggacgaacagaccgtgcgcgtgctgccggtgatgctgtacatcaacgagttgtgcgagcagatggctgttccgccgatctatgtcggcgacgtgaccttgtctcgaatggttgcgctgcgtaatgctgtgcgtgaggcgggcagggcaacgccactcgaggagaattccttctgcgacaacacattcaccataaccgcggacaatgtcattccgtgcgcgggtatggagtgggatcatcatgcggagtgcctgcgttgggatccgaagagggccgagcaggaagccaaagatgaggatgaacgtaagagcaaggaagcgctcgctgaaaagttcaatttgatgacggacgctatgaaaagtatgagctacatggatgattccgatgattcgggtgattcaggcgaaggtgcggatgctgcgtgacgtgggcaatccgagataatccgaattagtgggaattatcgatataggaataagaaaatcccggcacttgcgattgcggtgccgggattttctttatgtagtactgattattgcaagttcggttcttaagttcagtgctgaacctgcatatttcgtcaatgctgtatgttgccgtacacggtaggatcgtcggaatcgtcggaattgtcggatccgtacggggtctggccctgcgaatcgttgccgaacgtggggcgatcgaactgcgtctggtcaagctgggtggactgttccggaaccgtaggcagcggaggcatgctcggcatggaaggggcttcgggtgccggggctgcatgcggagttgccggggcggccggagtgtactgggcggctggagcggctggcatcgcaggtgccgcgtactgatcggtcggagttccgtaaggagcgccatacgggttgccgtacggagtgttggtggctgccggggctggggtcggagcgccatacgggtctgcggtgggcattgccggagtcggcgcaggcattgcaggtgccggagcggctgccgtatacggatcagcggttggcgtcggaacagccgctgcgtacgggtcggcgaccggtgccggagtgccgttcggggcgtattgtgcggttgcggtcggtggcatgcccggggctggggcgtagccgttgccggctgccggatcgtcgaagcgtgcgccggctggatcggtcttcttggccatgagcacaatgagcacgatcgacgtggccaggcatgcgatgaaaccgatgatcaacaggagtatgccggctgtgccagtcgagctcgatccgccaccgattacggaaatggcgccaagtcccgtcatgacgaggccgacgctcagcagaacgccaccgatgaagtcaatcgcgtagaggatgaccagcgtggtgccggccttgttggtgtcgtgcaggcggcgaacggaaagcgcaagggatggaacaatcgttgccagtgcccaaatggtgttgacgaagcttcgcattccattggctgtattgctgtcgatgatggcgcccaacaccgcgaagatgacggcaaacgcgatctggatgatgaatgtgcacagaacccaccaccagaattcgccgcgggaggcgcggcccttgaacgtggcgtactttttccagaagcggatgaacgcctcgccgatggtgcagttgtaggccggctggtcgagcggagcggtcagtgcgaagaagctgccggacccctgtggctgaggttgcggtgcgccgtattgcggctgctgctggttgtatccggccgcattgccgtattgcggcgctgtattgaggcgcgccatactggggtgcctgctggccgtagtcgggtgcgccgtattgcggtgcctgctggccgtaatcattctgaccgtaggagccgtaaccgccatattgctgggcctgctgcgggttctgcggattatattggttggggtccgtcattagattaccctttcggaaagtgaatcgacatcaaaaaagtgaagtcgattaacacagtactcttgcatcgccaaaaataccgaaaaatattgcagtgtgggacaatcccgacggaccccgcaaaaatcccctttgacttggggcatcttctgacgcgttggggaagtccgtcgatggcgcggctcatgcccagcatggtgttgtaaggattggtggctgcgatcatcgggtcaattagctgcaggatgtttatgaccgcgaaaagcgagttggtgcgtgggactggatggcacgtccggtttgcggggcacaatggagcttatgactgaagctgaaaacaccaaaccagaacttcctgagcacgttcgcgtgcgtttctgcccgtccccgaccggcattccgcacgtcggcatggtccgcaccgcactgttcaactgggctgaggcccgccataccaagggcacgttcgtgttccgtattgaagatacggacgcccagcgcgactccgaggaaagctacaaccagatcatcgaagccctgaattggctgggcatcgactgggacgagggcatcaacgtgggtggccccgacggcccgtaccgccagtccgagcgcggcgacatctacaaggatgtcgcagccaagctgcttgaagccggctatgcatacgaatccttctccactccggaagaaatcgaagcccgcaacgtggccgccggccgcccgaaggctttcggttacgacggctacgaccgtgatctcaccgaagagcagaaggccgccttccgtgccgaaggccgcaagcccgccctgcgtatccgcatgcccgatgaggatgtcgcgttcgacgatctgatccgtggccgcatcgagttcaaggctggttccgtgccggattacgtgatcgtgcgcccgaacggcgatccgctgtacacgttgaccaacccggtcgacgacgccatgatgaacatcaacgtggtgctgcgcggcgaggacctgctgagctccaccccgcgtcagatcgtgctctaccgttacctgatcgagctgggcgtggccaaggaaatgccgctgttcggccacatgccgtacgtgatgggccagggcaacaagaagctttccaagcgtgacccggaatccaatctgttcctgcatcgcgacaacggtttcattcgcgaaggcctgctgaactacctggcgctgctgggttggtccatcgccgccgaccgcgacgtgttctccatggaagaaatgatcgaaaagttcgacgtgcgtgacgtcaaggccaatccggcccgtttcgacctcgacaaggccatttccatcaacgccgagcacatccgtatgcttgagccgcaggacttcctgaaccgtgccgtgccgtacctgaaccgcgatggcgtggtctccgccgattcctgggatgcgctgaccgatcgcgagcgtgaggtgctgtccgcttccgtggagctcgtgcagccgcgcgtgcgcctgctgggcgaggtcgccggcatggtgggctcgctgctctccaccgagggctacatcgagcctgatgatgacgccaagaagcagttgaaggattccgctccggcagtgctcgacgccgccattgcggcgctttccgacgttgctgaagatgattggaagaccgacttcctgcatgagacgctgaacaagtcgctgatcgaagatggcggttacaagccgcgtctggcgttcggtccggtgcgtgtggccatgagcggccgtcgcgtgtctccgccgctgttcgaatccatggagatcgttggcaaggagatcaccgtcgcacgcttgcagggcttgcgcgagcacctgtgatgcgctgatggtgtgattttgccgatcgcatgactgtcgacccgctggaatgttccgttccagcgggtttgttgttctgggatgctgtttaagaatggcggaaaatggcgcgacacgccgtgacttgcgcactcctacggattcgcgtatatttatcactcgttgcggttcgcggctcagctgagaatcacagcaataactcaagcccccgtcgtctagcggtctaggactacgccctctcacggcgccaacaccggttcaaatccggtcgggggtacgacggacaacttttcgaagttgccacgcctgccaaattgggatgtggtgtaattggcaacacagctgattctggttcagccattcttggttcgagtccaggcatcccagccaatgaccctcgcagatgcgagggttttttgtttttcgcaagcatgtctgccagtacaacatagtccaagaaaattgcactaccctaggaagcatgactgaattgcagaacgcagcaaaagccgccgccacgcgaccgcgcatccaaccggcggaagaaggcgacgatcgcccgctttccgtatccgcgcgactgggacgattgcaattccaccaatccggcaaattccgcgttctgcagcttgccgacattcaagacgggccgaaagtcagcaaagacaccgtcaaactcatcgaagcgtcactggatgccacaaggccggatatcgtcatcttcaccggcaatcagatcgcaggatatgatcccgcatacgcgcaaaccacgcgcaaacgtcgttggagcgctgccgcggggatttcctccaaaaccgcttcatccaagtcttccgaagcgtcagaacggttcgaagctgcgctggaacgcacctgcgcatccgtgcgcgccactgtcgaacagctcgtgcgtccgcttgccgatcgcggcattccgtgggcggtgacattcggcaaccacgattttcaatgcgggctcagcaatgcggaaatcgaaagcatttgcagggaatttcccggatgcgtgaaccctgagcctacgggaggcgagagcggcctcggggacgcaaattctgcaaattctgtgggaagcatggattctgcggaagatgcaggtttcgtgcaactccgggcggaatcgtatttgccgaatcagcgcgtattcgcttgcgagccgggcaccttcgcattgccggttgccgatgtggaccatacgatgtccgtgctgggcttggtattgctggattcgggcgattacgcgcgttccggcgggtacggaagcccgtccgcggaggcgttgcgatttcttgccgaagtgccgaaagcgatgcgtgcgcaatcgcaggaaattgggcgatcgcaggaaccggcggtcccgtgcatggtattccagcattttccggtgcaacagtattaccaactgcttaagccggccgcagcgaatgcggcacgtgcgattgaaggctaccgcaatttcgctggaaaacattacgttttggatgaggaaaaaacgcttcccggcagttatctgggggagggtgtcagctgcccggatgccgacagcggtgaattcgcgatattggaacagcatgactattttgcgatttccgcgggacatgatcaccgcaacgcattcgttggaacagtgccggtttcgcgagaaatggcctcggctgatgcgcagacggcggcttcgccaggcaaggttggcggtctgatgatgatcgcgtcgcccaccagcggtttcggatcgtatggtccggtgccgcagaagcgggccgcgcggctgatcgagttcgacatccgccatccgtacgagccgcgtacgcagctgcttgaatacggcgaattggtgggcaaaccgagcgcgggcaaggcgtacgcgtacggcatgaccagtgaatcgaagcccgaatccgaaggcgtggatctgctgcatcggccgacatggtggagcaaactgttgacttggctgcgtaagaagtagctgaaaagagcgaaatgacaaatcctgcaaggaaatggcaaaacttgcggaaggcaggaaatggcaaaaccgtgtcctgcatgcatcgcggaacacggttgagaggctgtatattgcccgtcagcgaccggaagaagccttaatcaaggcgtcggtcaaatacttgccggcagccataaccagcggggcgtaacggcgtccgggattggaccccatacgaccgtccgggccggaaatcgaaattgcggcaatcacctgaccggaagcattgcgaatcggcgcggaaatcgagcatacgccttcatcgcgctcgttgaccgactcggcccaaccgcgcttgcgcacggcggtaagcttggccgcggtgaacttggcgtgacgcaacccctgatgcaggcgttcggaatcctcccaagccagcaaaatctgggccgcggaaccggcctccatcgacagcatcgcaccaaccggaatggaatcacgcaaaccggaagcgcgctccacggcggcgatgcacacgcgcatatcgccctgacggcggtaaatctgcgcggattcgccagtgcgatccagcaacgtctgcaaaatcggcgcggctgcggtcagcaaacgatcctcgccggcagcagcggccaattccgcaaaacgcgagccaagcacgaaacgaccatgctgatcacgcaacacaaaacggtgacgctccaacgcaatcgccagtcgatgcgcggtcggtcgggccaagcccgtcgaggaaaccagctgtccgagcgttgccggaccggattcaagcgcgtcaaggattttgacggtcttgtcaagcacacccacaccggaatgaatctcattgctttgagaagacgtcgtgtggtgggtctcagctggaagctcagtctcatccgactgcgattcaggcatggtggtgcttgtattcgaagaagtcataagagggattatgccatctcacatattgaaatgcaaaatgtacgcaatgtcggactgcggtagagcaggtattttaatctttactcagttatggaaaaagctggaaaaaatctgaattttcaacgattttgtaggtacatacggggaggtatgccacaatcgcggcgattttgacatgatctggagtgaacttggcccatatgtgatgtgtgcgttgcatgcaagtatctcatataccggcataaacgcgttcgaaccaggctcgaacaccataggcttatagcacgaacaacgcgggttggcaataccgcgaggaaaaagcgaggaaaaattcgaggaggtcccgcaatgggaacgacattggccgagaaggtctgggccgatcatttggtacgcaagggtagtgatggggctcccgacttgctgtacattgatctgatgctcatgcacgaagttaccagtccgcaggcattcgaaggcttgcgactggccggacgcaagccacgtcaccttgaccagctgatcgcaacggaagatcacaacacgccgactgccgacatcgaccgcccgaatccggataagatctccgcgctgcagctaagcacgctcgaaaagaactgcaaggatttcggcgtacgtctgtgcccgctgggagacgccgatcagggcgtggtgcacgcgttcgcgccggtgctgggcctgacgcagccgggcatgacgatcgtgtgcggtgactcgcacacctccacgcacggcgcgttcggtgccatggccatcggcatcggcacctccgaagtcgaacatgttatggcaacgcagaccctgagcctgaagccgttcaagaccatggccgtgaatatcgaaggtgaactgccgaagggcgtcaccgcaaaagacattattcttgcgattatcgcgaagatcggcaccggtggcggccaagggcacgtcattgaatatcgtggtgaggccatcaagaaactgtcgatggacgcacgcatgaccatctgcaacatgtcgatcgaagcgggcgctcgcgccggcatgatcgcgccggacgaagtgacgttcgaatatctgaagggacgcccgcacgcgccggaaggtgaaatgtgggacaaggccatcgaatactggaagacgctgaaaaccgatgacgacgccgtattcgacaaggaagtgaccatcaaggccgaagatctcgagccgtatgtgacgtggggcaccaacccgggtcagggcatcaagatttccggcgtggtgccggatccggcttcgttcaacgatgaaaccgagcgcaccgcggccgagcgtgccattgcctacatgggcttgacgccgggcatgcgcatcaaagacattgccgtggataccgtgttcatcggctcctgcaccaacggacgtctcgaggatctgcgtgtggccgcttccattatgaaggggcatcacaaggccgaaaacattcaccgcgtgctcgtggtgccggcctcctctcgcgtgcgtttgcaggcggaaaaggaaggacttgacaagatcttcaaggacttcggtgccgaatggcgtaacgcaggctgctccatgtgcctgggcatgaaccccgacaagatggtggcccgcgaacgttccatctccacttcgaaccgcaatttcgaaggtcgacagggcaaggggtcgcgtacgcatctggcgtcgccggcggtcgccgccgcaacggccatccgcggtaccatctcgtctccggctgatctgtgaatcgttgagaatgcttgaaaacctgagaaatcttggatttccggcattctgtgaatcgttacatcgaaagaaatagtgaaatggaaaaactgactactcttaccggcgtggccgtgccgcttcgccgttccaatgtcgatactgaccagattattccagccgtgttcttgaagcgcgtgcagaagtccggtttcgacgacgcgctgttctatgcgtggcgtcgcgatccggaattcgtgctcaaccagccggaatacaagcggggcaagattctcgttgccggaccggatttcggtatcggatcttctcgtgaacatgccgtgtgggcattgcatgattacggcttccgcgtggtgatttcgtctcgtttcgccgacattttctacggcaacaccgcgaagaacggcgtgctggctgcgattatgccgcaggaatccgttgagttgctgtggaagctgcttgacgaggagccgggccgtgatatgacggtgagcctggaggatcgcacggtgacgtgcggcgacgtgacgctgccgttcgaagtgaacgactatacccgttggcgcctgatgaacggctatgacgatatcgatctgacgttgcagtatgaagacgatattgtgacatacgagaagatgcgtgccgaaaagttcccgttcaagccgaagacgctgccggcgaagcgtgagccggagcagttgatcgcgtccgcgcgcgaaggcgaatacccggattggcagggcccgcttgccgatcgcggcatcatctgagttggcgtctggctaggtgcgcgggctgtttgcggggtgattcctccagtgggtggaaggaacaccccgcttgcgttgttgcgcgggctgtttgcgggaggatttttccagtgggtggaagaattgggacgtcgggatgattgttcgcgggaggattcttccagtgactggaaggattgggatgttatgtgatgcgtgagcgggaggattcttccagtaggtggatgtttttggactttgagacggtccgtagcggggtgattcctccactgggtggaggttttgggacgattaggggactcatattgtccggattcttccagtgactggaaggattgggacgttgggattgctgattatgtgagatttgcgcgggttttgcatatgagacgcgctatggtgggcttattgtttcgtgctttcgtagctttcggagagaaaaatgagccagggtttcgcgccgttttatgatgtcaatcgcacgtatgaagacaactatttgcaagggccgttcggcgcgtttgccgaagtgttgcgggctgatgcgtccgattctgcgggatcggtcacgtctgttgttgctgaggttgcgtccgattcctccagtgaggttcagggcgttcagaccattcaggccgctcaagcgcaggaattccttggttttcgtgtgaatctgccgttcggtattccagctggtccgctgctgaatgagcgtttcaccacggccgctttccgtatgggcttcgatctggcggtatacaagacggttcgttcccgcgcatggggctgcaatgcgttcccgaacgtgctggccgtgcatccgcggaatgccgatggttcgctggttccgggcagtgccgaacttgacgagggtgtgcttgccgatacccgttatgagcttccgatttcgatttccaacagtttcggcgttccctcccgtgatcccgacgaatggcagccggacatgcagaaggcgatcgccgcagccggtgacggccagctgctggtgccgagcttccaaggctcccgcgtggagggcatggatcgtgaagcgtatatcgccgatcatgtcaccaccgcgcatttggttgccgaaactggcgctggcctgatggaaatgaacaccagctgcccgaatgagggacataatcgtctgttgtgccacgatccgcatttggtcggcgagattacggaagcggtgaagaacgaaatcggcgatcgtccgctgatcgtgaagctcgcatacattccgaatgatgccgatctggaaatcatggtgaaggaaaccgccggccatggcgcggtgcagggtttctccaccattaacacaatctccgcgaagctggtggatgcgaacggcaatcaggcattgccaggcgcggggcgtgaccgttcgggcgtatgtggcaatgcgattcgtggtgcaggtctcgatatggttggccgcctgaatgcgattcgcgagaagctgggtcttgattttgcgatcgttggcgtgggcggtgtgattcgtccggaagattacaaggcgtaccgtgaggctggtgcaaacgcggtgatgagcgctacgggtgccatgtggaacgcccgtttggcgcaagacattaaagccgcactgtagtcacaggttcaattgcgcctgatttgcgctctgttgcgtttcaccgtccatttttcccattcgctggaaggattagtgcagcacgggggtagctgtccgtcctgattcttccagtgactggagggttttgcccgctgagatgcagtttggtgggatgattcttccagtgactggaggtttttggacggtggaggggcttgtatcgggaggattcttccaccgactggaagtttttgcccgctgggatgcggtttggcgggtggattgttccagtggctgggaattttggccgaaagtcgaacgaaattgggagacactgcgctgaacgcggcatttcacgagcccactacatgccttatggcaaactgagggttagtgtgtttcaagcttgaaccgtataagggaagcgaaagaggttgagcgtgtctgacaacaacaacgacattctgcacgtcgaaggtggcaagccgctgaacggcaccatcaaggtgcgtggcgcgaagaacttcgtgagcaaggccatggtggcggcgctgctcgccccgggtacgtccgtgttgaagaatgttccggagattcgcgacgtgcatgtggtctccgacttgctgcgtctgcatggcgtggacgttacggtggatggcgatcacggcgtggtcacgatcgacgccacgaatgtgcagcttgccgatgtggccgacgtggatacgctgtctggttcgtcgcgtattccgattctgttctccggcccgctgctgcaccgtttgggtgaggcgttcattccggctctcggcggatgcaatattggcggtcgtccgattgatttccacctggaaacgttgcgcaagttgggtgccaacgtcgataaggaacataaggacggcattcatatcaccgctccgaacggtttgcatggcgcgaagattcacctgccgtacccgtcggtgggcgctaccgagcagacgttgcttgccgccgtgcttgctgagggcaagacggagctttccggcgctgccaccgaacctgaaatcatggatttggtgtgcgtgctgcagaagatgggcgcgatcatttccgtggatgtggaccgtacgttccgcatcgagggtgtgaaggagctgaagggctatacgcacacttcgctgaccgaccgcatcgaggccgcttcctgggcttccgcggcattggccacgcatggcgacatttttgtcaagggtgctacgcagcctgaaatgatgacgttcctgaacgtattccgcaagattggtggtgagttcgacatcaccgataacggcattcgtttctggcatccgggcggcgatttgaagccggtcgcgatcgaaaccgacgtgcatccgggcttcatgaccgactggcagcagccgctggtggtggcgttgacgcaggcgaagggcctgtcgatcgtgcacgaaacggtgtatgagaatcgtttcggtttcacgaagccactggtgcagatgggtgccacgattcagctgtatcgcgaatgcctcggatcgctgccatgccgtttccagcagcgcaattacaagcattccgcggttattttcggaccgaccccgctgaccggccgcgatattgacgtgccggatctgcgtggcggcttcagccatctgattgccgcgttggcggcaaagggcccgtccaatgtgcagggcatttcgctgattgaccgcggttatgccgatttccgtggcaagctcgaagctctcggcgcagatttcgactgatttgttgcttgatttatcgctgatatagcttgattggcttggtaaggccggtgttcacaacagtgggcaccggtttttgcttacatattgccgttgctcgttctcaaaaacttagtaattcagtgtataaattattgaacttaatttagggggttatggcgcataatagtgatgcaaaagttttattgtttttgaaaataatgtcgattttcggcagagattctttcggaatggcattatgattgtcgatatcgaatggcgtttgcaacgaggtgaacagccgaagatataagggtttccctcatcgttattgtgtttactgcatgtccagacggattctagggatagtcgcaacatcttcgtcgtcaatcgtcctccagcctatccaccagttccgcctttttcgtatattccgtgtttttgtatttcgtgtgtgcgtcgtgcatgagcgcaatcgttccaaccaagcggaatgggtggtggcagaatggaacgcatggcatccaaaggaaaaccctcgccgcgttccgcggtcaaaccgttaagcgacgaacaagtcgcaaagctcgcacagcgtcaccatctcgttgacccaacccacgactttccatgcgggccgcgcagagccaatgaagccgaaatcgcggcgcagaatccgaaagcgacccatcgtctgctcaccggatgcgacatcgtattccgcaaccgcaccaaactcaaggcgtggggcatcgaacacgtgccggaaaccggtccgttcatcaccgcggccacgcacgtcaccatgtttgacgtgttcgtgcccatgatctccatgttccatcaaggccgccgtccgcgctacatggccaaagccgaaatggcctcgtggccgctgatcggcaaatggttccaactggtaggcatgcagcccgtgcaacgccgttcgggcaaggcgaaagccatcgaggaaacctccgtggaaatccttacctccggccgacccctaaccgtatggccggaaggcacggtaacgcgcgacccgcagaaatggccgatgagcatgaaaaacggcgtgggcatgatcgcgcttgaggcttcgcgccgactcggctaccagattccgctgtattgcgcggtaacgtggggcgcggcaagcatcaaccattggtggccgtggccgcgtaaaaacgtggtcatgtgctacgacgaggcgcttgattatgcggatctgctcgccgattgcgattcctggggtgaggaagtgccggaggatctcgccaacgaacttacccgacgcatccgcgtgcgtatgaccgaagtcatggccgaaatccgcggcgaacaagcccccgatggatattgggattatcgtacgatgagccgagtgaaggactgaatcgaagaaggccgaatcgaaaaagaccgcacacgcgattgctgaaatgcggtaatcgaaatactgccagccgattgcgcatacgtatggcgcgtattgcggcatatatcgcggtgtgcgtagccggcggtagcattggaaaagcaatttttgagccaagactccgggttatgaatgatgcccggagtaatgcaaggagcaaatatgacgaacgtgacggtactgggcgcaggagcttggggaaccgctttcggtcaggtgcttgccgatgcaggcaacaatgtgactatgtgggccatcgaaccggagattgtggaaggcattcgcgaccaccatcacaacggtgttcgcctgcccagcgtgaaagtgctgccaagcaacatgaccgccaccggcgaccgtgccgaagccgtagccaacgccgacattgtgatcgtggccatcgccgcacagttcgcccgcgtcgcgctcgtcgaattcaaggacctgattcccgaaaccgcactcgtcgcctcgctgatgaaaggcatcgaacgcgccaccggcaagcgcatggatgaagtcgttatggaaacgctcgacctgccggccgaccgcttcgccgcgatttccggaccgaacctgagcaagcagatcgccgaccgcgagccggccgcaaccgtggtcgcctgcgaaaatctcgacaatgcgcgcaagatcgcagccgcttgcaccaccgactatttccgtgcgttcgtaacccgcgacgtgatcggcttggaaatgtgtggatcgctgaagaatgtggtcgcgctggccgtgggcatggcccgcggcgccggctacggcgaaaataccgccgccatgatcgaaacccgtggcctggccgaactgaccgccctgggcgaggcggcaggcgccgatccgaagacgttcgccggtttggctggcgtgggcgacctgatcgccacctgcggatccccgttgagccgcaactacacgttcggatccaacttgggcaagggattgagcgttgaggaggccaccaaggtgagcaacggcgtggccgaaggcgtgccgaccaccgatgcggtggtggcgctcggcaagcagtatggcgtgcctacaccgctcgccacggccatgagccacgtgctttccgatggcatctcctgcgcgcagatgctgtccgaacttttcggcgaaggcatcagcgaagaataagctttccgcaacatcgcgattgcagataagaccgcactttcaggtgcggtctttttatttttcgaggcatgcgattgcgtaaaacgtcaatcggaatgtgtcaatcgtcaatcgccatatatttcggcaataatagtaaatctgtataaaaatagtctaatcgtgattagtctaatcgtgattagacaaagcgattaagctcggtttttcaggttgcaatcgcatcattccaacgtttgattccgtattctatgattcatgaaaataggacatgagtgacgggcgtgtgcaattatggttcgtcgtgtgtgggctgtggggtgcggtttgtatactgaactgcgatattgcgaatgcgtggtatcgcgggcgaacagaagtgcgaaccggcgcgatattgcgaagacagacagtacagacagtattggcagacggtattgggcgcgcgtgcgttcaacggaccaacttatggagcataagacaaagatggcaaaacagcgcattgtggtgatgtatggcggcaaagccgacgagcattcgatttcctgcatctctgcggcgggcgtgctgcgcgcgttggatactgacaagttcgaagccattgaggtgggaatcaccaagaacggcgagtggatcgtaggcggcgaggatccacgcaagtggaacatgagcgaaggcctgccgatggtggagaagacggattcctccaaagatgtggtgctggatgtggcactcggccaggatggtttcttcgctcgtgaagatgacggcacgctgacttcgcttggccacgtggacgccgtgcttccggtattgcatggtccgtacggtgaggatggcacgattcagggcctgttcgaaatgatgaacgtgccgtacgttggctgcggtgtgctcgcttccgccgcttgcatggacaagcattatacgaaggtattgctggctgcggccggtattcccgtggctcccggcatcacgttggatgtgcgcgattatgatgccgcttccgaattcgccgccgaagcggacgagatgcttgccgcggtgcagcaggctggattgcagtacccgctgttcgtgaagccgtcccgcgccggttccagcttcggcgtgaccaaggtcgaacatgagggcgatgcggccgagcttgccgccgcagtgttcgaagcgtcccaccatgattggcgtgtgctcgtggaacagggcatcgacgcgcgcgaaatcgaatgcgccgtgctctgcccgaaggccggcgaggctccgcaggccagctggccgggcgaaatcgtgcttgacaagcgtgccgagggcgacgaccagttctatgatttcgacagcaagtacgtgaactccgacgcaagccatgtggaagtgcccgcaagcctgccggaagaaactctgaaccgcgtgcgcgaaaccgccaaaaaagcgttcatcgcagtcgacggcgccggcctgagtcgtgtcgacaccttcgtgacggccgacggcgaagtgatggtcaacgaaatcaacaccatgccgggcttcaccccgatttccatgtatcccaaggcatgggaggcaaccggcgtgagctacaccaacctgatcaccatgctgatcgagggcgtgctgcgctgatttcgattgggtggttgctcgctttagtctgattcgatttgcatgagactggcatcaatgctgacactgcgttggtgccagttgacatattccgccaatttacctgcagtttgggaaaatttagttttttcgattcaaaataaactgcatatttactgtaaggtcagaatcgcgttgatttgagggcttatcttctttcttgttgttatgaacaaggcataagaaagatattgatttccatgatttctctgcgcaaactggctgccggctctcttgctgccgttctggctttctccatggccgcctgcggatcgggcagcacggattcctccgctgattccacttccggcaaggccgtgaagattgatgaaaagtccgcaaaggccacttccttggctgatttcggtacgatggacgatttggttgccgccgccgaaaaggaaggccagcttaacgtcatcgcacttcctcacaactggtccaactatggtgaggtcatcaacggcttcaagaagaagtatccgaacattaagatcaacgagctgaacccgaacgcctcctccaaggaagaagtggacgcagccaagactaacaagggcaccgacgctgcccccgacgtgttcgacctcggcttggccgtggcttccaccagcaccgacaacttcgcctcctacaaggtgcaggcctgggataagattccggattccgtgaagaatgctgacggcaagtattacgccgactacaccggcatcatgtcgatcggttggaacgccgacaagtacggcgacatcaacagccttgacgatctgatggatccgaagttcgccggcaccgtggcgctgaacggcaagcctgccgaagccggcgccgcattcaacggttacctcatgatcaaccagctcgcaggtggtgacatcaacgacttgcagccgggcctcgactacttcaagaagctcaaggatgctggcaacctcaccaccgttgacgtgaccgacggaaccatcgattccggccagaccggcgtggtgatggactggagctacaaccaggcctcctatcagaagagcctcaaggagaagggcgtgaactggaagttcaagaccttcaagaacgcccaggtggtcagctactacaaccaggccatcaacgtggacgctccgcacccggccgcagcacgcctgtgggaggaatacctgtacaccgccgatgctcagaacgaatggttcaagggcggcgccaatccggtgctcctcgactccatgaaggaggacggcacggttgaccaggacaccctgaagaccgccatcaccatcgagggcgatccggtgacctataccaacgatgattccactcgcatcaccgaatggctccagaacaactgggacaagaccatcggcaactgattggcaaccgctcgcaagcaacgcaaacgagctggatcgcaatcgaaaataatgcaatctaaggccggtagaccggcggacacgacgggctgaagcaagttccccgacgtcttctgccgcaacaaccggccttgaagcatgtctccagcgcaatagcggaatcccacaatcctatgcaatctcaccgcatatcaatcgtatgaaagcacgcatgcaaccatgactgcagcaatcacccccaaagcgggagtcatcggcgggcgtaacgcacacgaagcccgcggaacgcgaggaaacggcccctccgcaacctccgatttcgccacgcatcgccgcgaaatcggtacattcgtcgtgaccatcccgttcttcgcctataccgcctgcttcctgcttgcgcctaccgttatcgtgattgtcggcgcattccagaacgtcgacggcggatttaccctcaacaacttcagcaaactcttcgaagcgaacaccatcgccgcgttcgccacctccattctcgtttccgtgatctccgcactcattggcgcggtcgtgggtgcggttgcctcgtatgcgctggtgattggcagcaaaccgaacggactgctgcgccgcatggtcagtgccatttcatcggtgctcgcacagttcggcggcgtgatgctcgctttcgccttcatcgccaccatcggtatcaacggcgtcggcaccatgctgatccgtcagctgaccggactgaccgtcaatccgaactggttgagctccctgcctggcctaatcacggtctactgctacttccagattccgttgatgattatcatcttcctgcctgcggtcgattcgattcgtccgcagtggcgtgaggcttgcgaatcgctcggcggtaacaccttccagtattggacgcgcgttgcggggccgatactggttccgcgtttcctttccgcattgctgttgctgttcgccagcgcgttctccgcatatgcgacggccgccgcattgttctcacagcgttcgattctggtgccgcttatgattcagggcgccatgcgcaacgaaatggatccgaatcagcagggattcgcgcaagtgctcgccttcgcgatgatcatcgtggttgctctggtgatgatgctgagccacgctgtggaaaagaaggccggacaatggcagtgaatcatactgaagcaatgcccccgcagctgcgtgccgcccgcgtgcgcaagcagcgcgtgatcaaggcgattattctcacgttcacgctgctgttcctgttcgtgccactggtgtctatgtttgtgttcaccattcgacacccgctttccggcaagtggagtttggatccgtggattgcgattttcaccggcgatggcagcgcgcttggtgctgacttgtccacattgtggagcggtcttggatcgtccatgggattgtgtgtggtgactgtggtcatcatgctgctgctcatggtacccaccatggtgatcgtgcacattcgctccaagcagctggaacgcgccatcgaatgggtggccaccctgccgctgaccatccccgccatcgtgctcgtagtcggcctggggccgatttaccgttggctcagcgccgacgtgctcagcaccaacccgatctggctgtgcttcgcgtacgttattctggtgatgccatttgcattccgcgcgctcgctgtgggcctcaactccattgacgtgaaaacgctgtgcgaagcatcccgctcgctcggagcctcctggccgcgagtgttcttccgtgtgctcatcctcaacctgtggcagtcgatcctctctgcatcgttcatctccatcgccgtggtgctgggcgaatacaccgtcgcatcgctgcttggacgcatgaacctgcaggtggcgctctaccagcttggccaatccaactcccaaatctccaccgccatgtcgctgctggcactactgttcggcgtgatcctgctggtagccctcgatcttatttccgacgcactgcgtaaatccaaagaaagcaacgaatcatgactctcgctgatcagaaagcaaccatcgcacgcacttcggaagcgttcgtaaacgccaatccgagcgccgaaaccgtaacccgagccgcacgcgaagtcctcaacgactccgcggaacgcggcggcggcgtgcaaatgcttaatgtagacaaaatctacccaggagccaccaacaaggcgctcgacaacttcaacctagaagtcaatcctggtgaaatggtcgtgctgctcggcggctccggctgcggcaaatccaccgcgctgcgttccctcgcaggcttggaagacatccaggccggccgtattctcgtcggcggccaagatgtgactggcgtgcccgtcaacaagcgaaacatggccatggtgttccaggcgtactcgctgttcccacacatgaccgctctgcagaacgtggaattcgggttggaaatccgcggcatgggcaagacggaacgccgtaagcaggccatggagaagctagaactcgtaggtcttgccgatcaggctggcaaatacacgcagcagatgtctggcggtcagcagcagcgtgtggcgctcgcccgcgcactggccgtgaacccccgagtgctcctgctcgacgagccgctttccgcacttgacgccaaagttcgtgtgcagctgcgcgacgaaatccgccgcatccagctcgaagccggcaccaccaccgtgttcgtgacccacgatcaggaagaagcgctcaccgttgccgaccgcatcggcgtgatgaaccacggatgtatcgaacagatcgccgacccgcagacactgtaccgccgtccgggcagcgaatacgtggccaccttcattggcctgaccaaccgactcccaggcatcacgaatggtgaggaagccgtggtgtttggccagcgcgtgccgttgctcgaagcctccaagcgcgacgcctccaccgtgctcgtgcgaccggaaaaccttgtgatcactctagccgcaaacgatggcaacatggtaggcgagcatggtcgcgtcgacatggtgcacttcctcggtgcgctcgcccgcgttgacttgacggttgccgcaggtgtgggccacctgcccgtcaccgtgcagctgccggccaatgagcttcctgccggcctgacggttggatccgaagtggtggtggctccgcgtccgatcgccgcgctcgccgtatgagctgtttcgttgcggacgcccatgacgacggtcatgagattgtaagctgatattcagcattcctgtactaaggtgctgaatatcagcattttcgtatatgcaccccgtgcacgtcgtcgcaaaggcaaatatgacgtttccgcagtacccccaatatccgcagcggccgcaacaaccgcatacgcagcagaatccacaacagccatcccaatatcagcaacaaccgcaatatccgcagccacaagccaatccctacgaactgtggctcaggcgcgtgaaaagcgtgttctcccgcatcggcgcaggcatgtgcctgatggtggtgatctggtatgcgcttgcaacggtgctttccggcatgctctatcaggtactgcataccacgaatctgccgaattgggcggtgtatgtggcgtcggatgcccctttgtatctcgtggccatgccgctcgcagtactgatcatgggcaaatcgtcggtcattgaaacacgcaagttcgacatgaagccgggccaattcttcaaactgcttatcatgtgcttcccgctcatgtatgggggcagtctcatcggcaatatgttggcgtcgctgctgtccggaggcaaagccagcaattcggtgagcgatctggccatgcaattcgacgtgtggaacgtggtgttcctcgtaattctcggaccgttgttcgaagaatggatcttccgcaaggaactcatcagccgcacgcgcaaatacggtgaaaaaaccgcgatcgtgttctccgcactgttctttggcctggtgcacatgaacctgttccagttcttctacgcattcgcattgggtcttatgttcggctacgtgtacgtgcgcaccagcaaactgcgttattcggtggccatgcacatgatcgtcaacttcatgggtggcgtggttgcgccgtgggtggtgacgaacattgacatcgacagtctgatgaacgtgctgaccagtgcggaaaacggcgacggaacggccatgatgcagtggatgggccagaatgcgacgggaatgatgatattcggcatctatatgctgctatattacggtctgatcatcgcgggcatagtgttgcttatccgcaatcgcaagaactttgaattctataccgcaccggaagaactgcctcgcggcgttcgcacgagcacggcaatactgaacgtcggtgtagttacttacattgtagtgacggttattattacgtcaatcaatctaatgatgcaataatttcagtataaaaagtgccgcatgtggactactgcatgcggcactttatatatatatgggtcaaccgcgatttcttatgttcgcgaggatattacgattctttgttaatggcgcgattctcaagaaaatcagcattggcgatggaacgtgccacggcgttgatcatgtcgggaagcaacgattccggcttggcgtacgcgcacacttcgacattgatgccgtaaggggagtagccggtcagtcttactttcggagggaagcgcggatcggccaaatcggcggtatcgcgctgcacggcctgaaccacctgacgggtcatctcgtcgatgtcggtaccggccttggcggtaaacggcacacgaaccagcatctcattggacggattgagtttttccagtgacgcggtgttcagaatcgaattcggaatgatcttgacgttgccattgcgctcgcgcaccacggtctgacgccagttgatgtcttcgaccacgccatcggtgcccgccacattcaccagatcgcccggctggattacacggccaagcatcagaccgaaaccgccgatgatgttcgcgatcgtatctttcataccgagcgacaccgcaagaccgccaatgccgagcgcggtgaaaatcgtggtcggattaatgccgaacaccggctgcagcacagtgcccacagccaacgtccacaccaccgcgcgcagaatattgatgaaaatcgaagcgttcggcacttgcgaacggtccagcactttgctcacgattcgggtaagcgccttgtcgataacggccgcaagcagtgcaacgacaatgagcagaatgatttttccggaattggttttcagccaatccacaacgattccaatcggttccatagtgttctgaagcgtcccttcataagtttgattcgcatgcattactggtgcgcgcgacttgcgttcgctgcgtctgcgatgcgtgttcgagatgcgtgttcgcaacttgtgttcgcacatatcctacagtgcgtggctgagtcggtttgagcgtgggtgtgcgggggcgtgcgcgagaacatgtgggaatgcgcgtggtgacatgtgtccggagccgtgaacggactaaagttgaggcatgggcaatgttgtggattatgtgcgccgcgagttccgcgggtttggcgaattggcgttcagcaatgtcgattccttggtgctttccgagctttcctacatgcgattgccgggcttggttccagcattcggcgaggccaagtcggtggcgaccgtgccgatccgtgacttgctgcgcgccgaaagctacgatgagatgtttgtttcgaattcctctgaaatgaatgattatcggctttcgttgctgcgtgcggtttgcgaatcgccgcgattccgcgggttgcgggtgggggagtatgacgaacgtttggatgagggcgagcagcagcaattcgctgcgatgaccttcgatttgggtgccgatttcggcttatatgttgcgttccgtggcactgacggcacgctcgtcggttggaaagaggattttaatatggcggtgcgctgcccagtgccgtcgcaagaatcggcatatcgatatgcggactcgattctggacaggacggaacgtttcctctcggcgaaaaaatcacccgacattatgatcggcgggcattccaaaggcggcaatatggcggtatatgcggccatgcaaatcacgcaaagcgatattgaagcgaccaacgaacgcgcgcaacggctcggactgctgccggcgctcggaggaagcgtgccgggacgcaactgcagaatctcccgcatcttctcgcatgacggtcctggaatgtctcaagtcatggtgcatagccgcgcatatcaggcaatcgcggcacgaatcgacaaaaccgtgccggaatcctccattatcggcatgctgttgcaatcgcaaatcaaaccaaccttcgtcaaagccgacgccataagcattctgcagcatatgggatcaagctggcaagtgacgcaatccggcgaattcgagcaggcaagcgagctgacaggcggtgcacaactcatcggcaaaaccattgacggatggttcgaccgcgtaagccaggaacaacgcgaacgggccatcaaccagatatacgacatcttcgcagccgcggggtacggtaatatcgctgatctggtggcgcattggacggattcgctgccgaaaatcgtggcagccgccagaggtaccgacgtgcaaacgcgcgaactcatcaaagacgtgttcaaggcgattccagccagtgcggcgaaagtcgctgtcggggaactgcgcaacgacaaggagggggatgcgtgatgggcaatattattgactatgcgcgcacggaaacgcgcagtttcgaggcattgccgttccgcgaggctgacgcattggtgttggcgcagctttcgtacgacgaagtaccggaatgcgtgctgcgattggacgatttggtagcgaaatacggtacgttgcaggcgcgtgcgaagcaattcgatattcggcgtccgatcgcatcgttgcgtatgctgcgcaagcccccgtttggcggcgtgacgattgcgcgtgccgatgacgagctgaaccacgacaagcccgtggccgaccatgatgtggagaacgtgggattggtcgatccgcaggtgacgcacgacttctaccatgctgtggcggcgaatccgcggttttccgacgttgagatgagcgcgtattgcgagcagttcgatggtggtgcgcaaacgcagttcgcggcagtgactttccggctgccgtcgggaacgctggttgtggcgtttcggggtactgatgattcgctggtcggatggaaggaagacttcaacatggccttccaatacccggttccagcacaggtttccgcagctgaatacctgaaaaaagtcgcctcgctgtgggatgggccgatactgctgaccggtcactccaaaggtggtaatctggccgtatatgcggccatgaacgccgaagacgagatcaaggaccgcgttgaacgcatttactcgctcgacgggccgggtttccccgaagaagtggtgaaaagtttcgaatatgcgagcgtgagcgaccgcattgtgaaaatcgtgccggactcctcggtggtgggcatggtgtttgaaacccccgaacgttgcgtggtggtgaaatccgacgtggacggcatcatgcagcatttcgccttctcgtggcagatgcacgggggtgaattcgccaaggccgaagatgtggccgacagttcggtggtgttcaacaagtcgctgaacggctggcttgcgggactttccaaagaacagcgtgagcacgcggtcgacgcgctgttctccgtgcttgaggcttccggtgcgggcagtatttctgcgatcgtggcggccggtccgaaagtgattcctgaaatgctcggcacatatgttggcttgagcagtgcggatcggcgcaacatcaatcaggcgttggtgattctgttgcaggcggcgctcgctcgcaatccgaaagttcagcgaaagtgaagcgcgaatgaggcgtgagtactgtgcgaacgtgggcgggcactgttcgcgtagcgtacttgtgttgtaagcgtgaattcgtatacgacatttgccgaaattcggtctagacaacttgtacaataaaacgtggttatgaggcaacgtgactaattattagggggtactgatgccacgaccacgtagggattcggaaatcctgccagcaaaagatcgtctcgaaaacgccttctgggagctgctttcggaacgcgagtacaacaaaatcaccgtcaccgacatcgtgcgcacggccgacgtgaatcgcaattccttctactatcatttctccggactgccggaattggccgactccgccattctgcacgccgtcgaagacacgccaatgccgggcgtgccagggcgggatttcaatcctgacaccgaatggcgcaagcacgtcaccgcgttgctgcgcgatcccgaacagcgtcagcgtctcgaccgattggccttgctggcaggtccgcacagctcgccggaactcgtttcgtcactcaaggaattcgggcgactcaccatgatttccgtacttggactggatgccgacaacctcgatctgaaaaccgatctcatgctcgatttcaccgtcggaggcatgctggccgtactgcagcgctggccgaaactgcatgaaaaactgccgctcgacaccgtattcaacgaggacgtcgccgtactcgcggcgggcatgttcatgtcaatgtcgaaagcggacatgctcgaatactggcgcaggatcttcagcgaaggattcgtacccggcatggcgatttcgcaacagcagccgccgtctgccaagtgaccatcgaaagccggctgtgacaatccagtggtagaaacgatatagcggcgtttttccgcggattgttccgtggaaaaacgcgaacgtgcgaaatgaacgaacgacggggaggttgtccatgatcaacgaagcttacaaggccatgctcggcggaaaatccgtgatccgcgagctgagcgaatacgcgaccgcgcgcggtgccgaaatcggctacgagaacgtgttcgactattcgttgggcaatccgagcgtgccctgcccgcaaagcttcaccgacgaaatgatcgccctgtaccaagaggcggaaccggtcgcgttgcacggatactcgccgtcgctgggcattacctcggtgtgcacggccattgcggaaagcctcaaccgccgcttcgacatggactatacgaccgactacatcttcccgaccacgggtgcggccggcgcgctggcccacgcactgcgcgtggtgaccaagcctggagacgaagtcatcacctttgccccctacttccctgagtaccagccgtatgtcaacggaaccggcgcgcacctgaccgtggtgccggccgacaccgaaaacttccaaatcaacttcgaagcgttcgaacaggcgctgaacccgggaaccgcggcggtgctcatcaacacgccgaacaatccttccggagccgtctattccgccgaaacgctgacccgactggctgaaatcctgcgcgccaagcaggtcgaatacgggcacgacatcttcctgatttccgacgaaccataccgtgaaatcgtgttcgatgggggtgtgcagccgtacccgagcaagttctacgacaacacgctctcgtgctactcgtactccaagtcgctgtcgctgccgggcgagcgcatcggctacgtggcggtgaacccgcgcgctaccgatgccgaactgatcgtgccgatgtgcgggcagatcagccgcggaaccggccacaactgcccaggatccagcgtgcagctggccgtggccaaggtggtggacgaaaccagcgatctttccgtgtacgagaagaacatgaacctcttgtatgacgcgctggtgcgcctcggattcgacgtggtgcgcccgggaggcacgttctacatcttcccgaaggcgcttgaggatgatgcgaatgcgttctgcatgaaggccaaggattacgacctgattctcgtgccatccgacagtttcggcgtgcccggctacttccgtatggcgtactgcatcgatacggaaaaggtggagcgttccatcgccgcattcgaaaagttcgtgcacgaagtctacggccgctgagccctgtgtgcgctcgctggaggaattcggacgcaaataagccaaaggggtgtgtatctgccttatatatggcagaaacacacccctgtatatatggcagaaacacacccctgtccggagctatctcgcttatatatggcaggtcggttggctaaaacagccaaaaacgtacccccgaagtgctgttttgctgaggacgtctgccatatataagcgagataggcgttcttaagctgtgtggagtgtccgtttctgcagaatcggacgttcataggctggtttttggtgtttggatgtccgtttccggtgaatcggacagttgggctgatgtttttgggtcctgtttgtccgtttctgcagaatcggacattcaaagcactctcagtgggtggcgatttcgtcgatcttggtgacgtggccgccgaactgggcgcgcatggtggagacgacgcgcagaatgtcgtccgcgccgccgcgggaagtctggcgggcatacagcgcggccgcggtggagggtgtcggcacgcccagttcgagcgcagcctcgatcatccacttcgcctcgccggattcgttggccaccggcggcatggattccagcgtcggatcggacttgaacgcgatcgccagcaaatccaacagccaggactgtaccacggaaccgtctcgccatgaagtcatcacggccgccggatccttgatgagatcggacttcaccatagtggcgaaaccttcgccgaacgcctgcatcatgccgtattcgatgccgttgtgcaccattttggcgaaatggccgccgccgaccgggcctgcgagcaccagtccggaatcgccttcaggcttgagcgcttcgaaaatcgggcgagcgcgttcgaaatcctcttcgctgccgcccaccataagcgcgtatccgcggtcaatgccccatacgccgccggaaacaccgcaatccatgaaatggatgcccctcggctcaagttcggccgcgtggcgcgcgtcatcggtgtaacgggaattgccgccatcgatgatcatgtcgccgggttccagcagctccgccaattcgttgatggtgctgtcggtcgcctcgcctgcgggcaccatcacccacacgatgcgcggcgcggtgagcgctgccaccatctcttcgaggcttgccacggtgcgatccgattcgggggagcggtcatatccgaccacctcgtgcccggccgccgcgatgcgcttcgccatattgccacccattcggcccagaccgatcattgccagctgcatgatgttcttctttctacggttttgtttgatatggaatttgattgggattggtgccatccacccgctttcagcatcttccgcaacgcagaaaagaagatgcggaaaacgaatggacggcaagttttttgtatttcagatatgttttttcagatatgatgcgcgcgaatcgcaatcgcaattcgtgtgcgaagtgttgcgtcaaagcaccaacgaaagcagcatgacgcaacccaagccggtgaccgacagaatcgtttccatcagcgaccaggtcttcaatgtctgaccgacggtcataccgaagtattccttgaccagccagaatcctgcatcattcaggtgcgagaagaatacggaacctgcgccgatggcgagcaccagcatcgccagatgcgtcgggctcatgccggtggcgagcggcaccataatgccggatgcggtgacggtggcgacggttgcggagccggttgccaggcggatgagcacggcgaccagccagcctgcgatcagcggattcatggcggattcggtgatcgaattggcgatcacgtcgccaatgccggaatcgacaagcgtctgcttgaaaccaccgccggcggcgacgatcagaataatgccggcgacggagctgaacgactgcccgaccatgccattgaccgcgtcgcgagtgaacttctgcatgtagccgagcacaaccatcgcgaaaatcgtggtgatgagcagagccaccagcggagtgccgatgaaggcgagcgcgcgtccccatacggtttcgctctggccggtcagatccacgatggaagatgcgagcataagcacgaccggcagcaggatgacggcgattgcggaagtgaaagacgggcggttttccgcggatttcggggcttctgcctcagcagtgttttctggggccgcgatcggcacccacttggcggcgagcttgccgaacagcgggccggagatgatcacggtcggaatggcgacgatcaggccgagcgccagggtgatgccaaggtttgcgttcagtgcgccgatggcggtcagcgggccggggtgcggcggcacgaatgcgtgcagggtggacaggcctgcgagggctggaatgcccagcagtacgaccggagctttggcgcggcgggcggcgaagagcaccaccggaatgagaatgaccacgccgacttcgaagaacatcggaatgccgacgatgaacgcgatcagtgccatggcccacggcagacgctgcaacggcgtcttggacatgatggtgtcgacgatggtgtcggcgccgcccgacttgaacaggatcgtgccgatgatcgagccgaatgcgataagcaggccgacgttggcgatggtggaaccgacgccggacgtgaaactgtcgaatgccttgtcgtattccacgcccgcgcacacggccatcgcgaatgagccggcaagcagggaaaggaacggatgcactttgcataccgcgataaggagaacgatgatggcgatgccgatgatcgccgcagcaataaggttcatgaatcctcctcgattcatggggttggcttgctagatttgtccgattctggagattcggacatatggaagcccattttgggtgcgtacatgtccgtttctggtgaatcggacagttgggctgctgtttttgggtcctgtttgtccgtttctgtggaatcggacaaacatgcaccggttttgggttttgtctgtccgtttctgccgaatcggacacatgcggactggggaatggtgggttaggcggcctgggttgcggtttgggcggccacagttgcggcgtaggcgttcaacgctttgatggcacggtcgaccatttcgtcgacgctgccttcgatggagatttccacgccgttctcttcgggggcaagcggctcaagaatggcgaactggcttggtagtagcgcgggcggcatgaaatggcccttgcgttcgctgagcctctgctgaatgagcttgtggctgccgttgaggtgaatgaagaatgtgggcacgtttttggcgagcacctcgcggtagctgcgcttcaacgcggagctggacaccacggtgttttcgccgagcgcctcgcgtgccaccatccaggagttgatgacgttcagccatggccagcggtcctcatcggtgagtggaatgccggctgacattttgtcgatattcgcctgcggatggaagtcgtcgccttccgcgtacacgtatccgagtcgttcatggatggcttctgcgacggtggatttgccacatcctgcaacgcccatcaccactacgtgaatgctcatgttgttctccttgctattgatgatcctgtgccgcttcgcaccaggaataagactactataaaccgtaaaagtagtatcagtcaaataaaaagtactacgaattggaaaaatcgtgtgacttgctatgctggagatagtgcaaaatggcggtaaatcacgcaatcgcagatacgcaatcatctgcgattggtgattgccgtgcgtgtcgcagaatgcgtgaaacatgccgtgaaacaaagcaggcatgttgtgaagtgggcaagggaggagcgatcgatggctgaaagcatggcgggctcagaacatatcggcagcgagctgttgcaggattcggtgagtcgaacgctcgccatcgaaatgctcgacggcgtgtggaaggctggcgaaagccttacgttggaagccttgcaaagtcgtttcggtatttccagaaccgtggcgcgagaagtcgcgaaaacactggaatccatgaatgcggtactcgtcaagcgtcgcatcggacttgttgcacgtccattcggcgaatggcaggcgctcaaccatcaggtgatcgaatggcgtctccactccacgcaacgcgaacggcagctgtcatccctcactgagctgcgactggccgtcgaaccggctgcggccgcctccgccgcgcggctcgctcccctcgacgtcaaggcgaaattccctgtgtacgcggcgcgaatgcggcaaatcgccgaagccaacgaggaaggcgaagcggggctcgcgcaattccatgatcttgacgtggaattccacacgttgattctgcgcgaaagcggtaatgagctgttcgcggcgctttccgacaccatcgccaccgtgctgcgcgggcgtgtggaactcggcaaatacccgatgaagccgaagtccgacgcgctcgacgcgcatgatgccgtagccgacgcgattgccaaaggggagcctgaacgtgcgcgcagcgccatgctcgacattgtcgacgaagtggcgcgcgccctcaatttcttctgattttcgcgccaaacttgctttcttcggtgaaaaatcgcaattgcgattactatgcggccgactcttgccatgcgcgacttttcagacgtaaggcgacatcggaaatacggcatgaaggcagctctgccaacgtttctttcggtgaatatgaagatgccggggaatacccccggcggcttggagccttccttgttgccaagagaaagcttcactattgcagcaaaatgcgcatgcagaatcaatcggttgcggtgattgaatctacatgcgcatttagtagacaagtactacttgcgggtggggtctttttgcaggaggaggaagatgagggcgacgatcagcaggattgcgatcgaaagcacgcccaccgaagcgttgccggtcagcgacgtggtggtcgcaacgaggaaagtgccgataatcgaagcggtcttgccgaaaatatcatagaaaccgtaatattcgttggcacgattctttggaatgatcttgccgtaatacgagcgcgacaacgcctgaataccgccttggaacaggcctacgagaatcgcaagaatccagaattccgttgcggaacgcaagaagaacgcggcaaacaacacaatgcagatataggcgaccacagccgtggtgatcatggttttcgcgccgaaacgaccggcaagcttgccataagcgatcgcgctcgggaatgccacgaactgcgtgaccagcagcgccattaccagatgcgtggagtcgatgcccagctgcgtgccgtacgaggtgctcatggaaatcaccgtgttcaccgcgtctatatagaagaagaacgcaatcatgaacatccacaacggcttgttcttgcggattgcacgaaaagtggagccgagctctgcgaatgtgccgcggatggcctcaccggtctgacccgcggtagcgcggtagtgcacctgcttatagctggtgagcagcggaatggtgaacgccacccaccacaatgcggtgattacgaacgaagcgcgcgtgcatgccaccgtggaccatccaagcaacgacggaccgccgaaaatcagcgcgatacaggcgataaacggaatcgtggagccaatatagccccatgcgaaaccatgcgaggacacgcggtccatacgttcattcgacgtgatatcgaccagcatggaatcgtagaacgtgagcgaaccgttcaggccgaccgtggcgagaatgcacaccaccaagaaaacgagccagctgagcggcaacgccatcgcacagcaggcgaccacgcccgtcaggaagaatccggtaaagaacttcaccttcatgccctgcacgtcggccatggatccaagcacaggcatcatcaccgcgatgatcagcgacgcgatggtctgcgcgtacccccatgtcgacacgatattcgattggccggcggactgcagcagcgagtttgcgtagattggcacgactgcggtcgacagcatcacgaatgcggaattgccgacatcgtagacgatccacttcttttcgcgggtggtaagttttgcgttggggtccggcatatgctctggggcagtctctgtggccatgtcggacgtaggtgcggatgcgggcgctgttgcgcgttcggacatgattgttgactctttcgaataaaccgtcaattcactattgtatatactacagttcatcttaagcggctgtaaggggagcgctctgccgttacgcatgaacattgcatgaacattgcgactgatgtgtgatcgacataaaaaatctgaaatatcgaaatgctgcaaataatactgggaatactgaaatgacggagatgaacatgtgcagattgtagattgcatcatctgtatgttgatgtcgtatgttgatgtcgtgaaaaacgttcgcagaacggtatattggaacgtgtcaaaatactgggaaaacacgaactaagtttgctgtgtgtgactgccgccgcgctgttgcgtcggcatatttctgcgaagagtcgaggagtctgtatgagtggggaagttccggacatgcttggtgcgaacgctgaaatgttgcgctcgatattgagccagccattgcctgacacgctcgacatgatcatctggcgtggcgtcacgaactccgcgcaagcgtcgccattcgaacgattcgcggcacgacttttggtggaagccggtgctgcgggcatccgagacattgctgccgaaaacgattttgatgtgatccgactgagcacgacgaaacgattctggctgcgctgcaacggcaacgatctttccaatgaacaattcaatgttgtgcaggcggtcgaatcggcgcttaaccgcatcgactatgccgacgacgaagcgcgcagggcggtgcacggaggtatgccggaagcgtgcatcgacgaaaacttctatattgcgaaatcgcaacagtatctgcgaaacgtgtcgggtgcgatcgtggcaatcgacggtctgcaggaaggtgaaaacaacttccgtagaatgaggggtacggaaggggcgcgcggcggaaattgggatatcagcaccagattcgccaatgtttgcgaaaatctcgaattgcctttccgcttgcattaccgatttgacgtcgatgcgtccagcggcgtgatggtagtgcgcttcagcataccgaacacggcgatcatgccggttgcgtcgcaatatcgcgacggattcgcctccgcgtatgccgtgcgattggcgggcatgcttgcgtgggcggcgttctcgtcaagcgtacgactgacgcaagtcgatctgaccggttgcgtgggggatgctgacggcattcccgtgatttccatgggattcgatcgcgtgccattcatgatgggtgcgctgcctgccatgaaaaacggacaatgcgacgtggttccgttggatgtcgatccgctggcgctgctcaatttgctgcgcccggtgcgttatgtgggtttctttgatgggaaccgtgccctgacgccaatcacaccgctggcaacgtcagccgtattcttggagaaacgtgtttccgaatggcaggatcaacgtgcgctgcctgaaggattgcggggattcctacgtgccgaccgtgcctgcgaacttgacgtgatgcatgacgaatcgccggtttccaccgatgatgtgaacgcgattatggaagaaaacgaaggatcccccatggtcgccgaactccaattggaagccgcgttggcgcaacttggcgaaagcggtgaagcaggtggggtgtgcgaagcgggcggaactgacgagacaggcgtagcgaaaattggcgaaaatggcgaaattccgctctactgcagccgtccaggcgtgcgactcatcatctccctgctagacggcgacgaacacacgcgctactggaaactgccggatgctgtagtcgacgtacaccagaatcttggggaactcgccaaaaacaatggcgactatgagcgcgcggaacgtgagctgcgcgcctgcatcaaacttgccccaaccagcgtacgtttctacgaggaactatcgcaggtatacgcaagaaccgacgaatacggcaaagcggccgacgtgctcatcggcgcgttgaaaatcgcagtgctgcctatcgattgcgaagtactctactatcgacttggctacgcattgtggcagttgggacgtctgccggaagcgctcgcctgctatgcgatgatggtcaacggcggcacgccattccgtacggccgcgcgcgatgaggccgaagaagtgagtaggcagatgggattgccttcgccggatatgaaatatggggatgcgtgcgatgcgctgcgatccggcggcgtgccggttgcgccggaagacaaggtgttagatacgattgcccgcgccgcgatttgcctgacggatgctggtttcccgctactggctcaggatgcggcttggatgcttggaatgcgcgatggcggtgatgtgatcggcgcggttgcgatgagcctgcgttttggagccgaagggcgttcgaagaactagcgcgacgacgccgggtggggtgtgctgggcggtttgactggctggcggctcgggctatgactggctggcggcgtctatgcgcgggcaaatggtggtttggatgcgctgtctgccgacctgacgcatgttgaccagacagcggcattccggggaatttaaggcgattgctatccacaaatttgcgattggctggggctggttgtatagttgagaagttgtgtgttctgccttgcattcagttgcggggcatcgaacgcgcagacttgcaagtcaatagtaattatagggagtccattatggcagctcgttgcgcagtgtgcggcaagggaccgcagaccggtttcaccgtttcgcactcacatattcgcaataagcgcaccttccgcccgaacctgcagccggttcgcaccaccatcgacggcgagaacgttcgcgttcgcgtttgcgtcaagtgcatcaaggctggcaaggttcagcgcgttgaagcgtgaatcgcgaaataacagcttgaaaccccggtagaccaatggtcaccggggttttgctttatcttgatcccgccagggctttaagcgttcggatttctccactcgatggagaaatcttcccgcttacagtggcgtttgcgtccgtattcctccagtaggtggaggaatactcccattggttggctggtttgcgtcctgatttctccagcgactggagctttttgcccgctaaggggcttgtggacggggtgatttctccagtgggtggaggtttttgcccgctgaggggctggtttgcgtccgtattcctccagcgagtggggaatttgggcggtttgagtcgtacccagtggtagaagccgcatctgtcggcataactggggagaatggtgcgttatgagcaccacactggaaacaccgatttcatcaatcgagagcaaccgccgcagagtcggcgcgctgaaatcgcttggtgtggtgtcagttggcgacgccctgacctactatccgttccgcgtaaccgatccggttcccgcgcgctcactgcatgaagcgaaaatcggggagaaaatggcgttcgccgcgcatgtgctcgaaacgcgcgttttccccatggcacgtcgaggcttccgcctgatcgcaacagtcacggacgacgatttcgcagcgcgtcgcaacaccccaaaatcgttggcgtcgctggtcttcttttcgtatcgcaaatcgtatgttgactgggtgcagcgcaaactgcacgcgggagcgctgctcgtcgtcgcaggcgagccaagcgtgtacgacaatcgtctgcaattcacgcatcccgacctgctcaccatcaatcccgtgcaatcgcagtcggaaaacggggaatggaacgacggtttcggcgatcctgcgaatccgcctctcggcaatctgaaatacgatgcgcaaacgatcgacgaagcgctgaaacgagtttgccgtccacgaccggtatatcatgcaacttcgcgaatttccagcgaacatattcatgaatcggtattgaaatatatggatgcgttgcgcggagccgaatatctggcaacgcaaaatgcagggaatttcttagataatcctacgcaagaaggggattttgatattccccaaattgatcgagaaatacagattaaagtactcggtaatgctattcccgatattattccggaagattttcgtgaggaatatgggcttatgcatcgtgctgaggcattcatggcgattcatgatccggttgatcgcaagaatttcgataacgccttgcaaacgttgcgatatgaggaagcgctgatctgccagaccgcgctcgtcaaatcacgcgatgcatcgcgcaaatccaaggctaccgcatgccctgaaacgcggttgaaagacgatttcatcgcgtcgctgccattcgcccttacgaacggccaacagcaggtcatcgccgatatttccgccgatatggcgcacgattaccccatgcaacgattgctgcaaggcgaggtcggttccggtaagaccgtggtcgcggttgctgccatgatgcaggccgtcggatcaggcggccaggccgtgcttgtagcgccaacgcaggttcttgccgaacagcattatgcgagcatttccacaatggtatccaaactgggaaaaagcgacgcaaattcgagtgataatcaaaaaaatctagatgatgccaatgcgcggcgaagcaataaacggtccgcgcaaagttcgaaagatggggaattcgacgcaaaaacaattcacaataatgctgtggataaaggtgtacaacttgcagaccttcttgatttggccgcatctgatgatgtggaaaccggattttccggcaaaggaaacgatatatttggcacaaaagatggggagattcctgtatttcttctcacgggaagtatgcgacttgccgaacgtcgtcgcgtgctcgcagcagccgcatcgggcatgccctgtatcgtcgtggcgacgcacgccgcattttccaagagtttccaggcgccgaaccttaccttggcggtgatcgacgaacagcaccgcttcggtgtggaacagcgcgaatcgttgaattccaagggttctacggcgcctcatctgttggtcatgacggccacgccgattccgcgcaccgcagccatgacctggttcggcgatctcgacatttcctcgctgaccgaacttcccggcggccgcaagccgattcgcacattcgtggtgccggaagacaatgcgtcgttgatgggcgaaatgtttgccctgattcgcaagcgcatcgacgcgggggaacgtgcctacgtggtctgcccgcgcattgacgccgatgccgaagatgcggacggcgcgctggcggcgtcagcggcttcaggctcgaaaaccgcaggttcgtcggccgcggcttttgacgacgcctacgatcttggcgaagacgacgaccggcgcgcacaacgccccccgttgcattccgtggcggaaatcgtggagcgtctgcaatcgctgccgcagttcaaaggcattcgattcgccacgttgaccgggcgtgacgatgacaccacaaaatcgcaggtcatggccgattttgaatccggcataacaccgattctggtggcgaccacggtgatcgaggtcggcgtggacgtggcgaaagccagctgcatcgtgattttcgatgcggaccggtatgggctttcgcaattgcaccagttgcgtgggcgcgtcggccgaggcggcaccgattcgggggctttcctgatttcgcgtgcgcccgcggacagtgatgccgcccgccgtcttgacgtgattcagggcacgttggatggtgccgaaatagcgcaggccgatttggaattccgcggcgccggcgacgtgctcggcgacgcgcaatctggcggaaagtcaggtttgaagctgcttcgtgtggttaaggatgtgaagattattgagcatgcgcgggttgaggctacgaggcttgtcgctcaggatcctgatttactcgaacatgtgcagttggccggggcggtgcttgatttcacgcgcggcaatgaaacgttcctgaccagtaattagtttggtgcgattaattaatcgcctggcacgctagagtggtgcgtatgcgcgtaatttcaggacgattcaaaggcgttgcattgaccacgccgaaagcgggcactcgaccgaccaccgatcgcaccaaagaggcgattttctcgcatctcgattcatggggagtgttggacgatgcccgcgtgctcgatttgtttgcaggaaccggcgctttgggcatcgaagcattgagccgtggcgcacgagagctggtggcggtggaatcatccgctccggcggccgcattgatcgcgcagacgctgaccgcgttgaaacataaccgttcgtgggaacatggcatgagtgcccgcgtggtgaaggcgcgcgcggaaaaatacgcggcttcagcttcggccgttgaaccgttcgacatggtgttcatcgacccgccgtacgccttcgaaacgaatgattgcaaccagctgctcgccgatcttgccagccgtgaactgacttccaacaacacggtgatcatgctggaacgatccacccgttccgaagagcccacggctccagaaaactgggaaatcaccgatcggcgcgattacggcgaaaccgccgtgtactacatcgaactaagcaagccaatcgctgaatcgtaaattcggcgctatgatgtcagcatgtttaccagtgccgcatcgtcgcgaatgttttatgtcgacagcgaactcgattacagttcggtgatcaactccgatcaccgcgaatcttggggcagtaatcagctgtatccagcaattgtgcgtgtgcatacggaaatgcctgcgcagaatgtgccattgcattggcatcttggctcggaactggtatatgcgcgtcatggtgacgttcgtttgttcatcgacggcatggacgttactctgcgcagcgggcagttgtgcttgattagtcccaaagccctgcattccattcatccaatgccgcatgatgattcacagaacgtgttatccatatccttcgatggtgaatacttgtctcgcatgtgtccggaattagcgaatatacggctgaatcaaggggttgtctacggagtagatggcattgtggacggtcaactccttggcttgtgcgagcagattgtcggttgtgtggaaaatgatggctcggcgctgcagatgctgcaactcaatgcgttgctgtatgagctgctttatcatgtgtgtacccagtgtacggtgatggattgctatactactgatggtgaggcaaaacatatcagtagtaacgcagtctgcagtactgcacatgctttcaatgctggcgatgttgcgactgtcagcgaaggctcgggtgttggcgtgcgtcgtatcactgaatatatggaacggcattacgcgcaggatctgtctatcgggcagctcgcatcacagttcggctattcacgtgagcacttctctcgactattcaaacgcggcacaggagttacgcccgaccgatatctgacggaaatccggttgcaatcggctcttgatgatttgctcaatactggcgataccgttgcgcaaattgcgcagcataatggatttcccaacgtgcgatcgtttacaacagcatttgcagcacgtttttccgctactcctgcagtatatcgacgtgctcacaacgcataaaatatgtagtgcgggcgcttgcgtaacgttatgcttaactcttgcgtaacgttatgcttaacttgagtgatttttcgcaaaatcaagtattctcagcgtgtcacaaaaccgactttttctgtcaaaaagtcacctaaatagttgatatgtgctctcgtaagctgaaatcacagccgcatgtcgtagcagacaggcggcacagtgcacgtgaacagtgtgcataaagagaaatagcgaaggagcgaactatgagtgataccaccgtgacagctaaagctgccccaatgtcgcagctgccgcaatccggaccgaaacgagtcatgcttaaaggtgcaatcttgtctctggctctgctgctacaaagcatttccgttactgcagcagtcgtgtccagtcttaaacaagactttcccaacgcttctgccatggaactgcaatgctttgtgacagtgcctgtgctgggtaacatcattgccacgctgattggaggacgcttcgccacaaaaatcggtaagaaaaacctgtgtatcatcggtacgttgttgtgcttcatcggtggttttctgccaatgttcgtgccgatacttgatggacaaaccgcgcttcgtgtgttcgcaggttttggtttgggtttgatccagccgttgtctgcatcgttgattgtcgattgcttcaaaggtaaggaagcggacacactgatgggtttccaatcctctgcggttggtttgggcgccactattatttcttccaccattgcaggcatcatgtcgttcgactggcactacttctactacgtgtatttcttcgcactggtggttatggtgattgtgttgttcttcattccgaacgcagtaaacgacttgggtcgtgaagaagtaatttccactgaaactaacgcagctccgaagcagcgcaagaagatgccgatttccgcgtatttcggcatgttgctacagatcatttttgccactggttacggcttctacactatcaatctgtcgcttgccgctgaagaaaccggcaccatcaccgcagtacaagcggcaacggtcatcaccatcatttccgtgtcttccttgattggtggtctgttcttcggacttgtcaagagcttcgtcggcatgtgggttggcgtgatcgccatcgccatgcaaggtattgcactgctcatttggggtaataccacttcgcttgccgcttggaacgtggctggtgtgctgctgggcgtgggtttctgctggttcatgccatacgtgaacattctggtgaacgagcataccgatccatccatctctgcacaggccacttcttatgcgttcttcggcaactccgttggttccttcattccgccgtatgcattcgcagcactgggcacaatcaccggtatcaccagcccgtggaagtccatgaacatgggtgccgcattcatggtcgtgtgcatcgtgctcatcctggcattcatggcgtcggaaaagaagaagactgcagcaattgttgcctgacggcaattcgtgtactgcaacatgcatattgaaaaatggagaaaacaataatgattgatatcgaaaccatggtagaaccacccgcggcggagccactcaaaccaatcttcacaccagtcgataaagtcgcggaattcccccattccgatgagctgccggaaggttgccaagtatttgacatcaacactgacgatttcttctactccacgtatataacgcacgaaacatatgtgacgcgacgtgacgtggacggcaacgacctcgatctgcagatgaccatctacacaccgttccatgacgatggcaacatgcccgacggtaaaccagaagcaggttggccggtaatcgtgatcatacgtggagccgctttctttaagccgaacctgtccagtttcaacagtctatatattcgactggcggaaaagggatatatggttgtagtgccggaatatcgtccaagcaccgtcgatccgttccctgcacaaatgcaggactgcaaaaccgctgtacgttatgtgcgccgcaatgccgaacggctggatgctgatcctaatcgcatcgcattattcggtgactctgctggcggccataccgtacttatggcaggttttaccggtgatcgcgagccggatactccagattacggcgagaccagtgctgaagtgcgctgtatcatcgactggtatggtcccaccgattttgtgaaaatgaactactatccgagttcgcaagatcacaatcctgcgcaatgcccggaaggtatggaactcggcggcgttagtgtgctggaaaacccggaactgagccgtgcagcttcgccaatgacctatttgagcgctgacaggccgactccgccgaccttgattatgcatggcggtcgtgatctgctcgtaccgttcaaccagagttgcaggctgtatgcgaccatgaaggtgcttgataaagacgtgactttctacaagcttgacaatgccagccatgccgcttatggattccgcagtgacaaggcaatcgggttggtacttgattggctgcggaagcgtttgtgaaactggcggataatgcggtaatgctgtaacgttaccgaactgctgccaaatcgttgccgagtcgatatgagaaaacgtcaatccgatgatgttacttgcatcttggattgacgtctttcgtatttgcgcttttgggaatacgcgacttttatcgcttgcgggggtaggggccggagacttcccaaccgagcgacataagcgtcttgcgatcggccttgtcgagcttggcgcaatccaacgcttcgatcaggtcgggacgcaactcattggttttctcgagcgcctcatcacggcggaaacgatccaccttcgcatgattgccggaaagcagcacgtccggaaccttgatgccacgccattccgcgggcttcgtgtactggcggtgctccaacagcgcattatcgcccgtatacgattcctcaacaatcgaagcggcattgcccataaaaccgggcagcagccgcgtgatcgcctccaacatgaccgacactgcgacctcgccgccgttcaacacgtaatcgccgatcgaatattcgcgcacgtcaatgccttgcgcgcggtaatactgcggaatgcgcgcgtcatacccttcgtaacggccgcagccgaacagcagatgatcggcatggctcagttccgtcgcatcctgttgtgtgaacagcggggcggaaggattcggaaaaatcagcacaggacctgcggaagatggtgcaatatcagttttttcggaattctcaggacctgcggaagattgtgcagtgtcggaatctgcagtatcgcaagaatcgccagtatcgaaggaatccgcagaatcctcaatattttccgtattttcgattaccgcaggctcaagctgcagcagctcgtcgaggcattcgctccacacttccggcttcatcaccatgcctgcgccaccgccgacaggagtgtcgtcgacggaatgatgtacgtcgtgcgtccagtcgcgcagattgtgcgcggtaacctccacaagccctttcgactgcgctttgccgagcagactgaggttcagcacttcaaaatattccgggaaaacagacacgatatcgatcttcataatgttcagaataccgggatgcctgccaagtggcaggaaacataaaaagtgggcactggattccaatgcccacttgaatggatatgtgatcgaaagcgcgtaatcatgaatgcttacgcaggatcgcaaacgatcacagtcccggaataagacctccaggcggatcgagggtcagatagccctcttcgaggtcgatgtctggcacgagctcgtccacgaatggcacgagcgcgctgttctcaaccacaacgccgtcggcatccttcaccggattggcgagacgaatcttcagcagccattgggccacttctatcacgtcaacgactttgccgaccaccacgcccggttcgagaccaagcatattgtcttcagccagtcgcgcctcaagaccgatgaggtctttcggataccactcgtcggcttcaagcatgtcttccggatcgtccgcctcgccatacagcacaatgccgttggctgcttcggactggtcgcggttgtcaatgccttcgaacttgatgatccaacggtttttgaaggtacgggagttctccaccacatactcttcttcgccgtctttcgtgtacaacacagcaccgggagcgaaccggtattccggttcgtccgtaaagatctgcacggtgacttcgcctttgagcccctgcgcacgcccgatacgacagaccctcagcagctcgggctgttgagggtcgtcagaatgcatatcacgcaccacgctaggatctcacctgcgcacgtccatgatgtcgacgcgcaccttgtggtcggacagtgcctgcaccacggcgcgaatcgcatttgccgtgcgtccgctgcgtccgatgacgcgaccgatgtcttccgggttgacgcgcacgcgaatgagttcgccacgcgcgttctcatgggacttcaccgaaacgtcgtcggggaaatcgacgatgttcttaatcagatgttccacagcctgggcgagcatgatcactcagcttccgcagccggctcttcagccggagcttcctcggtagcggcggcttcggcttcagccttggccttggcgtcagcttcggactttgcagccttcagcttctgagcctgagcctcaacggcctcaacgcgagcggcggcatccgggccagcttcaacggtcttcagggtgccttcagcaccgtcaaggcccttgaacttctgccagtcaccggtgatcttcagcaggttcagcacctgctcggtcggctgagcgccaacgccgagccagtactgagcgcgctcggaatcgataacgatggtcgaaggctgggtgttcggattgtaggtaccgatctcttcgatggcgcggccatcacgcttggtacgggaatccatgatcaccacgcggtagaacgcgtagaacttcttacccatgcgcttcagacgaatcttggttgccaaaatggctctccttgtataactaggggtgtgcgtttcgttttctgtgtggggcacggaatccgaaacccacatgttcctcacgtcacgcgatagttagagggcctcgcgcgcgcgaataacttaccaagtataaccgtggggtacggacggatgggtcttaggatgtttcccgctctatgcgactttccgaatccgtgcaaaaccgggaagtcgtttgtctgattctgcggaaacggtcaattatgcggcgaatgtgatgccttgaatgaccgaatcggcagaatcggacatttgctggcattcgtgagatgtttgcgtgggtctacatggcggaatcgtcggaatcaggcaggctggctacacttggaggttccgagtttgcgtatgtccgttcggagtgaacggtttgcatagggggagttgcctgaatgattatcgcgctttggattgcgttgattatttgcgttgtatggattgcgcttggcgagatgccggctggttgggatggccatttgccgctgccgtacttgattgcgttgattccgttgctgtggattccgacgcttgtgatcgccgtcgccggtttcgcgttgcatgagccggctctcgggggagtcgctgcggtggtctgtcttgcgtcgctgctgcgcaaaatcgcatattggatggaaaatcttaattctcccaatactgcgcagagggttgccgaaaaacttgcggaaaagcgtgaaacatctcgtgaaacaggcaatgaagctgttacggaatccgcgaaacatggccgtttccgtgtgatgacgctgaactgccgatttggtcgcgccaacgctgcggcaatcgtcagcgcggtcaaaaaacatgatattgcagtacttgcattgcaggaattgacggacgatctggttgcgcaattggacgcttcgggattgtctgatttgcttccgtaccgtcagttgggggagagcaagggaacggacaatggcggattcaacggtgtgtggattcgtattgaaccaagcgacatgtctccggtcactgcggtgattcccgcggccgacgtgccgggcgtgtgcttcccgatcgattcgatgcgcggcatcacgtttgtttcggcacatccgaagtctccgatgcgcggatgcagggaatggtccgccggcatcatcggtttgggggagttggcgaccactcagaagcagggcgacatcaccgttgtgttgggtgatttgaattccggtaccgatcatccaagcttccgcaagctgctgaatgcgggcttcaaggatgcggccttgtgcgaggcgaagggccgtcatgccacgttcccatcatggctgtcgtggccgcgcatcattctcgaccatgtgcttttcaccaagggattggacgcttccgacgtgagttcgttctgcgttgaaggtagcgatcatcttgcgcttgttgccacgttgacgttgaagtagttgatggcgattataaggtagtcgattcagctgaaaacagctgattggagtacgcaaaaaggggatgcgattcgtcttgaatcacatcccctttttatacgttaccgttttcgcgtcgcttgctttagtgcagcaagccggacagtccgccgccaaagttcggtggcagctcaccggcatcgcccatcaagtcttgcaatccggcgggaagtgcaggattctgcggcttcttggcaaaagcggaaccgccggaagacttaccgtcggagttcttgccggcaagcttgtcgcgcaatgccttctcttcagcctcgcgcttcatcggattgccggacttaccgcccttcttcttgcccttcttgcctttacccttgcctttgcccccgcccatggcagggccgccaaagccaggcatgccagcgccggccttgttgctcatacgcttcatcatcttcgcggcctgctcgaaacgctgcaacagcgcgttcacctgcgaaacggtcacgccggaaccgtaagcgatacgagctcgacgagaaccgtcaataatcgaaggatcacgacgttccgcaggagtcatcgaacgaataatggcctcagtacgatcgatttccctctcgtcgaactgctcaagttctttacgatgcgcggccatacccggaatcatgccaagcagattcttcatcggaccaagcttgcgcacctgctgcagctgatcgaggaaatcatccaaaccaaaggaaccatcggaaatcttgatggcggccttacgagcctcttcctcatcgaactgcttctgcgcctgctcgatcagggtaagaatatcgcccatatcgagaatgcgggaagccatacgatccgggtggaaaacctcgaaatccttcagaccttcgccagtggaagcgaacagaatcggcttgccggtaacggaggcgaccgaaagcgcggcaccgccacgggcgtcgccgtcaagcttcgaaagcaccacgccggtgaagtccacgccctcatcgaacgccttcgccgtctgcacggcatcctgaccgatcatcgcgtcgattacgaacaggatttcgttcggctgcacggcgtcgcgaatatcgcgagcctgcttcatgagctcttcgtcaacgccgagacggcctgcggtatcgatgatgaccgtgtcgtacagcttctgcttggccagcgcaacagcgtcacgcgccaccttcaccggatcgccggtggtcagacccggggaagcaacggcttcgccaccgtcggactgcacgcccttttccggagcgtacacgggcacgcctgcacgttcgccaaccacctgcagctgcgtcactgcgttcggacgctgcaaatcggccgcgaccaacagcggagtgtggccggaatccttcagccagtagccgagtttgcctgcgagggtggttttaccagcaccctgaagaccggcgagcatgatgacggtcggcggattcttcgcaaaattcagcggtcggtcaacgccagcgccaagcacggccgtcaactcttcgttgacgatcttcacgacctgctgggccggattcagcgcctgggaaacctcggtgccgagcgcacgctcgcggattcggccggtgaaggaacgcaccacgtcgagcgccacgtcggcgtcgagcagcgcgcggcggatttcgcggatcgtaccatcgatatcagcctcggaaagcttgcctttgctcttcagatgcttgaacgcattcgagagcctatctgtcaaagaactaaatgctgccataatgtccctcagtctagccgtcccgcgggaaatttcgcattccaattaatggtgttgatgatgttcggttgatattcggtgagatgcttgatgctatttgcatgagaaatgacaatcccgtctcttccaataggagaagacgggattattgcttattaagagcgctgcggattatttgagggtccaggtgggaccctggggagtgtcttcgatggcgattccggctgcgcccaaggcatcacgaatggcgtcggcgcgggcgaaatccttggccttgcgggcttcggcacgctcctccaactgttcggaaaccaaacggtcaagcgcagtatgctcagcggaatcggcaccggctccggcggtgccgccggccgcaccctcgcttacccacggttccgccaacggatccaaaccaagcgtatcgagcatcgcacgcacattcaccaaaacagcgcgaacttcatccttcgcaacatccgaatcaacacgatcggcaagcttcgaaagcaacgtgttgccagaacgaatcgccgtgaaaatcgcagcggaggcgccggaaacattaatatcgtcattcattgcggcgacgaaatcagccggcagctcatcggcggaaaccgaaacgatctcctcacgggacggctgcccgccaacggcggcaccggcacgttcgatgaaattcgacacacgatcgtacgcggactgagcctcggtcaacgtctgatccgaccattccaacatggaacgatactgcacggaaccaagcgcgtaacgtaccacccaagcggaattttccgccaaaaccgccggcacggacaagccgttgcccagcgacttcgacatcttctcacccttggcggtaacccatgcggaatgcatccaacgagccgccgaatcgtaaccggcggcacgagtctgcgccatttcgttctcatggtgcgggaaacgcaagtccagcccgccgccatgaatgtcgaacatatccttcaaatagcggtggctcatcgccgagcattcaatatgccaacccgggcgacccgtgccgaacggagtattccaacgcgcgtcaagcggatcggaatccttcggagccttccacaatgcgaaatcacgcggatcatgcttgtcttccgacatgtccgcaggatcaaccggattgtatttgtcgttgcccgtattgtcgaccgacggacccatggcatcggccacttcggaagcggcatcagccacagcggtctgcttctgatgcgtcaactcgccataatgaggccagctggcaacgtcgaaatacacgttgccggtcggattgccgttctcgtcagtcaccacgtagccgtggccgttgtcgatgatctgcttgatcagatcgatcatgtcgatcatgtggccggtcgcacgcggctcatatgtaggaggctcaacacccaacgtgttgtaagcctcagtgaattcacgctcgtaaatgtacgcacgctcccaccactgctgaccggcggccgcagccttatcgagaatcttgtcgtcgatatcggtgacattgcgcacgaacgtgaccttgtagcccaaacgctcgaaccagcgacgcaccacgtcaaacgcgacagccgcacgaatatggccgatatgcggcgagctctgcacggtggcgccacacacgtacatgccgacctgaccaggcttgatcggcgtgaaattcgacacggcgtgcgatgcggtgtcgtacagcttcagatcggcagcggcgctcgccactgcgtcaactgcggttgcggcgctagaaatgttgatattctgcggttcttgcgtgttcgtcataaccacgagagtattgccagaatcggacatgcatgcgagatgaaaatgaacggcaaaacggtttttgttggatttgtgaacatcgtttacgtaggtgatgcaacaatagaacgtatgacgcaatcgcaggtgctgattttgcaacacgttccgtgggagagaccgggacgcattttagacagtctggatgatttgggactgcagtatcaaatcatcaatgtcgccaagcagaagaaaccggatttgcctgattttggcgaggtttccggcgtggtgatcatgggcggcccgatgggtgcgctcgactacgacaagtatccgggattaaaggccgaggccaagctcgcgcgggctgcggtcagcgttggcaagccggtgttgggcgtgtgcctgggacatcagatcatcgccaccgcgctgggggcgaagctgaagtcgggagatgctccggaaatcggttttgcgccgattaaatgcatcgacaagcatgattatttctcgatgtggaacaaaaccgtggatgtgctgcactggcataacgacgtggtgtcgttgccggagggcgcgcagccattggcacgatccgcgaagaccaaggtgcaggcgttccgttttggttccgctctgggcatgcagttccacttggaggttacccctactctgttggaggagtggcttgacgagtcaagcatggtcaaggatctcaaggctgccggcgggtcgaaatcgcagttgcgcgaggcgttcgccgaatataatccgcagttgcagccgcttgcggatcaggtgttttcgagttttgccgctcgttgtaattcgtatgggcagaatttggctcagtcgcagcagggctgatcgccgagttgcgtgcggctccgattgctgcgtagcgctggtggcgattcgcaagttgcggcattgcctgcaggtttgggagatgttcccgctacattggtgacttatgccgacttatgatttgggacttgaacacgtttcgcttgcttttgcgaccaagaatattttcaacgatgtaacgcagggtgtttttgaaggcgaccgcatcggcatcgtcggtaagaacggcgacggcaagtccacgttgctgcatttgttcaaaggcacgcaggagccggactccggtcgcgtgaccattcgcggcgggcttacgctcggcatgctcgaccagcgtgacccgctcgacgacaacgccaccgtgcgcgaagctgcgctcgaaggccgtgaagactacgaatgggctgcggaaaccaagtcgcgcgaaatcgtcgaagcattgcttggcggcatcagcttggaagcgaaaatcggttcgctttccggcggtcagcgtcgccgcgccgatttggcacgcctgttgctcaaggattgggatattctcgcactcgacgagcctacaaaccatttggatgtggtgaccattcactggctggcggaacatttgaagaaccgttggccggccggatccggcgcgctgctgctcgtcacccatgaccgttggttcctcgacgaagtgtgcgaatccatgtgggaggtgcatgacggcgaaatcgagccgtttgaaggcggctattccgcatacatgctgcagcgcgtggaacgcgatcgccaagccgacgtgcgtgaaacgaaacgtcgcaatctggctcgtaaggaacttgcctggcttacccgcggtgcccgcgcccgttccaccaagcagaaattccatgtgaaggccgcgcgtgagctcatcgccgacgtgcctccggtgcgcaatacgctggaattgaagcaaatggccacatcccgcttgggcaagcaggtggttgacctgatcgacgtgacgcagattttcgaacatgtgcaaggcgaggccgatatcgatcctgacgttgccgacatggaagcgtcggcatcgcgcgtcgatgtggtgccggccatgtatgccgagccgcaagtgcatggttccgtggaagttgccgtcgacgatctgactgatccgcgattggtggatgccggtgttgcagcggcgcaagttgctgcagctgcgaaagaatcgcaagaaattcaggaatcgcaagaaaataatactgatgattctgcagaagaaattacttctgcagcgcaaaaaattactgttaccggtcgtaagattcttgacgacgtgacatggctgattgggccgggcgatcgtttcggcatcgtcggcgcgaacggtgccggaaaatcgacgttattgaagattcttgacggcacgatcacccccactgtaggtcatgtgaatatcggcaaaaccgtgaaattcgcggtgctttcacagcgtctcgacgaattggagaagctcggtaaatacaagatcaaggaagtgctgagccgttacaagccgagctatatcgtggacggcaaggaaaccacgccggggcagatgatggagcgtctcggattcgagtcggcgcagctgatgacgccgatcaaggacctatcgggtggtcagaagcgtcgtatgcagttgctgctgatcctactggacgagccgaacgtgctcatcatggatgagcccggcaatgatctcgacaccgacatgctcgccgtgatggaggatctgctcgacacttggccgggaactctgatcgtcgtctcccatgaccggtatctgctcgaacgcgtcaccgatcagcagttcgcgctgatcggcggcaaggtgcgccacctgcccggtggcgtgcaggattatctggacatgactgaggccatcaagaacggcaagaatccgtttgcggacgaaaaggcaggtgccggcaaaggcaagaggggcggttccgctgggactgccggttccacgaccgaaggcaccgcaggcaactccgcaagtgggtctgcgactgctgaaaccgcatcttccgcgccttctacgccgaaactttccggcaaggcctttcacgaagcctccaagcgcgtatcggcaatcgagcgcaaactcgccaaactcgaagagcagaaagccgatcttgagcagcaaatggccgcgcacgaccccagcgactacgagggcctaggcaagctcaacgaccagcttcaagccgtcaccgacgagtccgaagaacttgaactcgaatggatggaactctccgaacagctcgagtagcattcgtatcgcccgcgtcaattaccggacagggtgtgcatgttgtggcggcggcgcagctcctccagcgtttccggtgaatgttggccattcgtgcgacagcgatgcgtggcattccatgtgccaatgtcatattcttgttattgcaggaaaccttagctgttcttgtcggagagaccaatggaggtgccttatgaatcaagtgatgcgaagaagcgcctgttgcttgttgtccagcttgttgttgtggtcatgcgttggctgcacgaaagctgcacatgaaagtttcggtgatggctccgtacagagcggcagcgagcatgatgatgccgcaaaacaggcatataaagcatttactgtggacgctctggatcgtgtcgccgtcgatgatctcaatagctcgggcaaactggttctagtaaacaagttgggtgcgaaatccgtacatggcgatgatgctatttcatttacaaaaacagttgatgacagcaatatgtattatgtcatctccatgtgtaagcagaaggagcaggctccttattcgtttgttctctacaaagatggacagccacacaccctaaccactagggaggcctgtacatctaacggaatagaaacgatctctctcccggcgaagaatttcccagatgccacctcattgtccattatcaatatcggcaatacggatcttgttgtttccgtatatgaagtaaaggaaccccatcatgaataatttcagtcataatgctccctgtcgtcctgccatcatcatagtttgtgacatcacaatgaatgctactgggctagttgttgcaaaactggctcagtaggtagatggggtagtaggtaatattgtggttggtttcgatgttgccggggccgaaaactaatccttggtgaaggtgataactttcctctgccaacacattattaagcgctcgatgaaccttgtttgatatcttcttgcgcctggcgaacgtctatgagactgttgttttgcgcaaaagatgctactgcagctggcatgactccaatgatcagatattttctgaatatcgcagatctgacaacaaaaagggctttcccgcgttgaaacgggaaagccctgtaggtttgggattaggctgattggatcagcgaccggtgatttcggagccgagcaccttttcgctcaaggccttcggaccgcgcgtcactgcgaccgcgccggaacgaaccagctcgataatgccgtaatgctccaaaagccccagcagcgcatcaatcttgccttcggcaccggtggcttcgatggtcagcgattccggattcacatcgaccacgcgcacgcggaacagacgcacgatctcaagcacgtcggaacggttggattcgtcggcagttaccttgataagcaccagttcgcgctccacagtggtgttcggatccaaatccacgattttcaacacatgcagcagcttgttgagctgcttgatgatctgctcgagcggcacctcatccacatcggcggtcaccgtgacacgcgaaatgtcaggacgctcggtgggggagacggacagcgagttgatgttgaacgcacgacgggcgaacaggccggcaatacgcgccagcacgcccggacggttctctacgagcacggaaagcgtatggcgcttggaacccggctgagatgcaggatacattggtagacccttccttactacttactcgtttgctcgtttactcgttgtcggcagcggccttcgggcgctgcagcggcttgattccgggcatataggtgacattgtcgttggaatcgccagctgcgaccatcggccacaccatagcgtccttccacacgcggaagtcgataagcaccgggcgatcgttgatttcgttggccttcttgatcgcctcaatggcttcttcttccgtgaacgcacgcatgccgatgcaaccgtacgcttcggcaagcttcacgaaatcaggaacatccacgatttccggcgtattctctccatccatcagattggtggcggaataatgctcgccgtagaacagggtctgccactgacgaaccatgccatacacggaattgttcagcagcgcgatcttgactggcgtgtgatcgtggaacgcggtcgccagctcttcagacgtcatctggaaggaaccgtcgccgtcaatcagccacaccggcttctcgccctcatggaaacgttcggaaccgacacgagcgccgatggcggccggcagtccgtaacccatggtgccaaggccgccggagctcagccaagaatgcggcttctcgaaatcgatgagctgcgtggcccacatctgatgctggcccacaccggtaacccaaatcgtgtcagaatcagccaggtcggaaagctgcttgatgacccactgcggagcgagcgaaccatcggtcggctcgtcccacttgatcgggtacttttcacgccaatcgttgatgatctcccaccaatgcgaagtgtcaggcttgccatgcacggcctgctcgcgcttgatttccggaatgagatccttcagcacggttgccacatcgccaacgatcggcacatccggctgacggttcttgccgatttccgccggatcgatatcaatgtgaatcacacgcgcacccggagcgaaagcgtcaagcttgccggttacacgatcgtcgaaacgagcgccgatcgcaacaagcagatcgcaacgctgtacggcaccggtagcggcaatcgtgccatgcatgccaagcatgccaagcaccttcggatcggaatcaggcacaacaccgcgtgcgggcagcgtggtgacgatcggagcgttcgtgacttccgccagctcctgcacgagcttgccggcatcggaacgtgccgcgccgccgcccacatacagcaccggacggtacgactgctcgaacagcttcgcagcgtcggaaagcacacggccgtgcgccttcgtggtgggattgtagccgggcagaatcatgcgctgcggccacgaatagtacatatcgccggtctgcgcggttttggtgacgtcgaccaccaccggaccagggcggccggaacgtgccacatagtgcgcttcagccagcacacgcggaatgtcctgcgcacgcgtgaccagataggagtgcttgaccaccgggtaggttgcgccgacgatatcggcttcctggaaggcgtcggtgccaatggcgttcacgccgacctggccggtgatgaccaccatcggcacggaatccatgttcgcgtcggcgatcggggtgatcatgttcgtggcgcccgggccggacgtgacgatgcacacgccgacctgaccggtcgatacggcatagccttcagccgcatgacctgcggcctgttcgtggcgcatcagcacaaaacggaagctggtttcatcattgattgcatcgtataccggcagaatcgcgccgcctggaacgccgaaaacatccttgacgcccagatcttccagcgaacgtaccagcgcttcggcgccggtcatcttctcgccgtcaacaatggtctgcttttcagtggttgcggctgccttgggcatgccgctgaatgcctgcaggggcgtaggtaacaccatgttccctctcatattcgctcgtggaactttcttacaggggtatgctgccgcgtttcggtgcacgcaatcagccgaaccccatcatcggaaagcggcgcaatcgcttgtggcgacttgcgaatcgcaatccttcgctagtaatcagtctatgctatcggctgacaggagaatatgccggattcgtgccatattctggcgtattgcgttccgcggcggtatgagagggcggattcgtagctgctttttatctacctgcgactacttactggtgttttcgccgttgctgccgttactttcgttgccgttgtgcttgtgatgatgtttgcgatgcttacggacgttttgtgcttcaggcttgcgattgtccagtgccttccaaccttcttcggctgcggcgagttgcgccttgcgtttgctggtgcctgtgccggtgctgatgatttcgtcgctttcgcccagcatgacgttcgcagtgaacacttgcgcatattccggaccggaaaccgacatctggtagcgcggttcgccgaagcccatgccatgcgctttgacggtaagcgaggttttccaatcgagggctgggccttccgtcgcgacttccgcaagcgtttcgtcaacaagatgatgcacaacgcgacgtgcctcgtcaatgccatgctgaatgaacgtcgcaccgatcaacgattcgacgatatcgcacagaatcgagcttttatcagcgccgccctgatcgctttcgccatgaccgagcagaatgtacgggcctgcattgagcttttcgcgagcgattttgctcaaggattcctcggaaacggctttcgcgcgcattttcgcaagctgcccctcgttcatgtcggggtgtgccttgtacagggtttccgtggagacgagctcaagcacggcgtcgccaaggaattccaaacgttcgtagttttttgcgcccggattctcgtgcgagaaggagcggtgggtgagcgcttcgaccagcaggtcgggttcgagcgtggtgccgagcgcttcaagcagtgcgttggcggtcatctcgccttcggaaacggcggatgcgtcggcgttgttctgggtcataatcgtcctcggtttcgtagtgggtatgcgacggcgaagctcgccgcgctgttcgggacgttgcgtacgtggcaacaagccagcgaatctggccgattgctatgcaaacaacgatcccgttcagtctactctccacccatgtcgaggcggaaatgcagggaaatgcgcggatactaggtggatacgatacttggcggatgcgaggtgagatggttgggtgcatgcgaatgcatatggccaagtgcgcagcctgaaatatacaaaaccctgccacccgtcgatggcagggtttcaatgcttcatgccgttactcggcagccactcacttggtgtggatggagcggacagcctcgcggtacacgcggccgcggtaggcgccgcagctcgggcaggccatgtgcggcagcgccggagcgccacagttcgggcaggtaacggtctgggcggccttggccttccagtttgcgcggcgagaatgagtattcgcgcgcgaggtcttgtacttaggcagtgccattgtgtttcctctgtttcgttcgaacgattgagcttaagcgttcagtatcttaacttgtgctccgtacaaattgcaaaaaccgagcaaaatcagccctgccagcacccggatggaccttactcgttgccttccagccgggccttcaagccttccaaagcggcgaaacgaatatcggtcacatcgtgatgatggtccggatcctcgttcagatcggcgccgcactgagagcacaatcccaagcaatcaggcttgcacagcggctgcaacggcagttcctcgaccaacgtgtcgcgcagaagcatctcaatatcggcccaggatccgccttcaagcagcggatacgaatcctccgactcgtcttcgccggcgataatgtcgacttcctcttccttgacgccgcccttgccgtttttgccgcccttgccggacgcaacgcttgcggacttgtcttcatatgggaagaacgaagtgacgttcaccgtccaatcgcgcttgatcggtttcagacagcgggtgcattcggcgtgcacgggggcactgatgcgggcgttgaaaatcaggccgtcgacaatggagtcgaacgagccgacaacggtcacatccgcaccctcctcaacgccgacgatctcatcgccgatgccgctcggtgcggggaatgttgcgtcgatctccttgctttgcccggctcgcgaggcgacttgcgccacggaaatcgcccacggggaatcttcgatacgtgccatgttcagccttccattcagctttccggatagtcgtttgcgtcaagatgcggcacatgcgtgctcgcttcgcgctggcgatcatacagtacgttcaatcccgcctgcacgtcgttgccaagcttgccgagctgctgttgcagcgtttccatcaccgtggtgcagtatttgtcagctccctgcgtgagatggtcggccctggcttgcgcttggtcgagaatagcacgcgccttctgccgagccagttcggtcacgttttcctgcccggcgaggaattgcgcctgctcgttggcctcacgtatcgtgtctgccgcacgcgattgcgccgaagcgacgatggcgttggcttgcgtttgcgcgctttccaaacgtcgttccgactcacgcatcaacgccgaggcgcgttccagctgcaccggcatcattttcttcaactggtcgagctgttcggtgaattcgtcgcggtcgacgcgcacgctgccggggaagaacagtatcggtttcgcttcgtccaatgccgattcgagtttgtcgataatgtcgtacacggtggtgaattcgtcgcggctcaaatcgttggaatcgtccagcggcgcgttgggattgaacgtgttgcgtaaatccggcagatcagacatggaaatcaacggtttgaccggctcggcggcgcgtgccgtggcttgtgccttctgaccggattgggccgcccgatcggtcgggcgttcggcggtcacgtcgtcgtcaaactggctgccggccggatcgtacgcattcgtttcttcacccatcatgccctcttttcattattgagcgcttctccgagtagcggaatcacgcaatcgggcaccatgccggtcacatcgccgccgtgacgtgccacatctttcacgatcgaactggagatatgttccaaatcgggcgccgccggcaaaaacagcgtttccacgtcggcaagcttgcgattgaccagcgccatacccaactcggcttcataatcgccattctgccgaagccccttcacgataaccgtcgcaccgaccttcttgcaatagtcggtaatcagtccggttgttgaagcaaccttgatattgcggcaattccgctcttcaagcgccttacggataatctcaacgcgggtctcttcggaaaacatcggtgttttcgccgcgttcaccgccactacgacatgcacttcatcgaaaaaacgcgcgcaacgttcgatgacgtccaaatgtccggcggtcactgggtcgtacgacccggggcaaactgcaattgtcatagcctcaagcgtaccgcgattgcgtgaaattacgcgaagtgtcggcgaatatgtgggttttcatggctatgatggaggcagtggtgccgcggttgcggcgtatttgaggagttgattatggcatgttcgatattcgatgatcgcgacggcttcattgacgaggccgacccggtctcgccgctttccaatcccgacgcgggtactggcactgcggtgctggaacgccccgaagaggagacgaagctggatgatggcggcaacggcgatgcggatcgtttcgcgcattatgtgtcgcgcgatcgcattgccgagtcccgtcgcaccggccgaccggtggtggcgttgtgcggcaaggtgtgggtgccgaagcgtgatccttcgcagttcccggtatgtccggattgcaagcgtatctacgacgaaatgatgaattccaatttctaatcgttttttatctctttcatcgtatggtgatcttggaatttcgttgaaatttctgaagattgccgaaagtgattacatataaaaaatctgccgagacaatctcaatcatcgaaaaataatttcgatatagagaccatctcggcagattttttattgttgttgcgtcttatatctgctgatatatccgcgtttagcgcaacgaaatttcgtcgatgcgacgcaattcctcatcgctgaacgtggtgttcttcaacgcgccgatattgtcgagcagctgctgcgggcgggaagcgccgacaagtacggaggtcacgtaaccgtcgtgcagcagccaggcgagcgccatttcggcaagcgtctgcccgcgttcggcggcaagatcgttcaggtcgcggatctgctgcaggcgttccggcgtcaacgcgctttctttgaggaagcggccgtcgtgtgcgatgcggctgtctgcgggcacgccgttgagatagcggttcgtgagcagaccctgttcgagcggcgagaacgtgataagacctttgccaagctttttggcggttttcttcaatccgttgcgttccacggtgcggtcgaaaatgctgtaacggttctggttgatgatgaacggcacatgcagctcatcgaggatcgcggtggccttttccagcgtcggaccatcgtaattgctcaggcccacgtagagtgccttgccgctttgcacggcggttgccaacgcgcccatggtttcttcgagcggcgtggaggaatccatgtggtgatggtagaaaatgtcgacatagtcgagaccgaggcgttcgaggctttggtcgagcgaggcgagtagatatttgcggctgccgagatcaccgtaggggccgagccacatttcgtagccggctttggtgctgatgatcagttcgtcgcgatgatgatggaaatattcgcgcagcagacggccgcagttcttttccgcactgcccggctcgggaccgtaattgttggcgagatcgaaatgtgtgatgccgttgtcgaatgcggtgaacacgatgtcacgcatagtggcgtacggcgtgatatcgccgaaattatgccaaaagccgagcgaaaccgctggaagtttcaggccgctctcgcccacatgattgtaggtcatggaatcgtatcgagcgggtgacggcgtgtagacggtggtcggttcaagcatggttcctccttgaaaactctgcgtattccgctgtgcgctgtgttgcttgagttggcgcatgtcgtaagtttgtcgacgatactatcgtcgcacttcaagtaaacttgaatgcaagtatcgtcgatagtgtgttttccgatgattgacaatcgcaaggaatcgcaaaatcgctagaaaaacctagaaaatcgtagaaatgagaaggggaatggcaacatatacgattcgtgaagtcgcgcaacgattccatgtgcagacgtcaaccttgcgctattacgaggatcaggggctgctgtgcgacgtggagcgcgacgatgcggggcgacgcgtgtacaccgactcgcatatcgggcggctcgaggcgatcgcctgcttcaaacatgcgggcatgagcatcgatgaactcaaacgcttcttcgcatacgaaaaagacgagcgtgcgcacattgcggacatgctggaattgttggaatcgcggcatcaagcgattttgaaacagcgggccgcgctggaagaggcgtacatgcatgtgttgcgcaaactgcacttgtatcgcgatattcagcacagcatcgaaacgggggcgccatacccggattgggcgaattatgatggcaaggattttcgcgccgacgatcggtgaagttcggtggactgacgaagatcagtgaagactggttggcgaagggcggtgacgcccagttggcgaaaaagcggaaaataaaaggtgtggaaccgcaaactacagttccacacctttagaacacctagcagaacgtctaatagagactgctgcgactcgtttcagccctacttcagcagagtggccacggatggcagcagggcgcgcaacgccttgccgcgatgggagatggcgttcttttcggccggttccatctgcgcggacgtgagcttctcgccggcttcgacggcacgcgccggctgatcgtcgggcacgaacagcgggtcgtagccgaagccatgctcgccatgaggctcatgcagcagcacgcccggcatttcgccggtttccacgatttcctgagcgatcgcataacgaccatcggcgcctgcgcctgcttcggtttgcggcaccaccagcgcggccgcgcaacggaaacgcgcggtacgcttggcatccggaatgtcggcgatctgcgcgagcagcagcgcgttgttggctttgtcatcgccatgcttgcccgcccaacgtgcggaaagaatgccgggggcattgcccatcacgtccacaatcagaccggaatcgtcggcgattgccgggcagcccgtacgtgcggccacatcacgggccttgagcagcgcgttctcttggaaggtcacgccatcttccaccggatccggcagattcagcgaaccggccgacaccagctccacctgatctgcgtccgcccccaggcaatcttccagaatgcggttgatttcaacgagtttgccctcgttatgcgttgcgacgatgattctcacgttccgattcctttcgttgctgttcgttgcttcgttgatgtcggcttgcctgacgtgcgtttgacgtgccctgacttgcctaacctacgattggtttgcgaggccagcctgcggtcggcttacgtccgacttgcagccttcagtcctgtgcgagcgcggactgctgtgcggcctgcagttccttgttgcccttttccgccaggtcaagcagcgcgttcaactcggcgcggttgaacgggcggtgttcggcagtgccctgaatttcaatgaattcgccggaaccggtcatggccacgttcatgtcggtcatggccttgctgtcttcgatgtacggcaggtcaagcatcggtgtgccatcgatcacgcctacggacacggcggaaacgctgtctttgatcacgcgctcggcggacctgatgtgcttgtgcttctcggcccagcgcatggcgtccacgagcgccacatatgcgccggtgatcgacgctgttcgggtgccgccgtcggcctgcagcacgtcgcagtcgatctgcacctggttttcgccgagtgccttcatgtcgaccacgccacgcaggcagcgaccgatcagtcggctgatttcgtgcgtgcgtccgccgatcttgccgcgcacggattcacgatcggtgcggtctgcagtggctcgcggcagcatcgcatattccgcggtgacccagcccaagccggagtccttgcgccaacgtggcacgcctgcggtgaacgtggccgtgcacatcactcgcgtattgccgcattccacaagcacggatccttccggaacatccgtgaaatgacgggtgatgcgcaccggacgcagctcatccaccttgcgtccgtccgtacgaatcatcgtttcgcccaacaagtctttaatcgctaccatcgctgacttctctgctttcgattgatcacacgatcaacaatcgtttgtattttccgaaaaaacagtatcaccagccgaaaacccgtctttccgtcttgaactcgcctcttgctgcacctcaatttgcctatcccaatttgcgtcgtgcccgaatttgcgcgcatctcacgtttgtctcacgtaatacaggcatgcaagcacgtatgatggaacgaaaacctgtgcttggccacggcgaggcctacacttatggtcagtttcaccaaaagtcagaaaggctttggaaatgctggattattcacctgcactcatgaccgacatgtacgaatacaccatgcttgacgcgtgcctgagggacggcaccgccaatcgcaagtgcgtattcgagattttcacccgtcatctgccgcttggccgccactatggggtggccgccggccaaggtcgtattcttgacgcgcttgaaaatttccatcttgacgataatgatctgaaattccttgcagatcgcaaagtagtgggccccgaaactatcaaatggcttgagaatttccatttttccggttcgatcaagggctatcgcgaaggtgagatgttcttcccgaattcgccgattctgcaagtcgaaggcacgttcggcgagtgcacgctgctggaaacgctgttgctgagcattctgaattacgattccgcggtcgcgtcggccgcgtcccgcatggtcagcgccgcgaaggatcgcccgtgcatggatatgggcgggcgccgtacgaacgagtgggccgccgttgccgctgcccgtgctgcggtagtgggcggattcaagggcacggccaatctgctggccgcgcaaatgtatggcttgaatgccatcggcacggccgcgcactgcttcacgctggtgcatgatgatgagcgcagcgcgtttgaatcgcagattgccgcgctcggcaagaacaccacactgttggttgacacgtacaacattgaagaggccgtgaagacagctgttgaagtggccggaccagaattgggcggcgtgcgcatcgattccggcgatctggcgtcgttggcgcagcgcgtgcgcaaccagctggatgcgttgggcgctaccaacacgaagatcaccgttaccaacgatttggacgagtatgcgctcgcttcgctgcagaccgcgccggtcgattcgtatggcgtgggcaccatgctcgtcaccggatcgggcgctccgacctgtgcgatggtgtacaagctgactgaacgcgagaattccgctggtgacatgcagccggtggccaagaagtcgaaggacaaggccacggttccgggccgcaagctcgccttccgctcgtacgagtattcgctggccgactgcgaacatgtgatttccggctccgaagagcagctggccgcctatcagccggaagaaggctggaaggatctgctggtcggctacgtgagcaacggcgaaatcaactccgattatcagggacacgaagccatcgtcaacgcgcataattaccgcgcccaggcgctggccgaactgccgatcggcgcgcaaagcctcatgaagggcgacccggtaatccctaccgaaatcaccgtcctttgactcgtgctaccatcatgctggttgcgtacggcaatcaatctcgtaatcaaccagcatgaaggggtaggattacatgcgagcattttctctggttacgttgagtccggaggcgtttgacgatttttccgcacatcacgcggacggcaacttccaacagacctctgccgcaggccgtctgcgtgccggccaagggatcgaagtggaataccttggcgttcaagaaaacggcacaatcgttgcgggagcgctgttcgaaacgcatcgcagccgcctttccaccttcagtgtggtgcacgacggccccttgtgtgactatcgcgatcgcgaattgaccgaatatttcatgacccaactcaagcagcacgcgaaggcgaaaggttccgcacagatggaaatcgtgccggaaatgccatactgcctgcatgactcgcgtggcggcgaactgccagccgaccaaggtggcgctcctgctgatgatgccgtggaaacgttgaaaaacctcggcttcatgcatgacggcttcaccatcggctacactgcggtgccgcgctggcgttacctgaaagacctgactggcattaccgacgaaaagtcactgctcaagtcgtatgacaagcgcacgcagtggagcgtgaaacgtgccgcatccatgggcgtgcatgtgcgcgagctaggcgaagacgagctgcaggtgtttgccgacatcgagcaggccaccgccgaacgccgtaatttcgaatatcgcggtgaagcctacttccgcaagttcaagcaagcctatggcagcaaagcccacttcatggtggcgcagattcacatcggcgaatacattgccgacatggaatccaagcgcgatgtcttgcggaagaaggtcgatacgctgcagaccaaatacgatgagcatccgaccaccaaaacggaacgccagttaggggaagagtcccgcaaccttgaggcggcggaaaagcgtttggctgaagcggccgagtatgccaaagacggtgacgtgcttccggcggcagcatccctattcgtggaacacgctcgtgaaacggtgtatctgttctcaggcagtgtggaaaagtacaagccgttctacgcttccgcgctcattcagcatgatgccatgctgcatctgtgtgtggaacgtggcgtgacccgctacaacttctacggcatcaacggcgtgttcgacgatccggaagatgagggtcgtggcgtactcgaattcaagcaaggcttcaacgggtacgtcgaggaactcatgggctcattcgtgcttcccgtacgtccgctgaccttcaaactcaagaccgccctccgcaaactcctgcgccactagctattagctcaccttccgcttggaggattctgggtgggggcttataggtgcgcgagggttatgtgaacgctgttgacggcgactgtaggccggactaggttatcgcttttggtgaaaagggattttagccagttgggatagtgaaaggtagttacggatcgtgatgcgcgaagtgaatgcgagtgaggaacaagagcaagaatcgtctgaatggaatgtgcgcgagctgagcggtagtgagtttgatgagctttccgccgcgagcagatacggcggattccagcagacttccgaaatggcggcattggctcagtccgacggcatgcaaacgcaatacgttggactggtggattcgcacgatgctccggtggctggcgcgttggtggctttttcgcaagggcgtttcggcgtggaaggctcgttatggcttggcccgttgtgcaatgggaataacagagagcagatgaccgcgttgaccgaaggtttgcgcgaggctgccgaacgggttcacgccatcagcctgacgtgctggcccaaccaggtgtattgcgttcgtgattcgcaaggcaaggccatggccgaacccaatgatgagatggtgcgggagtacgagcggctgggttggaagcatgctggctttacccgtggatacgatgccctgatgaaccgttggaattacgtcaaggacttgagagagttctcgaacgccggcgagctgctcgcttcgtatgcgaagaacacgcgtcgtaacgtcaagatcgcgcggaacagcggcgtggaggttcgacgcctgaatcgcagtgagctgaacgtgttccacgatatttgcgagctgagtagcgaacgccagcatttcgccaaccgtagccttgattacttcgaacgcgtatatgatgcgtttggagacaaggccgagttcatggtggcggaagtgcatcttgaccgctatttgcaatcctgggaggaaaagctggcgaagttctcgaaagacgtggaacgcttggagcgttcgcttgagcatacgaagtacccggatgatgtgcgcaagaagctcgatacggctcagaagaacgtggagtccgcacgtcgccgcattgaggatgcgaacgagcgcatcgcccgtgatggcgaggtggtgccggtcgccgtaggtctgttcatgtggcatgaacgcgagctggtgtatttctccagcggatccgacgatcgttacgccaagttctacgcgcccaccgccttacagcatgagatgatgtcgcgttgcttggaacgcggagtgacgcggtacaacttctatggcatttcgggagtgttcgacgatccggaagacgatggacgcggcgtgctcgagttcaagcagggcttcaacggctacgttgaggaactgccgggcgaattcacgcttccggtgagcaagctgcgctacggcgtgagcgatttggcccacaaactcctgcgccactagttttaggggggtttcagccatgcttggcgcgacgcggatttgcgtggggtgagactttctggtacgctttatgtcttgtgcgcggatggcgtgtgcttccgggcattgccactttagctcagtcggtagagcggctcactcgtaatgagcaggtcgacagttcgattctgtcaagtggctccaacgccctagatgtgaaagcatctagggtttcgcgtatcaggagcgtttcgccccgatatggctacttgcgcgagtggcggaattggtagacgcgcaggatttaggttcctgtgtctttgacgtgtgggttcaagtcccatctcgcgcactttcagaaaacggcggaattccgccagttcttggtcattgtagtccactcaataagcctttttgagaacatgttgaaaacattttgcccgtttgcgtcccaattcttccactgactggaggatttgggacgttggggagcttgtttgcgggtggattcttccagtaggtggaggatttgggacgttggggagctcgtttgcgggtggattcttccactgactggataatttgagacggtggcaggcttatttgcgggtgaattcttccagcgggtggaggaattgggacgctgaggggcgcgtgagcggagtgtttcttccagtgggtggaagaaacaggacggtgatgggtggcttggtggcaggggatgctcctaagatggcttcgggtaggaagagaaagagatgattagggattaggggagtgtcgtgtctgcgctgattcagcctgttgcgctactgctgattattctcgccgggtacttgttcaaacgtgccggcctgttcgaagatcgcgattaccgcattatgcagaccattattttcaatctggtgctgccaggcgcgatcgtctattcgtttgctacgaatccgcatgattccagcatgctgttgatttcgctgttcggcctgattgttgcgttcattccgccggtcgtggttttcttgacgtcccgccaccgaccggtgcagaaccgtgcgttcatgatgttgaatggttccggcttcaacgttggctgcttctgtttcccggtggtgcaggcgtttcttggcacgggcgcgatcgtgcccgccgccatgttcgacattggcaattgcgtaatggttgccgccggtacgaatgtgatgacgcaaacgctgctgcacatcaagcctggcatgccgcttaccgaacagtatcagggcaatgcgcccacgctcccgtatgtgaagccgaaagacaaggatgccaaacgtcttgcccgcaaggcgttggcccgcaacgtgttcaagggtttcttcggttcggttccgttcgacacgtacttggtgatgattattctcacgctcgctaacgtgaagattcctgacattattgccgcgctcgtgcagccgctttcgaacgcgaattcgttctgcgcaatgctgatggtgggcatgcttatggatttgccatctgacaagcaggatgtgcttcagttgttgaaggtgattggctggcgactgccgtttggtattgcgtttgctactgcggcttggctgctgctgccgtttggcgctgagattcgtgaggcggctgcaatgtgttgtttggcgccgattgcagtgttttccacgctgtttaccgacaaggtgcttggtaatgcgaagcttgctggttttacgctgtcgattactgcgattatcagtttgctgctgatgaccggcgctcacttcttgttcgtcgcgctcgcataagagcggcagggagatctttaccgggtgcgggagattgtttgtgaccccgcagagcacgaagtcgttgaatgcttgcttgctggtagttgcagtgccgttttcttgtcgttcactgcataatgcgatcgtttcgtttattacatgtttggaagtgttacgaagacttgcgccggaaccatgcatacgatttcagtaatcgtcgaaaatgcgcatgtcgaagacggaaggttgtcggaaccgcgctatattgcgaatcttggcgaatgtgttaactcaggaaatatttttgtgttgttctgtcttcttttgtgagtatcttgtgaggtgaagagatacggaatgcgacacgcggaaatccgcagagaagccgcaatcgcatccgcttcatagtgatgatgaaaggacctatacaccatggccatcaatcctcctgttgacgccaccaagaccccggagtgggccgcactgcagaagcactacgatgagctgcagtccgaaggcatcagcctcaagcagtggttcgccgatgacgccgagcgcgtcgagaagctgagcttcgacgcgggcgacctgcacttcgacctgtccaagaacctgatcaagccggaaaccctgcagctgttcgcagacctcgccaaggccgtcaagctcgacgagcgcaccaaggccatgtacaccggcgtgcacatcaacaacaccgaagaccgcgccgtgctgcacaccgcactgcgccgcccggccgaagacgaaggcaagtacatcgttgacggacaggacaccgtcaaggacgtgcgcgaagtgctcggccgcatctacgcattcgccgacaaggttcgctccggcgaatggaccggcgtttccggcaagaagatcgaaaccgtcgtcaacatcggcatcggcggttccgacctgggtcccgtcatggtgtacgaagcgctgaagccgtacgctgacgcaggcatctccgcacgctacatctccaacatcgacccgaacgatctggccgaaaagaccaagggcctcgacccggagaccaccctgttcatcgtcgtttccaagaccttcaccaccctggaaaccctgaccaacgctcgcgaagcccgcacctggctgctcgacgccctcaaggccgccggcgcagtcgacggctccgacgagaagaacgccgaagccatcaagaagcacttcgtcgccgtctccaccaacctggagaaggtcgctgagttcggcatcgacccggccaacgccttcggcttctggaactgggttggcggccgctactccgtggacgcagccgtcggcacctccctcgccgtggtgttcggaccggaacgtttcgaagagttcctgcacggcttccatgagatcgacgaatacttcgtcaacaccccgttcgagaagaacgtggtcgtgctgctcggcatgctgaacgtgtggtaccgcaacttcttcaaggtcgcatcccacgccgtgctgccgtacgaccagtacctgcaccgcttcccggcctacctgcagcagctgaccatggaatccaacggcaagtccgtgcgttgggacggcaccccggtcacctccgaaaccggcgaaatcttctggggcgagccgggcaccaacggccagcacgccttctaccagctgatccatcagggcacccagctgatcccggccgacttcatcgcgttcgtgaacaccccgaacccgaccaaggacggcgaccaggacgtgcacgagctgttcctcggcaactacttcgcacagaccaaggctctcgccttcggcaagaccgctgacgaagtgcgtgcagagggcactccggaagagatcgttccggcccgcgtgttcaccggcaaccgcccgaccacctccatcttcggcgtggcactgaccccgttcgcactcggcgagcttatcgccctgtacgagcacatcaccttcgttgaaggcaccgtgtggggtctggactcctacgatcagtggggcgtcgaactgggcaagcagctcgccaagcagatcaccccggccatctcccaggatgacgaagcactggccgctcaggacgcttccactcagtccctgatccagttctaccgcgcaaatcgcaagttctgatttctctaaggattaaatagccttcgaaagggctctgcacgggatgcagagccctttttgctacccctggccatcttcaaaaggtctggcgggtgaggtatttttgaatattgctgtgccgggattcaggacgccgcataatcctgattcccttcgggtccagccgagaacaatcgcaagattgaacggaatgttgcacaaacgcaagttaccgtgattttcggcggattggcaatccttcgcaggcagacctgcggagaacatacgaggcagaacgaaattgaaaaatcgtgaagcccttacctgtgcgctgatatgcggcggcgactcgaggaaacacaatggttaacgctattgaggcatttgacgccaagcacatgaagccggccgaggaaatcccggcattccgtccgggtgacaccgttgaagtcaacgtgaagatccaggaaggcaacaactcccgtatccaggccttcaccggcgttgtgatcgctcgtcagggcggcggcgtccgtgagaccttcgttgttcgtaagatcagcttcggcaccggtgtggagcgtcgcttcccgctgcactccccggtcatcgactccatcaaggtggtccgcaagggccgtgtgcgtcgcgccaagctgtactacctgcgcaacctgcgcggtaaggccgctcgtatcgttgagcgccgcgacaactccgagaagtgagtttcaaacgcaaataaagcgtgaaattggccctcagcctcacggcaggagggcctttttctattctagaccgctatgataggggtcagtgtgcaaaccggacgataaaggaatcatgtatgaggcatgccaaagaagaaaacaatagcggcgacagctttggcttgcgcgacaccttggtctggtgcggaattcctattattatcgtgctgctgatacgcattttcctgctcggattctacgtgattccctccgggtccatgatgaacaccatcgaaccaggtgaccgcgtgatcacctcgaaactcaccccgaaagtcttcgatctgaaacgcggcgacgtggtggtgttcaaggatcccgaccactggctgcggcaggaagacagcagcaaactcggcggtgactacctcatcaaacggctcattggattgccaggagacaccgtggcatgcgaagggccaggtaagccgatcaccatcaatggtgtggcgattgacgaaagcgcatacattcgccccgacgtggatcccagctcattcgcgttcaacgtgaccgtgaccgaaggacacgtgttcgttatgggcgacaatcgcgccaattccgccgattcgcgctatcatcagggtgattcctcacatggacttgtgcctatttccgacgtagtgggtgtcggactcgcgaaatattggccgttgaaccgcatcggcgggctcgatgcgcaccatgaagtgtttgccgacgttccggaaggaggctcggcggcctgatggcggtttccgtaattcccacattggatttggaacgtgctattgccgaacaaggctacgatgtgatcgtcggctttgacgaagtggggcgtggatctctcgcagggccggtaatggttggtgcggctgcgatttgggcgcgtgacttagacgggccggctggagcttcgcaaggaggctcgcaagaatcttcgcatctggaagtgccgaaaggcgtggccgactccaaaatgctgaccgaacacaagcgcgaagccatcttcgacgaactcaaatcctggtgcgcatcttgggcggttggcgccgccagcaacaaggagattgacgagtggggcatttcccatgcactcggcgtagccgcgttacgtgcgttggcacaggcggaggcgaagctcggcattgacggcaacggcatgctctccggcaaaccggtgaaggtcggcgcgatcctcgacggaccgaacgattacatcaccaagacgctgaacaccttcgacgcgcccgaagtgccggtgccggcgaacgttaccaccaaagtgaaaggcgaccggtattgcgtcgccgtggccgctgccgcggtcatcgccaaagtcacccgggatcggctcatggtcgaactgggagcgcaaccccaatatgaaccatatgaatgggcccacaacaagggttacggttcggccgcacaccgtgacgccatcgctgaattcgggcccagcgacctgcaccgcctgtcctggcacctcgtctgacatacggcatctcatccgcagtccgcgattacgctaatccttgcggatgatgcatgccggaaggaaacctgtaagttcatcccgccgtctgatggccggggccaatccgtttccgtaccgtaggaaacatggaacacatacttcaggcgaccgatctggtcatggattattcgacccaacaggcgacaccaaacgccacacacatgctggcgctcaatcacgtggatttcggcatccaggcaggcgaaagcatcgcggtcatgggaccgtccggttccggcaaatcgacgttactgcacgcactcgccggcatcatcaccccgacagccggcaatgtgatgtttcgcggtgccaacctagcgcggttgagcgacgctgaccgcaccaaactgcgccgcagcgccttcggcttcgtcttccaatccggacaactgctgccggaactgccggccatcgaaaacatcgcgttgccgatgatgctgggcggcgcaagctaccagcaggccaccgacatggccatgctatggctggaacgattgggattgcgccagctcgcgcaacaacgtcccggcgaaatgagcggcggccagatgcagcgcatcgccatcgcacgtgcgctcgccgcgcagccggcagtcatcttcgccgatgaaccgaccggcgcgctcgaccagaccaccggccacgaaatcatgagcattctcatgcggaccgcacgacagaccggcgcggccgtggtcgtggtgacgcacgattcgaacgtggccgcattttgcgatgccaccgttaccatgcgtgatggcaggttgagctcgccgcagcaatcccaacctaccgccggaggcgcacgatgaacatgttccgattatggcgattgttccaccgctccggcacccgcggcacatccggccgcacctctgcgctggccatcgttgccttcgcatccgccaccgccgtcttcctaaccgtgctcggaggcctgcatggcttcatctggcgggcctccgccgaccacacgttcggttgcatgatcgattccaacaggtgcgctcccggtacatacgaaacatggtccaaagccctggcgcacgccgacaagctcgtcgccacggtcggcgacggccattggacggccgaccaggccacagccgtcatgaacacctattccgacggctatgtgatgctcgccgcattcgccagtctgctactcatcgtgccgttcgtggcgctcgccggctcggcggcccgtctcgcggcctcccgcagggacgcacgtctcgccgcactgcgacttgcgggcgccaccaccgcgcaggtcacgaaactcaccgcgctcgatgcgggtggccaggctctgcttggcgcgctggtcggcatggccggctacttcgcgctgataccagcgatcatgctgctcgacttccaaaaccagcatttcaccttcgaacagttgtgggtgggactgcctgccctggcggctgtgaccgtcggagtcacgctgcttgccttggtctccgcgctggccgccctacgccgcgtggccttcaccccgcttggcgtgacgcaacgtaccggacaacccatgccgtccgcatggcgcgcactgattttccttgccgtgttggccgtaggctacctgctgctcaacagcatctccgcattcgcgcacttgggtcagatggtggtctatgccatcatcttcggcgtcttcttcctcggcttcgccatggtgaacgtcgtcggtacctgggtggtggcgatgcgcgccagatcgcgtgcgaaacacccgaaggacgcggccactatgattgccatgcgccgtatcctcgacaatcccaagcgtgcttggcgcaacgtgtccggcgtggcgctcgctgtgttcatcgcggggatgacgtcggtgtgcggattgctcgccaccggaatcggaggcaaccacgacccgttcgacccatctgtgctgtacatgcgcgatatagcgatgggtggtttcctgacgctcgcctttgccgcggtgctcgccgccgtcagttccggcgtgatgcagacgagcaacgtctacgaccaggccgacgagtaccgcatgcttgcgttggaaggcacggatgaggcgacgctcgacaaggcacgcatgatggaagtgatcaccccgctcaacacggtgatggccgtttcattagggtgctcggtgttgttgctgtttccgattctggcaacgtcgttgctcaatccggcttcgttgcttacgttggccgcgggaatcggcttgtgttatgcgctgatggtgctcggagggtgtgccgcgaatcatgcggcgcacgggctcggtcatgccggctaccgtacggacgattgatggtctcgccgcggcggtcgtggataccgcggcgaggactggcgaggtcagccgagcagcaccgcgatgattgcgatgaagatcggtgaggtcagtgtcgagaagagaatgccgtcgcgtgcgaacgagagacccacgttgtaccgcgccgcgtagttgtagacgttctgcccggtcggcagggcggcgagcaccacgcacgcgtacaatgtggcgccgcggaagcccatcacgaaatacgacagcaggaacgcgataattggcatcacgatgttcttcaataccgccaccgtgaacaccgcgggaatattcgacttgtcctgcagcggcttcgtgccgtgcaacgacatgccgaatgccatcaaaatcattggcactgcggaatcgccgatcatgtcgatcggatcgtaaatacagtccggcaccacgaaatgaccggtttttgcggaaatcgcggatacggcgatgcccagcagcgaaccgataagcagcggctgatgcagcggctgcttcagaatctccctcgtggagaccttgcctttggtggtcacatcgagcacggtcaggccgatcggtgtgaacaccgcctgttgcatgaccagaatcggcgcgaccaaagcgggattgcccagaatgtacgtggcgatcggcagaccgatgttgttggagttcagatacagcgaattcaacgcgccgatggtggcatccgccgccttcagatggaagaacagcctattgaggatcagaaacaccaatccgaccagcacggccgagaagaacgccacaacaatggaggagtggaatatctcgaagattctctccttggccaggatggcaaacatcaggcacgggctcgatacgaaaaagctgaacctgttgagcaccatctgcgcggtaggtccgcctatgcgcatgcgcgcggccacgtaaccggtgccgatgacgatgccaatgacgcagaagccttccaatgcgcttaacagaccaggcatgacactcttcctttcgctctcggccgttggtttggccgctatccagtgttgcaccatgcatatggataacatccgatccgtctcaaaagcgttgtcgaacggcgatgtcggttccggtggtgctggataatgggcggtatgaacgaacttgagattggattttccgcttccgccaccaggcaggagcagctgaacgagctgatgacccagatcatgggaacctattccgtgagcgacgacgaagggccgttgaccgacgcggtcgaagcgtttttgaataaacagcagcatctgacagtgcgcaggcatggcgatacgctggtcgcatccacgaattttgggcgtgagcgtcgcgtgatcctcgccgggcatctcgacacggtgccggtgatcgacaatttcccgccgcgttggctggaaccgggcgatccgctgattcgcgaggatgttgccgccggccatgggcgggagcgcgtgatatgggggcgcggtgccaccgatatgaagggctccgacgcggtgatgatgtatttggcggctgcgttgacggatgcgaaatacgatctgacatacgtgttctacgaccacgaagaggttgccgccgaaaagaacggcctacgcaaggtggtcgaggcgcatcctgattggatttccggcgattttgcgattatcggggagccaaccgattgcggtattgaaggcggctgcaatggcacgatgcgtttcgacgtgatcacgcacggcattgcggcgcattcggcgcgagcgtggatgggcaagaacgccattcatgcggccgctgagattctgaaccggctgaacgcttatgaaaatcgtgcgattgaagtggatggcctgacgtatcaggaaggcctgaatgccacgctgatttcgggcggcaagggcacgaatgtgattcctgatgaatgccacgtgcatgtcaactaccgttttgcccccgacaagtcgttggctgaggcgaaggcgctgatgattggcgcggatgccggtgcggaattgggcaatggcgagcatgttgccacaggtggcgtattcgaaggcttcggcattgaaatgaaggacgagtcgccttccgcacgtccggggttgacgtcgccgctcgcgcagtcgctggtgaaattggtgcgcgagcgcacggggcgtgagcctctggccaagcttggctggacggatgtggcgcgattctcgatgctgggcattcccgcggtgaatctgggtgcgggcagtccgttgctggcgcacaagcatgacgagcagctgccggaatcggatctgctgctgatggccaacttgcttgaagactggctgaagtagctgtctgctgcctttttctgcctcctgtttctgcctgctatcggctgtttgttgttttccgtcttctgtctgcacaagtcggatcggctgtctgcacgagtcgtaatctgtgtctgcatttctcgcgaatcgtgatttctttcgacttgtgcagacggagcaacgacttgtgtagacggggcctgggatttgcgggcggggaaagcaggcggtgagttgcaggatccggaaaatttcccgtcatgtcacgttccgttgttttttgtgtcatacttatagacggtggttctgcaaatcaccaatgcatccgatggcgttgatcccctcgcgtgaagttcatgtgtgtccgcgagcgctggtgtccgccgtcgcatgatgaggacttttgacggaagttgcttcctacgggcgccatgatgcgcggccacggtgagagcgtggtgtgagaaccgtatgaggcctaagcgtgggcggcgcgattgcagcgtgtcgtcgaggagccattgtgcctaataccagtgagggcttcgatcaggtcgaagcttcggcatcgcctgagcatgccgtgaatgttgtgaaattcgagtcggtccagtccgatcctgccccgcgtcgccgtcgtggcggtcgtcgcgtggtgcgtggcgtgggagctgccggtgcgtccttggagttgaaggtcgaggagcatgcttcggctccgctgttcgaggagccgaagttgccggttgcgcaacctgcgcatgataccggtgattccgctgattccgagggtatgacccgtccgacccgtcgccgtcgtcgtccggtccagtccgatgatgatgttcgtgagattgccgacgaacggccgacgcgttctcgtcgccgtcgttcggtgcaggttgaggatgagcaggacgaggatcgtccgtcgcgtcgtcgcagccgtttcgccgatgatgcggatgagtacgatgagatgccgcgtcgtcgcgcttccgtcgatgattcccatgatgaggagtcgtctgtggagcgtgccttggatgccgtcgatatgttgccggaaggccatgaggtccgccacaatccgcgtccgatgatgtctctgcttttccaggagccggttttgccgtccgttgcggattcccgagacagggcagacgacgatcgcgacgattcccgtaatgaccgcggcgagcgtaatgatcgcaatgcgcaggaccatgacgatgagcaggatgaggatcgtccgtcacgtcgccgtcgccgccgcaatcgcgacgttgccgacgaagagcgttccgaagacaatcgcaatgaacgcgataatcgggataatcgcaatgatgatgcggacaatgatgaggaaggcggatctcgcaagtcgcgtcgttcccgtcgtttgaacgcgcaggagcgtcgtgccgcagctgaagtcgaacagatcgaagaggatttgatcctcgacgatattacgtatgcgccgattgatgacgaaacccgcaatcgtcatgacgatgatgacgacgagcagccgacgcgcacccgtcgtcgccgtcgcagccgcggcaatcgtgaggaagccgacgaacagcagcgggatagcgatgaaggcgagtcccgtcgtcgccgtgaggacgatgacgaggatgaaggcacggtgacccgtcgccgtcgtcgccgtcgtggcggtgcgaagacggatgagacggaagagccgctcgtgcgtcgttcccgcaagcagcagtacatcgacgagatcaccgacgtcgaaggttccacccgacttgaggccaagaagcagcgtcgccgtgacaatcgccgtgagcgcagccgtcaaagccagctcatggagcaggacttcctggctcgccgcgagcatgtcgaccgcctgatggtggtgcgcgaacgcgaacgccacacgcagatttccgtgatcgaagacaatgtgctcgtcgaacattacgtgtccgacattcaggaagtcgccactgtgggcaacatctatctgggccgcgtgcagaacgtgctgccgagcatggaagccgcgttcgtcgacattggtcaggcgcgtaacggcgtgctctatgcgggtgaggtgaactgggattccgcacggttggaaggccagcctcgtcgcatcgaactcgcgttcaagtcgggggacccggtgctcgtgcaggtcaccaaggatccgatcggacataagggtgcgcgactgacctcgcaggtcacccttgcgggccgtttcctggtgctcgtgccatccggtggcatgacgggcgtgagccgcaagctcagcgagcgtgaacgttcccgcctgaagaacatcgtgtcgaaggtcgcgccgaaagacatgggcgtgatcattcgtaccgcagcggaaggcgcctccgaagaggcgatcaccaaggatcttgaaagcctggtgcgccagtgggaacgcatcacctccaagcgagacgaattcctgcacggcaagcgtccgaagctgctgcaaggcgagccggacgtggcgatccgcgtggtgcgagacatcttcaacgacgacttctccaagatgatcgttgaaggtgaccgcgtgtacggccgtatcgaggaatacctcgacaccatggctcccgacttgaaggacaagctcgaaaagtgggatccggccgaacatgaaggcaaagacgtgttcgacaagtggcagatcgactcccagctgcgcaagggcatggaacgtcaggtctacctgccgtcgggcggctcgatcgtgatcgaccgcaccgaagccatgaccaccatcgacgtgaataccggccgtttcatcggccgcggcaagagtcttgaggagacggtgacccgctgcaacctcgaagcttccgaagagatcgcacgtcagctgcgcctgcgtgacatcggcggcatggtgatgatcgacttcgtcgacatggtcatgccagccaaccgtgatctggtgctgcgcagactggtggaatgcctggcccgcgaccgcaccaagcatcaggtggccgaagtcacttcgcttggcctggtgcagatgacgcgcaagcgcatcggacaggggctggtggaagccttttccgaggaatgcccgacctgcaagggccgcggattcattcttcacgacgagccgaccgtgtccgcggattatgacgatccgtacgccctgaagggcggcgacccgttcgtcaagaccaacaagcatggtcacggcacggacgtgcaggtgccgaaaggctcctcgccggacgtgaaggccaaactcgcacagatcgcggcggctgccgtggccgccaacaatgcggaactgggcgaggaagcatagaagaataaatgattattccggtctgtcaacctgacacgccggaaacagacttgcggttgtacgcgggtatgtgtaaattagattgctggtgtctggccgcgaggctcgaacgtgccgggcagtaagctttccaagttaataaaggaacggatatgtacgcgattgtgaaggccggcggccatcaggaaaaggttgaggtcggtgacgtcatctacgtcaaccgtctcgaggctaagaagggcgaaaccgtggaattcccggttgctctcgttgtggacggctccaaggttgtcctcggtgccaaggatctcgccaacgtcagcgttaaggctgaggttgtcaacgatgaggccaagggtccgaagatcagcatcatgaagtataagaacaagaccggcgttgctcgtcgcaagggccatcgccagcagctgaccgctgtcaagatcacggctatcgcctgattggcgcagggttagagtcaaggaccgaaaggaacagacatggcacataagaagggcgcgtccagctcgcgcaacggtcgcgattcaaacgcgcaatacctcggtgtgaagaagttcggcggcgaagccgtcgtggccggcaacatcatcgttcgtcagcgtggcaccaagttccacccgggtgagaacgtcggcatgggcaaggaccacaccctgttcgccctcaaggacggcagcgtgaagttcggcgtgcgtcgtgaccgcaaggtcgtcgacgtgattgccgcctgaaatacgcgcaattaacgcttacaagataaagccgcgcccgttatggacgcggcttttctttattttgatgattgctgaggattggtttccttcagcccgtcccaaacgtcacgtaacgttgcatacagttgcataagacatatcaaacggacaataatcggaccgtttcgaacaaacgattaaggtagatacatgagtgatttcgtcgatcgcgtgaccgtccatgtgaagggcggcgacggcggcaacggttccgccggcatccgtagggaaaaatacaagccgttggcgggaccgaacggtggcaacggcggtgatggcggttccgtgatcttcatggccgaccagaacgccaacagcctgttggattaccgtttcatgccccaccgcgaggctggaagcggcaccatgggcttgggagacaccaaagacggttcgaaaggtgccgatctgatcctgcccgttcctgtgggcaccgtgattttcgaagccaaagggccgcaaggcaagcctaagcatccgggcgagcagctcgccgatcttcgccatgccggagacaagttcgtggtggcggccggcggcaacggcggtcttggcaacgccgcattggccaaccgcacccgtcgcgctccgggattcgcgttgcttggcgaaccaggcgaggaacgtgacgtcattctcgaactcaaatccatcgccgacgtggccttggtgggcttcccctccgcaggcaaatccagcctgatcgcagccatgagctccgccaagccgaaaatcgccgactatccgttcaccacgctcgtgccgaacctcggcgtggttatggccggagacatgcggtacaccatcgccgacgtgccgggcctgattccgggcgcatcccaaggcaagggcctcggccttgaattcctgcgccacatcgaacgcaccgaaatcatcgcccacgtcatcgactgtgccacgctggaacctgaccgtgatccgatgagcgactacaaggcgctcgaacatgagcttgccgaatatgccgacaagctggaactgccgttgggcgcaatcccaatccccgaacgcccccgaatcatcatcctcaacaaggtcgatatgccggaagccaaggaattggccgaattcgtcaaaccggaattcgaaaaactcggtctcaatgtgtatgtcatctccaccgcatcccacgaaggtttgaaggaactcaactgggcgttggcggccatggtcgccgacatgcgcaaggaagtcgccgaacgcgaacaggccgaagaagaagcgcgcgtggtcatcaagccgctcgaagagccgcgcaaccgccgtcgccgcaacgacgaaggcggcaccgtgcttgacttcaccgtggaacgcaaggaagccggcaacggcgacgtctggtacgaagtgctcggcaccaagccggaacgttgggtcatgcaaaccaacttcgacaacgacgaagcagtcggctacctggccgaccgcctcgccaaactcggtgtcgaagacgagctgcgcaacaagggagccaagcctggcgacgaagtacgcatcggcaagggcgcgcgagccgtggaattcgattgggatccgaccattgttgcgggcgcggaaatgctcgacggcgcccagcttggcgcacgaggcgtcgacctgcgactgcaggaacaggacggccgttcgcagcgccgcaccaacgcggaacgccgtcgccagtaccacgaaatgatggatgcgcgccaagccgtgcgtgaagccatgatggccgaacgcaaggccggacactgggccgatccttccgtggacgacgaccgccatgacgaaaccagcctcttcggacgcggtgaaaccaccgattccgaaaacgtggaacaatagaagcagcaaaacgcccgctgatgtgccgattggcatgtcggcgggttttcttttcggccattcgaacgcctggaggaaccatgaacacgccatcgcaagcccaagtgcgccgcgccatcgccgaagcgcaaaccatcgtggtgaaagtgggatccagctcgttgaccaaaccaagtggccacctcgatccggaacgactcaacgcgctcgtggcggccctcgcacgcgtgcgactcatgggcgggcgcgtggtgctcgtctcctccggcgccatcgcagccggattcggctccctcggcttcgactcacgcccaaccgacgtggctgaccagcaggcgtgcgcggccgtcggacaaggcctgctcatggcccagtacgagaacgctttctcacaatacggactgcgcgtcgggcaaatcctcatcaccgtgtccgacaccatcgcaccacagcaataccgcaacgtgcgacgcaccctcgaccggctgctcgacctcggcgcggtgccgatcatcaacgaaaacgattccctcgcgtccaacgaaatccgtttcggagacaacgaccgactctccgcattgatcgccaacatcgtagtcgccgacgctttggtgctcctcaccgacgtggacgcgctctacacggcacccccaagcgaacccggatcgcgacgcatcagctacgtgccgaacgtggaggacgcgctcgccaaagtgcaggtcggcggcaccggatcaaacgtgggtaccggcggcatggtcaccaaaatggaagcggcgcgtgttgcggcggtctccggcattcccgcagtgctcacctgcgcggcaaacgcaggcccggccatgatgggcgacccagtcggcaccgcattcgcccccatcaacgaccgtggatcatcacgccgcctatggatcgggttcgcagcacacccgcaaggcacgctcgtggccgatgccggcgcttccaatgcggtacgcggaggggccgccagcctgcttgccgccggcgtactcgaagtgcggggcgattttgccgccggagacgcggtgtggatcgacgatgaagcgggcaatcacctcgcaaaaggcctcgtaggattcgattccgaagaaatcccgcaaatgctcggccgcaataccgcccagctcaagcgtttcctcggcgaagaatacgcccaccccctagtccaccgcgacaacctcgtcttggtttaatccctttccctcttttgttcggtgccctgtaaatagcaatatgccgcccctaccggtcagcagggaaaaggaattccaaaatgtgctaaaaggctgttgtttttcgggcgggagggatagcatggcaaacatgactatggctgactggcagactctttccgaacgtattaaccgcgtggctccgagcgctactctggccgttgattccaaagcgaaagcgatgaaagctgaaggaatcgacgtcattggatttggtgcgggcgaaccgaactttccgactccggctgcgatcgtcgcggctgcggccgaagcggtgcaggatccgaagaactatcgttacactccgacggcaggtttgccggaattgcgcaaggcgatcgcagacaaaacgttgcgcgactcggggtatggagtcgatccgaatcaggtgatcgtaaccaatggcggcaagcaggccgtgtacgaatcctttcaaatcctgctcaatgatggcgacgaagtcatcattccgacgccgtattggacgagctatccggaagccgtgaaactggctggaggcgtgcctgtcgaagtgttcgcgggagctgaccgcaatttcgagccaagcttggaagacctggaagcggcacgtaccgaacgtacgaaggccatcatcgtgaatacgccgaacaatccgacgggtgccgtgtggaatccggaaaccgtcaaggcgatcggcgaatgggctgtggaacaccatgtgtgggtgatctccgacgaaatctacgagcatctgaactacgatggtgcaaaaaccacgtatatcggcgctgcagtgcctgaagtgcgtgatcagctgctggtgctcaacggcgtggccaaaacctacgctatgcccggctggcgtgtcggctggatgatcgctccgctcgacgtggcgaaggccgcatccaagctgcaggggcatatgacgtcgaacgtgaacaatatctcccagcgtgccgcgatcgcagccgtgtccggatctcttgacgccgtgtacgagatgcgtgaggcgttcgacaggcgccgtcagaccatcgtcgccgcgttgaacgatatcgaaggtgtgaactgcccgacgccgaccggcgcattctatgcgttcgccgacgtgagcgcactgctgaacaagccgctcggcaccagcaaaaccgcttatgcgagcacgtccgaactggctgcggcgctgcttgacgaaggtcatgtggcggccgttccaggcgaagcgttcggcgctcccggctacttgcgattctcgtacgcgcttgccgacgacgacctcgttgagggcatgaagcgtatgaagcagtgggtcgaggactgatactggcctgactgagacttttcacacgattcgcaccgcggtgacatgccgggtgcgaatctttttttcgttgaaaaatagcggttttgggacatttcttgaaaaaccggttggactaagtcgcaaatacccgctattatttcgacttggcggttttgccgcttacttcttgcgtggtttttcgcacaaaatcctcgccagcaagtagaaacggcagagtacacctagggaagtggcgcaattggtagcgcaacggtctccaaaaccgtaggttgtgggttcgagtcccgccttccctgccaagcttcttacaacaagctcagcggaggattattatggcgaaggcaaaaaatagcgaaaaggccgttaagccgaacatcttcatgcgtcttggcttgttcatcaaacagattatcgacgaactccgcaaggtcgtgaccccgaccagcaaagagctgttcttctgggcactcgccgtgttcatcttcgtgctgctcctgatggcactggtcaccggcatggacttcggtctgggcaagctgaccctgtggatcttcggctgatcaacgacttgaaggtgaaactgcatgactgacgaagtgttttccgacaacctcgacgaagctccagaagctgatctcgaggccgtagctgccgttgaggagctgcaggccgagggtgaaagcgttccggaagtcgctgaggccgagccgactgctgaagctgcttccgaagagtccgcggaggacgagggcggcgaagagctggatgctggcgccaaggccgtcgaagacttctccaacagcctgcgcaccctcgaaggcaagtggtacgtgctgcacacctactccggctatgagaagcgtgtgaagaccaacgttgaatcccgtgtggcaagcttcggcatggaagataagatcttccagattgaagttccgatggaagaagtcgaaaagcacaccgaaaagggcaagaaggtcatcacccgcgtgcgtgttcccggctatgtgctgattcgcatgcttccggatgagaacgcccgtcgtattgtgcgtgaaaccgaaggcgttaccggcttcgtcggtccgaccaaggaaccggcgccgctgagccgcaaggaagtcgtctccatgatggctccgatgatcgcttccgaagcgctcaagaaggctggtgacaagccggccgccaacaagaagcgcgtccttgaagtctcctacgccgttggcgatcaggtcaccgtcaccgacggtccgttcaccaccatggcagctgtcgtctccgacgttgagcccaccacccagaagctcacggtgctcgtgtccatcttcggtcgcgacacgccagtggagttgggcttcaaccaggtagaaaaactgtcctgataagtctttgaaagaccccgcgcattgcggggtctttttttgtctgggggagtgggcacaatgggaaagcttgtgtctggagggtttggcgtgcctgaatgagggtacggaatccgctagcacagcacagcaatatacgttgcggaaggaaccggacgcgggaaacctactccggtgccgctaccaccgcttctacagaaagaagaaccatacaatggctcctaagaagaaagtctcggcgcttctcaagctccagattcaggctggcaaggccaacccggccccgccgctgggcccggcactgggttcccatggcgtgaacatcatggacttctgcaagcagtacaacgctgccacgcaggacaagatgggccaggtcatccctgttgagatcaccgttttcgaagatcgttccttcaccttcattctgaagaccccgccggcggcagctctgctgaagaaggccgcgggcatccagaagggtaccgaaaacccgctgacccacaaggtcggctccgtcaccaaggctcaggtccgtgagatcgccgaaatcaagatggctgatctgtccgcacgcgacgtcgaagccggcatgaagatcatcgagggcaccgcccgctcgatgggtatcacggttaccgactgagaggagagggacaaatggtaaagcgttccaagaagtaccgcgaagcttctgagaagatcgatcgcaacaatctttacaccgctaacgaagccatcgctctcgtcaagagcatgccggagtacaagttcgatcagaccgttgaggccgtgctgcgcctgaacgtggatccgcgtaaggccgaccagctggtccgcggttccgtcaacctgccgaacggcaccggtaagaccgccaaggtcctcgtgttcgcccgtggcccgaaggccaccgaggctctcgaggctggcgccgacatcgtcggtgacgacgatctcgtgcagaaggtcgccgacggcttcctggacttcgattccgtggtggctaccccggacatgatgggcaaggtcggccgcctcggccgcgtgctcggtccgcgtggcctcatgccgaacccgaagaccggcaccgtgaccatggatgtcaccaaggccatcaaggacatcaagggcggcaaggtcgacttccgtgttgacaagaatggcaacctgagcttcctcatcggcaagctctccttcaccgagcaggctctcgacgagaacttcaaggctgttgccgacgaaatcaagcgtctgaagccgtccaccgtgaagggccgctacgtcaccaaggcgaccatcacctccacgatgaacccgggcgtcccggttgatccgacggtcatcgcctgagcaatatagcttgcagatagcttctatatagcttgcaaaagacccgcatcctgccccaacgcgagatgcgggtcttttcatatatatcttgcgattatctatctcatttaataaataatgatcctgcaatcgtctgactatcaaagaatctcaatgaaaccagatatcagatagatattaaaacagagaagtgatgttcaacgatcgcgcatacggccaatcgcaagcgccgtcgtcaacacgtatgcgtcacgcgggtcggtcgcatcccaaccggtcgtttccgcggcacgcttcaaacgataacgcaccgtattcggatgcacattcaattccttcgccgtgttttccaacgaactgccgttgcgcaaaaacgtggaaaccgtcacaaacgtcggatcgtcgggattctcgccatgaagcacctgatacacgttctgatacaactcttcacgagcgtaatcatcgcccaacagcgcccgttccggcagcaactcatcggcacgcaacgggcgggacggcgacgccaaagcgggagccgcctgcaaggaaaacagggtttcacgcaacacgtgcgaagcgccggcgacaccggaacgcaccggactcaaatacaccgattcgtcatctttgaaagcgggcataatcgacgtgcaggtcacttcggcagtggcggcgccactctgacagacaagcgccagcagaaaactgccgtatgtgccaacaatcacatgttctccgcccagatcgcgcaccgccttacgcgcaacgagcgaagccgaagcgggactcgtttccggtgtgccgccaatcgcgaaacaatcgaaatccccacgccaaccaagcacattcatcaacgaggcgacgcgatcatccgtaagagaagtcatcaggcattcgaaagcgagccgttcgatggttgaatcgtcggtgtgccctgccagaaggtcgagaatgtctgcctgatcggagttcataagcgtcaagtgtagccgcccaactggcgaatcgctgaacggaaagcgtcaacgaggtgaagttcattcggggagtgccgctattatgccgcttatgagcgaagtcaaacaaactggaaagcgtggcgagcgtatcggcacattcctcagctggatgctggccgtgctggcatgcctttgggtggcatggtgttgcgcgatcgggccgttgtattggttcggcgatgggctttccgacttcggctggctgaatgtgctgtatttggtggtcgctttcgcgatatggttttcgatagttgtcgcattggtcagattcggccgcggccgtcgcgtacttccgcaatatttcgcacgacggcatgaaaaactatgcaacgagattgcaggaacgccgaccaccgtgcttggcattatgttgcgacacttgcatgatgccgcgcacagccgcccagggcgcgccctgcatgcagtgatcgtatggacggggcgcaaactcatccgctgcaccgactgttggtggaaactcatgctggtgttcgtaatcggctggctgtggattccaaccacgctattggccgcgttcggcgccgacattcgctcgcagatccgtgaattcagctgggccttgaaccagtggacgggcttgaaacagccatatatcggcttcttctcgttcgtgcccatggatatttacccgaccgcgcattacatgtggccggacaatcccacatatctgaccgaccagcacaatgtcgtgctcaccgtgttctacggtgccgcagcggcggtttcgcgctacttcaccgactccaacgatgcgggcatcgtggtgctcgcagccttgcaatggctattcgccgcattctgctgttcggccaccgccaaccggttcttcaacctgccgtggcgcaggcttggcgtcggcacgttcgacttctcgcatccggaacgccacgattgctggaatatgcgcgattacgcgcatcctgaagcaggcgttgtggcacgcccctccagactgcgggccggtgcgaaaacacgattcatgatactgctgttcttcatggtgtgcccgcttgcggtattcgccacgatttccctgacgaaatcgccgctgttcgctttcgcattcgtatggtggttcggcgtgtggtacgaactgcacatgacacatatcaaagcgctgcccaccatcaacggcaagccgacgtacctacgcaaacgctcgatcatggccttcaccatctcaagctgcgtgatgctgatcagcgcgaaatacgcgtggtacatcattctcttcaccctgatcctggcacttatcaacgatcgcaaacgttggaaaacctatcttgtggcacttctgctgccaaccatcctcattcatggcggcatcgtgttcctcaccaacacgggcgccatcatcggcggcgaccccatcgaaagccgtggcatccaactgcagcagatcgcgcgcgtcgccaaatacaatccgaaaggcattccggcggacgcggcgaaaaagcttgaaccggtcttcaacctcgaccagatggccgaagcgtacttccggcaggacgccgacccggtgaaatcctccggcatccaatcgaagaaagtcagctacaagtggcgcaccgtcaccgaagacgacatgacaaacttcaacgaggcctggcttgaaatcgttgtcgcaaatcctgttatcgcgctcgacgcgtttttcgccgaatgcttcggctatttcgacgtgaccgacctgccatacgtgtcgatggactactacgtgaacaacgattacgtgcagaacgacaatgcgtggatccacctgtataaccacgattggcgcgatgcggtggccggcttcgcgaaaggttggggcaatattcccgtgatcggctgggtgacgcacggcaatctgtacgtaacgctgatgctgctggtcggcgctgccgaagtggtgttgcggcgatggcgctcgctgtcatggcatctgcccctgctgctgctcatgggcgtgatgatcaccgctccggccaacaatttcgaacggcatatgctaccggtcgcgttcgtattcggtttcgtatgcctgcaattctggcgcgagtcgcgtaatgcgcgatcggctgccagcgcgaacgtggccagtgcgcatgaggccagccaggtgcggcaggacgagtagcggctgcgttggctgctgcatgagctgttgcgttgcggcgacattgcgtcggcgcgccgcgctgtagtaggtaggaggtaatgatggcgattttggattcggctgcgatcatgccgcgtacatgcgttgcggcggatcaggtgcttgttttggatacggtgggatccaccaacacgtatgccgcggatttggtgcgtgcaggtcggctgttcggcatggatggcatggacggcattgcagggaacctcgtgtggagcgggcgtgagatcgtggttgtcgcggcgaacgagcagacggccggtcgcgggcggctcgaccatacgtgggccagtgtgccgggggagtcattcatcgtgtcgctggtggtgagcgtgccggttgcgattgtgcgcgattcgtccgtcaatggttggctgcagatgattgccggttgcgagatgcgtgaggcgattgttggtgcggtatgcgatttcggcggcacgctcgatgaagatgttttgctgaaatggccgaacgatatttttgctggcggcaagaaacttggtggcgtactcgctgaaatggtgccgattccggattgcggggatcgcgttgccattgtgatcggcgtcggtttgaatcttgccgtcgctcaggaacgattgccgatagataagtccacatcgttgcagttggttgcgcgcaatctgcctgatgcgatggtgttgcgcgatgcgattgccgtacgttgggtgcaaggattgcgctcgcggttggctgatttcgaagaggaccctcaccgtgaggctgtgcgcgcccgggaagcgatgaccccgatctgctggacgctcggcaagcagtgcgaggctcattttgtggacggaaccactttgcagggcagggctgtcgcgttaaacgacgacgcctccctgaccattgaggatcaggaaggcgtattgcatcgggtgagcacggccgacgtaggcgtgctcagtaagtaaaaaattacttgattgctgaaatttgccgcaatctcacttcagcttggcaagacctgcgaccacggcggaagcgataacggccttgaccgcatcgcctgcgacgaatcccatggaagccacggccacaatcggcagtgcgatgccggtaatggcggactgcacgatgaaaccaagcagatagtcaagcgcaatgcagccggcgacacaggcaaacaggtaacgtgcggcggtcagcgcgccatgcttcagcgaatcggtgcgcgcctcacccttcagcagcgacgtgacgatggccgccggcaggaagccgatcaggaagccggcgctcgggccaaccaatgccatggtggaagcgccgccggcgaacaccggcagaccgaccgcgccggctgccagatacatgagcatcgcggcgccggcctgcttccacggcagcatcagcgcggccagcatcaccacgaacgtctgtagcgtgatcggcaccggcgtgcccggaatcggcacggcaccggccgcggatgcggtccacatgagcacggcgaacagcgtcggcttgaggatggatccgacagtgccgctggtggcggttttcagcgtggttttgagtgtcagcattgcgttacgcacgataattctccttggatgtgattgcattacgttgatgaatcgacgattgttgacagccgaaatgatggccagcgcgaaagtgacgaaaatgcaaggtttgtcaacttatgcccccaatcgtaggcttgccaagtttcggtaacgtttgtggagccttacaaaaagattgcgtgtcttttgtgggaaacgagttcacgatttttcgttcgcgcgaccaaacttgacgttatgcctaaaaatgtcaacaaacttctggtggcgaatcgcggagaaatcgcgcttcgcgtagtgcgcaccgcccgtgagatggggattcccacggttgcggtgtacgcggagcaggatcgccatgcacaatacgtgcagatggctgacgacgcatatctgctttccggagacacgtataaagacacctatctcaacgaggatctgctgatcgacattctgcagcgcagcggtgccgacgcagtgcatccaggctacggattcctttccgaagtggccactttcgcgcagaaagtgatcgatgcgggtgcggcttgggttggtccgaatccgaaagccctcgtggatttgggggataagatcaccgcacgtcgtgtggccacgttcgccaaagttccgccggttcccggcatttcccagtcgatttccgacatgcgattgctactggatttcgcgcacacgcacggttatccgctcatgcttaagcgtaccgatggcggcggcggtcgcggcatcacgctcgtgcacaacgatgacgagctgcgcggtttctacatgaatcatgatgcgctgcagggcggtgatctgaacgaatatttcgtggaacgattcatcgacaaaggacgtcacgtcgaaacgcagtgcggccgcgactcgcacggcaacttcaccgtgtattccacgcgcgactgctccgtgcagcgccgcaatcagaagcttgtcgaagaggcgccggcaccgttcctttcctccgaggtgaccgaccagctggaaacctactctcgccgactgttcgaagccgtcgattacgaggggcttggcacctgcgaattcatggtgaccgaacagggcaaagtgtacttcctggaagtcaatccgcgtctgcaggtggagcataccgtcagcgaggaggtctgcggacttgacctggtgcgcgagcagctgaccatcgccaacggtggggaactgaccgtgaaccatccgcttcgtggacacagttttgaactgcgcctgacctgcgaggatccggcgaagaacctcgcgccaagctccggcacgctggcctcgttgcgctggccgtccggcccgggcatccgtgtggattccggcgtggtcgaaggcgacaccatttcgccgaaattcgattcgatgatgggcaaactcgtggtcaccgcatctgaccgagcggcagcagtggcccgcgtgcgccgcgccttgagcgagctgaaggtggaaggcgtgccgactccggcaagcttgttcgaacagattttcaacgacgacgaattcaccgccgaacacggtgttgcatacgatgtcagcaccaaatggctggaacgcaagtacctcaacaaggaagccgcatcatcgcaaggcgggcagccggcgtccatgtctggcgcttccgaggtcgacaagaaggaatccagcgaaaccttcgtcatcgaagtcaacaatcgcagagtgtcgctgaccgtgccgaacgacatcgtcgccaacctgacgggcggtgccaaagcgcgtgacgcgaaacgtgccatccagccgctgcgtgggcagggactgcatcatgcgcagaaaaaacagcaaagcaatgacggccaatccggtgtgatcgcaagcccgatgcaggccgtcgtgacgcgtatcaatgtggccgaaggccagcaggtggccaagggcgacctgctcgtcgtgctcgaatccatgaagatggaaaactacgtgtacgcgccggtcaaaggcactgtcaccaagattttcgtagggcccgcggcaggcgtggaagccggcgaaacgttgatgaccatcgacgtgaccggagcgaacggtacggaagccggcgaaaacggcgcaactggcgctgctgttgacggaaccgcaaccgacggaactatggaagggggtaagtgatgactgatatcatcgcaagcccggccgtcaaagaagccgtgaagatcgtaatggaacagcaggagcgactcggcaaaaacgcggccgaagccgtctccgcggccgacctgccgggcgcatcccagccaatccgcgcatccgtgcttcgtgcggcgcaactcgcgcacgaagcggaagatcatgcccgcaatcgccagcatgtcaaaggcaaactgacggcgcgcgaacgtcttgacctgctgcttgacaccggttccttcgaggaaatcggacgattctgcggcggcgacatcaacggcggacgcgcgggagcggcggtcatcaccggtttcggcgaagtgttcggacgcaaagtggccgtatacgcacaggacttttccgtgcgcggcggcacgctgggagtcgcggaaggccgcaagatctgccgattgatggacaaagcgctcgacttgaaagtgccgatcatcgcgcttatcgattcgggcggcgcccgcattcaagagggcgtggccgcgctgacgcaatacgggcatctgttccgtaaaacctgcgacgccagcggtttcgtgccgcagctctcgctgattctcggcccatgcgcgggtggagccgtgtactgcccggcactgaccgatctgatcatcatgacccgtgaaaactccaacatgttcgtcaccggtcctgacgtggtcaaagcggccaccggcgaagtgatcagcatggacgacctcggcggcggatatgtgcacaacgccacctccggtgtggcgcactacctgggcgaagacgaagccgacgcgatcgactacgcacgaaccgtgctcgcctacctgccgtccaactccgacctgcagccgcccacctacgcgtacgccgcaacccgcgccgaccgtgacgtggccaagcgacttgccaccatcgtgccggacaacgaccgccagccgtacgacgtgctcgacgtgatccgctgcatcgtggactacggcgaattcgtgcaggtgcacgagctgttcgcaagctccgcagtggtgggattcgcctgcgtgaacgggcatccggtcggcattgtggcaaaccagccgaacgtcaacgcgggcatccttgacgtggattcctccgaaaaagtggcacgattcgtgcgtctgtgcgacgcgttcaacctgccggtcgtcaccttggtggacacccccggatacaagcctggcgccgaacaggaacatgcgggcatcatccgccgcggcgcgaaagtgatctacgcctacgccaacgcgcaagtgccgctggtcaccgtgatcctacgcaaagccttcggcggagcctatatcgtgatgggatccaaagccatcggagccgatctcaactacgcgtggccatccagccaaatcgcagtgctcggcgcggccggagcggtgaacatcatccaccgcaaagacctgcagaaagccaaagacgcaggcaaagacgtcgaagcgctccgagccaaatacgtggccgactacgaacgcaccaccgtcaacgcgaatctatcgctggaaatgggcgaaatcgacgccatgatcgaccccgagcaaacccgcgaaaccatcatcgaatcgctcaaactgctctccagcaagaaacgcgtgcgcaaaaccaccaaacaccacggcaaccagccgttgtgacgggcgcaaagtgcgcgggtgaatcgtaagcaaacgtaaacgcaagaacacatcgcaagatttttgaaacaagtaaggaacatcatgaacaccttttttcttgaccgactgaacagcgagccgcacgcactcgccttcgcaggccaatccaccccatggccggtgacactcgccgaccagagcgccaatccggtgctcgacgaagccctgcatacccacgccgacgcagcccaggcactgctgtacccggtgtccgccgacctgctcgccaccaccgggcgcccggtcgacctgtttggattcgagccaaatccggcacgactcggcgctgccgcagcggcttccgccagcgttccgggcattgctctcgcccagttgggtgcgctactcgacgctgcttccctcggctacaatcccgccgttgccaagccggttgccgtgctcggtcactcccaaggcgtgctcgccgtgcacatggtgcaggcgatcgtcgaagcgggttccattgaggcggcttccgcgcaaatcgatgaaattcttgcgattgccacgctgatcggcgttgccggcacccgtcaggcgcgtcagcttggccttgccgcacgtcacggcgaagccacgccgatgctgtctgtcaaggacatcacccgcgcccaggtggatgcgctgatcaagcgtgtttccggtgcccgaggcccgatcgccgtggcagtcaccaattccgccacgcattatgtgctctccggctacccggaggatctggccgcgttcggcgtggaagtggccaaggagcacaagcaccaggccaagctgcgcgaagagaaggtgcgtggcggtcgcgtgttcgaaccggtgctcgaataccttgacgtgaccctgccgttccacagcccgcttatggccgaggctgtttcacaggctgtttcatgggcggaatcctgcggaatcaacgccgaccacgctcgcgagctcgccgccgaagtgctgctcaaccatgtggattgggccgcccgcgtgcgtgcgctcatgaaatccaccgatccgagcgccctgtgggtgttggactttggcccgggaaccaccgttggcaagctgttctccaccgttgcccaaggcactggcgtcggcgtggtggaagcccccaccgtggccgatcgcggcgaactctccacgctggaaaccctgccggagcgcacccagaactggacccgcttcgcaccaagcatcatccacacctccgccggagacaaggtacgcaccgcattcaccgaactgaccggcaaagcgccggtgctgctcgccggcatgaccccgaccaccgtggaaccggaaatcgtggcggcggccgccaacgccggctactgggcggaactcgcaggcggcggtcaggtgaccgccagcgtgttcgaccgtcatgtcgccaagctggaagaagagcttgaagaaggccgtaccgttgaattcaacgcgatgttcatggaccgctacctgtggaacctgcagttcggatcccagcgcatcgtgccgaagaagcgtgccagcggcaccccgatcgacggcgtggtcgtgtccgcgggcattccggaacttgacgaggccgtggaactcatccacactctcaacgccgacggattcccgtacgtgagcttcaagccgggcaccgtcgaccagattcgccaggtggtgcgcatcgccaaggccgtagctccggtcaaggtgctcatcgaagtcgaaggtggttccgcaggtggacaccattcgtgggaatcattggacgatctgctgctgagcacctatgccgaagtgcgtgaacaggccaatctggtgctcgtggtcggcggtggcatcggcacgccggaacgtggcgccgactacatcaccggcgaatggtccgccgaatacggtcgcccgctcatgccggtggacggcgtgcttgtcggcaccgccgtgatgaccgccaaagaggcgcacaccagccctgaagtcaagcagatgctcgtcaacaccccaggcattcccgccaagggagcagacgtcgatccgttcgctccgctgggcgaacagtgggtgccgagcggccaagccaagggtggagtcacctccggcctgagccacctgcatgccgatatttacgagctggaaaactcttccgcgcgttgcggacgcctgctggtgcgcgtgatgaagcatccggaagagctggaaagccgccgtgaggaaatcatcgatgcgttgaacgccaccgcgaagccgtatttcggtgacctgaaggccatgacctatctcgcatgggcgcagcgtttcgccgatctcgctttcccgtgggtagatgaaacctatgccgatcgcttcctgcacttgctacagcgtatcgaagcccgcgtcaccacgaaggaaagcggcgaattcgcatcgctgttcgcatcccgtgccgatgtggaatccgatccgcatacggccatcgccaagcttgccgaagcctatccgcaagctgatgaactgaccgtcaccccgatggatgaagcttggttcccggtgctcgtgcgtgaatacccgaagccaatgccgttcgtgcccgtcatcgacaacgacctgctgcgttggtggggtcaggatcagctgtggcagtccgaagactcccgttactccgccgattccgtgcgtattattcctggtccgatctccgttgcgggcatcaccaccgttgacgaaccggtcgccgacattcttggccgtttcgaagaggccatggtcaagcgcgtttccgccgaatcgccaagcgcagacaaaaccgcgtttgcccagctcggcgcggcatcttccgcagaagaattcattcgcaaatccccgaacatctcgtgggtgggccatctcatggcaaacccggcgtacggtaccagcaacggtgacgccaactacgaaatccgcaagatttccagcgaaggaagcatcgaaaagtacgatctcgacattcatctcgatacctactgggacaacgatcctgacggtggcgcatccaagcacgccgtacgcgacatcgtcattccgctgaacgtggacggcaacgaatccgggctcttcccggtggtcgaccgcgaccgcctgccggaacacgtgtaccgcatgcttgccgacaccgcgggcatcggcaataccgccatcaccggcgacaagctcaccgccatgcccgttattgagcaggtggcagacaaagccgcccatccgttcggacaggcgcataccagctacacgctgtccgccaacctcggcttcgaccatgaagcggccaccggcggcgcgctgccgagcaatctggtgccgtcgcgcatcgcaccggacgcactcgtcggaccggcatggcccgccatctacgcggccctcggatccgtatacgtcaacgacttcccggtgatcgaaggcctgctcaacgcagtgcatctcgaccatctcatcgaactggaagtcagcgaagacgagctgctcaagcacactggcgaacagatcgcactgaccagctgggccgaaaactacttcgaatcggcatccggccgtgtggtgaccatccacgtcacccacagcgcacaagacggcaccgtgcttgccaacgaaaccgagcgtttcgccatccgtggccgcgcatattccgacgcactgccgccggaagcgccggactacggcggaatcgaagcggaaatcgaaagcactccgcgccgactgctgcgccgcgtcaaggtgaccgctccgcacgagatgaccgccttcgcccgtacttccggcgatttcaacccgatccacacctcgcatcgtggcgctgccgtttccggtcttgcggcaccgctcgtgcacggcatgtggctctccgcaaccgcgcaatacgcggtgcaggcgcttgacggcaagggtgcgcactacgaaatcgcaggctggacctacaacatgtacggcatggtgcagctcgacgacgaagtggaaatctccgtcgagcgtgtcggacgcgtggcacactccggcatggtgctcgaagtgaccagccgcatcgacggcaatatcgtgtctcgtggcaccgccatcgtacgtgcgccgaagtccgccttcgtctacccgggccagggcatacagcagcagggcatggtgctcgacgagcgtgccaagtccccggccgcacgagacgtgtgggagcgtgccgacaaggtgacctgcgagaagcttggattctcgatcctcgccgtcgtgcgtgacaatccgaaggaactgaccgccaacggcgtgacctaccgccatccggaaggactgctcaacctgacccagttcacgcaggtggcgctcgccaccgtggcattcgcccagaccgcacgtctgcgcgaagccggcgccgacatttggccggcctatttcgcgggccactcgctgggcgaatacaacgccctgagctcctttgccggcgtgattccgctggaaaccgtgatcgaactcgtgttccaccgcggttccaccatgcaccacctcattccgcgtgacgagaagggtcgctccaactaccgcatgggtgcgctgcgtccgaaccagttcggtgtgggcgacgacggcgtacgcgaatacgtcgaatccgtgtcgaaggcttccggcgagttcctgcagatcgtgaactacaacctggctggccagcagtatgccgtggcaggcaccatcgccggtctgaaggcgctgaaggccgattccgaccgccgcgtagccgaatatggcggcaagccggcattcatgctggtgccgggcatcgatgtgccgttccattccacgctgctgcgcaagggtgtgccggaattccgcgacaagcttgacgcgctcctgccgcagaccatcgattaccgtggtcgcttggtcggacgctacattccgaacctggttgcggctccgttcgaaatgacgaaggaattcgcagccaagattctcgaagtcgtgccgtccgagcgcattcaggccgctttggatgatccgcagatttgggattcctatgctgctgatgatcagaagctcggtcgattgctgcttacggaactgctgtcttggcagttcgcctccccggtgcgttggattgagacgcaggctctgctgttcggttccgccgagcagggcggtcttggtgtggaagagtatgttgaggttggtctcggcaatgctccgacactcgccaatcttggtgccaagacgttgcgtctgccacagtttgccggtcgcgatgtgacggtgtacaacgttggtcgcgatgagggccgcgtatatatgaccgattccgattcgttggttccggaagaagatgccgacgattctgcagttgcggctgcggcttcttctgcggctgctactccggctgttgcctcagctcctgcggcggctcctgcagccgttgcggaagttccggttgccgcagcttccgctggcgctccgtctggtgccgccgttgcggatattccattcaaggcatccgatgcgatcgccacattgctggcttactcggccaaggttcgccccgatcagatcggcgaaagcgataccaccgatacgctgactaatggcgtgtcttcccgccgtaaccagttgcttatggacatcagctccgaactgggcgtggcttccgtggacggtgccgccgaagcgacggtcaaggcgctgagcgctttggtcaacaaggtcgctccgaactacaaggcgttcggtccggtgctgtctgacatcgtgcgcgaccgtgtgcgtggcatgttcggtgccgccggtgtgaagctcggccagatcaccaagcgtgtgaccgatacatggcagcttggtgaagggtggacttcccatgtggtggctgcgctcgtgctcgaaacccgtgagggggccagctctcgtggcggtgatcttgcctcgttgagcacggatgccgcttccaatgcggccgctgccaacgcgctgatcgatgcggccgtgcagaaggttgccgccgacaagggcatcgccgttgccatgccgagcgctggtggcgcagctggcggggctgtggttgattccgccgctttggacgcgttcgcggccaaggtgaccggtgccgatggcgtgctcgcctccacggcgaagttcgtgctgaaccagctgggcgttgccgctccggttgccgaagaaactgctgatgagaacgcggctgttgtggctgcggtcgaagccgaactcggtgctgactggccgaagcaggtcgaacctcgttttgacgagcgcaaggccattctgttcgacgatcgttgggcatccgcacgtgaggatctggcacgcgcctactacaacaacgatgaatccgcattgaacggtagcttcatcggtctcggcaagaccattgccgacgaagccgcctggtatgcaggcaagagcgacaacgcggatctgaaggccgcattcaatcgtgtcgctgccgaagcaggagaaaacgcttccgaatcggcggaaaccagccgtttcgctggagatatcgccgtggtgacgggcgtggctccgaactccatcgcagcccaggtggtcaacggcctgcttgcaggcggtgcgaccgtggtggccacctcgcacagcttcaagccaagcgtgaaggcatgggccaagcagacctaccgtgagcatgcggccggtgacgccaagttgtggctggttcctgcgaacctgtcaagctaccgtgacgtggacgcgttggtcacttgggtcggcaatgtgcagaagaagacttccggtgcgaccaccacgattctcaaacctgcttacgagccgagcctgttcttcccgttcgcggctccgccggtgcatggcagcctcgccgattccggcgaactgttcgaatcccaggctcgcctcatgctgtggggtgttgagcgtgcgattgccggacttgcgaagatcggtgccgacaccgatgtgcagcataagttgcatgtggtgttgccgggatcgccgaaccgcggtattttcggcggcgacggtgcctacggcgaagtgaagagcgcatttgatgcgattgtgaaccgtgctcgcgccgaaaaggtgtggtcgagccgtgtgaccttcgcccatccgaagatcggctgggtgcgcggcacgggcttgatgggcggcaatgatccgctggtcgaagtggtggagcgtcacggtctgaagacctattccaccgccgaaatcgcggtagaactgctgaacctttccacccgcgaatcccgtatcgaagcagccaaggccccgctcgacgtggatctgaccggcggactcggcaacgagccgatcgacatcaaggcactgcgcgcggaagccatggaagacgcggcccaagcggaagcggcgaatgccaagaacgcaatcgcaggcaacgaatccgataccgcggccaagacgctcatcaaggcactgccaagcccgcgtgctccgcgtcaggccaaggtcgatcttgccgattggcagaacgtcaccgcccgtccggaagacgaaatcgtcatcgtgtccgtgggtgaacttggcccatggggctccggccgcacccgtttcgaagccgaactcggcatccattccgacggacaggtggatctgtctgccggcgcggtgctcgaactggcatggaatatgggtctgctgacgtggaacgacagccccaagccgggctggtacgacgttgatggcaacctcgtgcctgaggaggatatcgcggaacgttaccatgacgaggtcgtggcccgttccggcgtgcgtccgttcgacgaaggcatgggcaacgactacaaggacggcactgacgaggaagaggccgaggtattccttgaccacgatgtgaccttctcggttccgactcgtgagattgccgaagagtacgtcaagcttgatgaagcgcacaccagcttcgcggccgatgcggaatccggcgaatggaacgtgacccgccatgccggctccatgattcgcgtgcctcgtcgcgcggccatgacccgcacggtcggcggccagttcccgaagggcttcgatccggtcaagtggggcattccggcttccatggtcggcgatgtcgacaagatcgccttgtggaacatcgttactacggtcgacgcctacctgtccgcaggcttcacgccgaccgaaatcctcgaggcggtgcatccgtcgatggtggcctccacgcagggcaccggtttcggcggcatggcgtccatgcgcaagctgtacttggatcgcttcctcaaccatgagattccgaccgacattctgcaggaggctctgccgaatgttgtcgcagcccacgtgatgcagtcctacatcggcggctatggcaatatggtccagccggtttccgcctgcgccacggcagccgtctcccttgaagagggtgccgacaagatcgcgctcggcaaggccgacttcgtggtcaccggtgcgatcgacgacatcggcgtggaatccgtgatcggcttcggcaacatgaacgccaccgccaattcggaggaaatgtacgccaagggcatcgacgcgcgcttcttctcccgtgccaacgaccgtcgtcgtggcggattcgtggaatcccagggcggcggcaccatcctgctgacccgtggcgatatcgcgttgaagctcggcctgccggtcgccggcgtaatcggattcgtgcactcctacgccgacggcgcgcacacttccattccggctccgggcttgggtgcgcttgcagcgggcatgggcggcaaggattccaagctggtacgcgatctggcccgtctcggcgtcaccccggacgacatcgccgtggtttccaagcacgatacgtccaccaacgccaacgatccgaacgaatccgaactgcacaacacgttggcccacgccattggccgcgccgacggcaatccgctgttcgtgatctcgcagaagacgcttaccggtcatgccaagggcggtgcctgcatcttccaggtcaacggtctgacccagctgttcaagtccggcgtgattccggccaatgccgcccttgactgcgttgatccgaagctcatgcgcgacgaccacatggtctggctgcgcgaaccgttgaaggtcggctccgtcaaggcgggcctggccacgtcgctcggtttcggccacgtgtccggctttgcggcgatcgtcaatccgggcgcgttcgaagcggcagtggccaacaccgcgggcgtcgaggcactgaatgcatggcgtgatcgcgccaacgagcgtttggctgccggccagcgtcgccttgaggaaggcatgatgggccgcgccgcgctctacgagccgatcgacaaccgtcgtttccatgaggatagccgcggctacaacgcgcacgaggtggagaaggccatgctgctcgacccgaacgcgcgcctgggcgcatccggctacttcgaagcctgattcccgcgtctgagcgcctgaaatttctggcgctcagacgcacgatcatcaaaatcccgtatctgtcgcaatctcagtatttcgcggcagatacgggattttcatattcttgaatcactctactttccgtctgcacgatttccgtttggtgccgtattttcacttgtgcagacgcgaaacgaggggcgcacaatgcgggtggcagaggatgaagcgcttaggtaggatggtgtccttgcatgaaaacgaagtgtcgcccgcctgtttcgcggaaatcgacatggttcgtttcttcctgaaaactttcgaaaggctggaaaatgctgggtttagggcatgacgtcgtggatgtgcctgcgttcgccgagcaactgggcgaaccggggtcgcgcatgcgaaacctgttctccatgcgcgagctatggcagaccgctcaacgtgtgcaggtcaaaagggacggtgaggcggtgcatcttgcggcccgatgggcgggcaaggaggcttttctcaaggcgtggtgcgaagcgatttcacgcagggcaaatgccgatggagacattgcctatccgtacacgctcgacgattttccttgggcgcgcatcgaaatacttgacgattcccacggcgtgccccgtgtcatgctctcgcccgaggtgcgacgcaagttgcggcaatcgttgggattgccggttgatggggatgatcaatcgtgcgcaatccatatttccatgagtcatgacggatccgtcgcatccgcggtggtgacgatagaagcgtgaccgcaagtgattgcgtcaatcgattgacgtcaatcgcgacaacacctcgaaccggtttgataaaaccgtaaaatcacgctacactggtgccaacgtcgtggcaacgaacgctgcggaatccaactcataacaacgaagttccctgggaagaggagtcaaggaatggcacggtccaaatccgacaaagcatttgacgagcgcgtcgcacaatatagtgaggaactgcgcgaactattgacggatctgtatggggagcaggccgacgaagccttccgcaacctcaccgagctgatggccaaagcccacgatgcgcgccccgccgatctgaagcgtctcgacaccaagcgtctcgccgatccggaatggtacaagcgcggcaacatgttcggtatgaccatgtacaccgatctgttcgccggggatctgaagaaactcgccgacaaagtgccgtacctgaaggaacagaaactcacctatctgcacctgatgccactgctgaaaatgccgcatccgcagaatgacggcggttacgcagtggaggatttcgacaccgtcgacccgtcgctcggcaccaacgaagacctcgccgcgctcaccaagaaactgcgtgcggcgggcatcagcctgtgcctcgacttcgtgatgaaccacaccgcatccagccatcgctgggccaaagccgctcaagcgggcgatccgaaatatcaggactactactactgccacgacgaccgcaccatccccgaccagtatgacgccgtggtgccggaagtctttccggccaccgcgcccggcaacttcacctggaacgagcagatgcacaagtgggtgctcacctcgttctatccgttccagtgggatctgaactaccgcaacccgaacgtgctcgtgtcggtgctctccagtgtgcttggcctcgccaatcttggcgtcgaagtgttccgcatcgacgcggtgccttacatctggaaggaactcggcaccaactgccgcaatctgccgcaagtgcacgccatcgtgcgtatgctgcgcatcgtgctcgaatgcgtctgcccggccgtagtgctgaagggcgaagtggtgatggcccccaaggagcttgccgcctacttcggcacgccggaaaagccggaatgccacatgctttacaacgtgtcgatcatggtgaatctgtggagtgcgcttgccagtggggacgtgcgcctgctcaaagaccagctcgacaagcttaacgcgctgccggagaactgctggttcgtcaactacctgcgctgccatgacgacatcggctggggcttggacgagccggtggaggagagcctcggcatcgacccgctcaagcataaggaattcctgtaccacttctacgagggatcggtgcctggcagctgggctatgggagagctgtacaactacgacgaggcatcgaaggacgcgcgcagctgcggcaccacggccagcctgtgcggtgtggaacgtgcgctgatcacgcatgacaagccgctgctcgacatttcgatgaaacgcgatctgatgatgcattccgccatgtcgttcctgcgtggcttccccatgctgagctgcggcgacgaaatcgtgcagctcaacggctgggaatacaaggaggatcccgatcgcgtcgaggattcgcgcaatctgcatcgcagccccttcaattgggagaatgcggccaagcgcaagcagacgggcacgctgcagaagcagatgtgggacggtttgaagagcgttcgtgagatgcgcgacgatcccgcgttcgctccggaagcatgggtcactacttgggatgcgcataatgatgcggttcttgcggtggtgcgccacgttgaaggacgtacggtattgggattgttcaatttctcgtccgcacgtcagatcgcgcgtcttgattcggacggcgatatcgagcttcctgccgaagttgcgttggagccgtaccaggtttgcgtggtcgaaaaataattattacgatttcgacttgcgattgttgagggagtgtgtataatggctcgagtcgtttcgtgttggcttcggctggcatagacggtgcgcggatgtagctcaatggtagagcctcagtcttccaaactgattacgcgggttcgattcccgtcatccgctccacacaatcgttagagaagaagaaaggcgtgcttgacggcacgccttttgcatacctgccgtacgattgcttcgacgactgggtatgctggacgtgtcgtgacagcggtgcgacaatcgcaatacaacggagcgggtatggcacaaacgcaaggcaacaaggtgacggaagtcgtcgacggcgtggtcgaacgggtcgacgtttccaagcatccaacggcatccattgaggcgtccgatctttccttggccgatatcgaacggcgcaaatcgcatccggggcattgggcgctgttcatcgcgctggtgctggtggctttgatcgcgccttactggtggggacgtgtcatcgcagtcaaggatgcggcttggatggtggccaatctcagcttcctcgatcccaaaggcgtagcgctgatttcgtggacggtcaccattatggcgatggccggtttgggattgatggttgcggatgtgaagaaatggctgtggggcacggttttcgtggtgggactcgccgccgaacagttcgtcgccggcgtatgtctgctgagcttcaacttttggaacgccacctacgtgatgtacggcgattcctcagggctggccaacgcggcgaaccttggcattatcgcagccggatgcggtgtcgccttctatgcggtgctctgggtcggattgctggtatgcatcaaaaaggaatcgaaattcaatgtgctgacgcgcagttgggcatcgttcctgctgttcttcgcgattgagatcatcgcgctcgccgtggtgttgttcggaggtctgctgaacgtggtctgatccgccatttgttgtggattcgatttggtctgcccttcgtgtatgatttccccttggcgtgtttcgcccgcggatagagagcgcgccggtattggaccggcagcaccgcgcagcaatataaggaggatgccgtggcacttacggctgaggaaaagcaggaaatcatcaagacttacgctacccacgagggtgacaccggctccccggaggtccaggttgctctgctgaccaagcgtatcgctgatctgaccgagcacctcaaggagcacaagcatgatcaccactcccgtcgtggtctgctgctgatggtcggcgatcgtcgtcgtatgcttgattacctcaagcgcgtcgacatcaaccgttaccgctccctgattgagcgtctgggtctgcgccgatagttacattcttccgcccgaatgccttccttggcgttcgggcgtttttgcatgacagccgcgttgaggaaaagacagtttgaaagcccaaggtttagggtgcatgaggtctagaatctaaagatgaggaagcgacgaaggtaacgtcgcgtcacgcatgcagaaatcggttggagtccgctgaagaggactgccgatagttggtaaaagaaaagaaaaaggaggaaccctatggagggtcccgaaatcaaggctgttgaagccgtaatcgataatggttcatttggcaagcgcacgttgcgcttcgagaccggtcgtctcgcccagcaggcggatggtgccgtcgccgcctatcttgacgatgattcgatgattctgtcgaccaccaccgccggttccagcccgaaggagaactacgacttcttcccgctgaccgtggacgtggaagagaagatgtacgccgccggcaagattccgggctcgttcttccgccgtgaaggccgtccgagctccgaggcgattctggcttgccgtatcatcgaccgtccgctgcgcccgctgttcccgcacacgctgcgcaacgaagtgcaggttgtggaaaccgtgctcgccgtcaacccggacgatgcctacgatgttatcgctctgaacgctgcttccgcttccaccatgatttccggtctgccgttcgaaggcccggtttccggcgttcgcctggctctgatcgacggccagtgggtcgctttcccgcgttggagcgagcgtgagcgcgccgtgttcgaaatcgtggttgccggccgtgtcgtcgaaaacggcgacgtcgccatcgccatgatcgaagccggcgcaggcaagaacgcctggcacctcatctacgacgaaggccagaccaagccggacgaggaagtcgtcgccggtggtctcgaagccgccaagccgttcatcaaggtgatctgcgaggctcaggccgaactcaagaagatcgctgcgaaggaaaccaaggaattccagctcttcccggagtacaccgaagatctgtacaaccgtatcgatgagatcgcccacgccgatctcgacgaagccctctccattgccgagaagctgcctcgccaggatcgcatccatgagatcaaggagggcgtcaaggccacgctcgccggtgaattcaccgacatggacgatgccgagaaggaaaaggagatcggcaatgcgttcaaggagctgcagcgccagatcgtgcgtcgccgcatcctgacccaggattaccgcatcgatggccgtggcctgcgtgacatccgcaccctgtccgctgaagtggacatcgttccgcgcgtgcacggttccgcactgttccagcgtggcgaaacccagattctgggcgtcaccaccctgaacatgctcaagatggaacagcagatcgacgcactgtccggtccgcagtccaagcgttacatgcacaactatgagatgccgccgtactccaccggtgaaaccggccgcgtcggctccccgaagcgccgcgaaatcggccacggtgcgctggcggagaaggctctcgtgccggtgctgccgaaccgcgaagagttcccttacgccatccgtcaggtctccgaagccattggttccaacggttccacctccatgggttccgtgtgcgcgtccacactgtcgctgctcgccgcaggcgtgccgctgaaggccccggttgcgggcatcgccatgggcctcgtgtccggcgatgttgacggccagcacatcttcaagaccctgaccgatattctcggcgccgaagacgccttcggcgatatggacttcaaggttgccggtacttccgagttcatcaccgctctgcagctcgataccaagctcgacggcattccggctgacattctggcctctgctctgcagcaggccaaggaagcccgtaccaccattctcgaagtcatcaacgagtgcatcgatggtccggccgagatgagcccgtacgcaccgcgcatcatcaccaccaccgttccggtcgacaagatcggcgaagtcatcggtccgaagggcaagatgatcaaccagattcaggaagagaccggtgcggagatcgccatcgaagatgacggtaccgtgttcatctcctccgaaggtggcgacggcgctgaaaaggccaagcagatcatcgaccagatcgccaacccgcacgttcctgaagccggcgaaacctacaacggcaaggttgtgaagaccacctccttcggtgccttcgtgaacctgaccccgggcaccgacggcctgttgcacatctcccagatccgtaatctggccaacggcgagcgtatcgacgccgtcgaagacgtgctcaaggaaggcgacaccgtcgaggtagtcgtgcagggcgttgacgatcgcggcaagatctccctggccattccaggcttcgaagatcaggaatcctccgctccgcgccgtgagcgttccgatcgcgatgaccgtcgcggcagccgtggccgtcgtgatgaccgtcgttccgatcgtgacgatcgtgattatgatgatcgtccgcgtcgtcgtcgttccgatcgtgacgatgaccgcgattacgatcgcgatgatcgtccgcgtcgtcgtcgttccgatcgcgatgaccgtgactacgatcgtgatgatcgtcgttccgatcgtgacgatcgtgattatgatgatcgtccgcgtcgtcgtcgttccgatcgcgatgaccgtgactacgatcgtgatgatcgtcgttccgaccgtcgtcgcagcagccgccgcgacgaccgcaatccgcgttacgcagccgacgagaactacgacgagtaccgtgccgatcgcgaagagcgttccgagcgtcctcgccgccgcgtccgccgcgactttgatccttttgaggactgacgcctcaaaaggatccctcgcagcatagctgactgactgaagtgccctgtaccggaaggtacggggcactttgtgtttccatgcagattgcatgaaaatgagacacgggggcatgagttttgtcataacgtacctgggcgcatgcaagaatggtgtgaagagccattaacgaaggagtcgtcatggtcgttggcattatcattgccgtcatcgttgtacttattgtgctttgggccgtcagcgcctacaacgggctggtcacgctacgtaatcgtgtgaagaacggttgggcgcagatcgacgtgcagctcaagcagcgtaccgatcttattccgaacctggtggaaacggtcaaaggttatgcggcccacgaatcccaagtgttcacgcaggtcacgcaggcccgtgccggcgtggtgcaggccgcgcaaagcggtgacgtggcgcagcgcatcgctgcggaaaaccagctgagccgcgcacttgtcaatctgcaggccgtatccgaaaactatccgcagctgcaggccaatacgaatttcatggatttgcagaatcagctgaaatcgttggaagagaagatcgcctacgcacgccagttctacaacgatgtcgtgcagaagtacaatacccagaccgaggttgtgccgaccaatattatcgccggcttgttccatttcgaacaggccccttacttccaggtggacgaagcggatcgtcaggttccgcaagttaagttctgacatgcatgtaaagccccgtccgatgacgatggggctttactgttcaattcggcttgtacggccatctgagggaagaagaagcgagaaagagggattatgacggccaaacagcatgcgtcgcgagcggtgcgcagcttcggtatcgcgatcgtcgtcaccgttggcgttgtagcggccatattgctggccatcgcattggatgacggtggggccgatctgagctacaaaacgctcgactacgatgtgcaggtgcaaagcaatggcgatttgaaaatcacccaacacatcgatatgaaactcgccgaccgcagcgatgacgacggcgaccatccgtggaagcagctgtaccagcagtacacgctgaaggaaagcaacctgaccaatatcaccgatatcagcgtgcgcaacgcgacgacgggagagacctaccagcagggtgatatcgcaatcccaagcagctatagcaccgacgaatggaatcgagaacatgcggggcagtggtatatcgccgatgtttcgcaaggtgacagcaatccgcagccgttcgatcccgcaaaagacggtcttgttgccgacaataccgacgatcgttccaagaaaatcgaaatcggctggaatattcccgccaccacgtcggcgagcagcctgaaattcgatgtgaccatgaccatgcagggcgtggccaccgcctatcaagacgtggccacgttccaatgggaaccgctcggcgtgagcaatcagattcccatcggcaaggtcaccggaaccgtcacgttcccggatggcattacggcggataattcatgggcctggctgcacaccgaacgtacgtcaaccaccgaacgtggtgataaggggtcgttgcagttcaccgtgcacgacgttcgtgccggcgactatgttgacgtggtcgccatgttcgacgtcggtgcgaccagcggtgtggcacgcactcgtgataccaccatcaaaaacggcattatggaaagcgaggcccaacaggagcagcagtggcgtgaccggcagcgcacaaaagcgcgtatccgcctgatcacgtggatcgccattgccgtggccgggctgatcttgtgtgtgatcgccgttgtgctcgcattgcacagtttcgatcgttcgcaataccacggtgacatcgagtattggcgtgacgagccggaaatgagccccgccagcgctgcggaactgctgcatatcgttgacaacaagcattcgaaaacactgtcgagccgaaaaatgtcggcttccgtgctctcgctcgcttcgcgtggagcaatcgccatttacccggggccggccgccatgtatcggggcattgatatgagtcggtctcgcaatgccgatatcgcgcagctgatttccaatgatccagctcgtgcgcgtgatgcaggcaaaaccagcaccatcgtgatactgccggtggtgttcgataacccgcagtcattggcgctgagccagagcgaacgtaccgcgctcgacctgctggtgaaggcgtccgaacgcattggttctccggtgttcgatctgaaacagatggacaagaatttctccgattggtcgaagggctacaagtatcaggaaaagtttacgaatgcgtgcagtagcgaattctccatgttgggtgccacttcgtcatgcggcgggggagcgttcgccgcaggcatctgcgccgcgatcctggcgttcctttccatagtgtattttggcgtgatcggcaatcttgcgttggtcgtgctgatttccgcgccgatgatgttcgcgtccgtgtttgcgctgagctacctcaaattgaaggggcttaacgacaatggtcagcgtcttgccggtcaggtggtcggtttgaaacggtatatggaggatttcagcgacttccgtgatcgtggcgtggctgatctgacgttgtggggtcgctacatggtgtacgccaccgcgttcggcatttccgaaaaggcgatgaagcagctgctcaaggcgtacccgcagcttgccgacccgaattggcttgatgccaacgcttccgattcgctgctctactggagttaccgttcatggtatttcaatcatcattacgccggtcctgcttcgtgtgatacgaattcgatggatttctcgccgagcgccaattttggtgatattggcgcgcagttggaatcaggttttgctgatattcaatcgacgattgccgcggcatctccgtccagcagttacggtggttccggtggtagcttctccggcggtggtttcggcggttcctccggtggttccggcggcggcagcttcggtggtcgctgatctgcggcattacgcgcatgtttggtgggtttgttgtctgctgaggcgggtcggctggtaaggttgcattcggaaagacactctgtacgttgttgaaggagatcgggatggctttgttccgtaatcttggaccgttccgcaccacggccatcggccatggtgaaatgccgttgaccattgaaaacaatcgtggtcacgatgtcggtatcgaaacattgcacgcctcgttggatgccggatgccgtcacatcgacaccgcttgggcgtactacacgccgggcgaagaggaacagaccggcgaaaagctggtgcgtgaggcgcttgactcgtggaagggcccgcgtgaggaagtcaccgtggccaccaaggtgggcttgcgccgcgcttgggagggtgacaagccggtttggccgcgtgacggcaagccggagcatctgatcgaatacggcaagcagtccgcgatggcgcttggcgttgacagcatcgatctgctgtacctgcaccgtcatgatccggaagtgccgtacaacgagtcctgcgaaggcatcaaggcgctgctcgatcagggcgtggcccagtgggcgggtgtttccaacgtgagcatcgaacagttgaagatcgcgcaggagatcctcggcgacaagcttgtggccgtgcagaaccagtattctccgattcatctggacacccaagatacgcttgactattgcgccgagcagggtctggcgttcgtgtgctggagtccgttgggcggctaccgtcacccgtacgacgagcacctgttcgatccgttccgcgaggtggccgaagcccgtggcgtgagctaccagcgtgtggtgctcgcatgggagctggccaagggcgaccacatgttcgtgattcccggcgcccatcgaccggaaaccattctcgattccctcaaggccgacgagctcgaactcaccgaagaggaactcgccaaactcggctgagtgtcagattcgcaacgttttgcgtcaaggcgtccgtctccacgatggacgcctttgtttttccgcatgtgtttttcctcgtatgtatttcccggatgcggcagaagtgtcccgtgaatagtcgagaatatagagcggaaaaatcgagtaagaggaacaagcgtgcaaagaagaaacaagcctgaagtattggctcccgcgggcaatctgcgaggactgaaaaccgccgtcgattacggtgcggacgccgtctactgcggaggtaaggcgttcggcatgcgttcggcgccgaaaaacctgagtttggaggatttcgaagaaggctcccgttacgcgcatgagcgtggcgctcgcgtgtatgtgacctgcaatgtgttgccgcgcaacaatgaagtcgaagcgatgcgcgaatacatcggccagctcaaagacaccggcgtggacgcactgatcgtttccgacattggcgtgatgctcatggctcgcgaagtggcgccgaacctggaactgcatgtgagcacgcaggcgggagtcaccaactatcaggcagcgaacgccttctaccagttgggcgcacgtcgtgtggtgcttgcccgtgaaatggatctgcaggccgtgcgagacattcgcgcacgcattcccgacgatcttgacatcgaatgcttcgtgcatggcgcgatgtgcatggcgttctccggtcgttgtctgttctccaattatctgaccggacgtgacggcaatcatggcgaatgcgctcaaccgtgccgctggaagtattccatcgtcgaagaaaagcgtcccggccagtattttccgatagaacagactaaggaaggcgcgtatctgttcaattcgcaggatatgaacatgcttgcgcatatcgacgatctgcttgattcgggtgcgaccagtctgaaaatcgaaggacgttccaagagcgcctactatattgcggcgatgacgaacgcttacaagaccgccgttgacgcatacatggtgcaacgcggttttgaagacgaggatggcactgtgctgaagccattccatgaccgtgtgattcgcccgtctgatccggattacggcaagccggaaaccaccgatttgattatggaacatgcggatggcgcgttcgcggggaagccggatattgcaaccgttccagtcgcttccgccggcgaaccggatgatctgagctaccatgcgcgtagtacgaggcgtaagtcgaacacggctgcggaaatcctgccggaaggctggtatcacgccggagtgcgcccggcggaacacgtgtccctgcctgactggttgctggacgagccagacaaggtggcgcaccgcgactattccaccggcttctactatccggaacacaaagtgcagcaaagcaccgaccgttccgcgtatttccgcgcttggctggtggttggcgaagtgctctcgtggagtgaagaagacggcggccgtgtgaccattatgagccgcaacaaaatcgaagccggtcaggaagtcgaattcgtgctaccgggcgcggcgccgctcgcctacaccgttcccgcaggcggattccgtgacgccgacggacattgggtcgaatccatcaacaatccggcgcatgtcttctccatgccatgcccgcaggaagtgcccgtgaacgcagccatccgatctcgtaccaaaaagccgacgctcaaagcggaataattgcgaaaaacatcgtgtagacgcagaaaatcagcagaaataagttgaaataatcgtagaacaatcaaggaaaacaaaaaaatgactgacaagcagtatgacgacgcgattcttgacagcaatgcgatcgacccgaccgacgtggacggcaatccaattccggtgaccattccgatcatgcttgcgccgggcgtcaaagtcgtgtacaccacgcgacttggtggcaccagcgaaggcgattatgcgcattgcaatctcggaggcaagtccggcgaggatccgaaccatgtgcttgccaatcgtgtggcgctctccaatgccatcgacgcgaagctgagcttggtcagccaggtgcattccggcgttgccgtcgatgtggacgaattgttcgtcatgaaccgtccgttcggtttcgacgtgtctggcggcaagggcgaaaccgctcagcaggtgggcgaaaccgcggatgagccggcagtggttgaagcggacggccaggtgaccgctcagaagaacgtggcgctcggcatgttcgcggccgactgcctgccggtgctcatggccgatccggaagctggcgtgatcggcgccgcgcattgcggccgtcgtggcctgcagaacggtgtgatcggcgccaccatcgaaaagatggtgtccaagggagccaggccggagcgtattgtcgccacgctgggcccgtgcatctgcggcgactgctacgaggtgggcggagacattgccgacgaattcgacgcgcagttccctggaaccttcacgctgagccgtttcggccagccgggcatcgatattgcggccgccgcgctgcaggagcttgccaaagccggtgttccggctgataacgtcgtttcctcccgcgcccgcgtcaacgcagccacccagtatctttccgaagacgaggaattggcagaaatctgccaggccgatggcgaaggcgaaccgcagctcgcggaacgtttcaagaaaatccgccgtagcctgtgcacgctggaaaatccgctctggttctcgcatcgccgtgccaccatcgcaggcaaagcgcacgaaggtcgtatgcttgcgctgatcgtgcgcgaatagtgggagagcggcgcgctattgcggattgcgtgcagaacgtaaggcaaaacgcgctgcaaaccgattcgggggtttacggtgggacgtatgagtgagagagagcagatgcaggaacagaagatgccggttgtggccgtggtgttggcggccggtttcggcacgcgattcgatgagaccaatcccaagcagttggtttcggtgggggataagccaatcgtctgctggagcatcgaggcgttcgaacgcaacgatcgcgtgagcgacatcatcgtcgtggtcaacgagcgtgtcagcaatatggtgaacatgctcatcgacgaagccggttataccaaggtgcgtgccgtgattccgggtggctccgagcgtgtggacagcacccgctccgcgcttgatctgctcaagcaggcaggcattcccgatggcgcgaaaatcctcatccacgattccgtgcgaccgttcgtcgaacagcgatccatcgacggctgcatcgacagcctcgaccagttcaacgcggcgaccgtggcatacgcgtccactgacacgattctactgaccgaagatcttggagagcgcaaggtggtgcgctccgtgcccgatcgtacgaacgcattccgcgcgcaaaccccgcaggccttccgtttcggtaccatcaccaaagcctacgagctcgccaccgccgatcccgacttccacccaaccgacgacacccgcgtggtggtggactatctgccgaacgagccggtcgccatcgtcgccggatccgaaacgaatctcaaaatcaccacacaggccgacatgccgatcgccgagaacatcgcgcgcagcctcgacccggaacatgccaaacaagaagcgaaagcgcgcatgcacgcggtgttcgccgaagcgttctcacaaatgcataagcactgatcgtaaacgaacccacctttcaaccacgtacactggaacacatgcagcagatcaacatcgtcatctcaggtttcaccccgtacgacggcatcgacgtgaatccggccgtacttgttcccgtggcgctcgccgaatattggaatgatccatctcaatccgtggcgctgtccgacgatcttctgcaggatgtttccatgagcgtgacgacggtgacgcttccggtcagtttcgccaatgcctggcccatgctgctgaacgccatcgaacaggcgaatcccgatattgtcatcgccaccggtttgaagcggtccgcccgcggcgtgctgttggagcgatgcgccacgaatctgatggacgcggccaagcctgacgccgacaatgtgattccacctcgccgtccgatcaatccagaaggtccggcagcatattggacacgcctgccgttgcgttcgattctgcgcgatttcgccaaacatgagattcccgccgcgttgagttcggatgcgggcacgttcgtctgcaattcgctgttctaccatttgctcgactggtctgcagcgcaggaaaagcgcattctgtcgggtttcgtaagcctgccgatcgtcaacgagcagccacatccgcaacatggactgtcgatcgcgcagcaaatcgccgcaggtaacgatgtgatccgcgaatcggtgcgttattatctgcagccatcctcaagtgagattctgctcggctgaacggcgtcggcgtttcctcgaacgatttctgtgctctctgtgagaattatgcgactgccgtgtgccgaacgtttgttctgcgctaaagttcaaaacggataggcgcgggcaagatgcgcgatggaagggaattcgtgaaaggaataccatggttgagcagttcccaatcgtgttgagggggtacgacaaggaaagggtcgatgaggcgttcgcttcggctcaggagacggtggaccgtctgcgtgagcaggtcaaggccgacgatcagaccatccttgaactgcaggcacagctgcaggaagagaaaaacaagaaggccaacccgaattcgttcgcatctctgggcgccaacgcgcagcagatgctcgccagcgcggaacagaccagcgccgagctgctcgaccgtgccaagaaagacgcttccgcggcacgcgccacggtgcagcttcaggccgaaaccctgctgaacaacgccaagctcgacgccaagcgtattctcgacgaggccaacgccaaggccgaagcggtgctgtcgaaggccaataatgatgccgacacgttgaagtccaacgcccagcgcgaagcggaccagctgcgtggcgaagcgcagaaggccgtggtagcgcaacgccagaccgtcgatctggaattgacgaactcccgtgaggagcacgacaagcgtctcgcatcggagcgcgccacgcaggagcgtgagctctccgatctgcgcgccgaagccaccgagcagatcgcggcgcagcgcaagaacgccaatgacgagatcaaccgcatgaaaagcgagaccaacgaccagatcgaatccgcgttggccgaagccaacaagaagctggccgacgtgcgtgagcaggtgtccaagatgatgacggacgcgcagcgccgtgcctcggaaatcacggataccgccaaagccaaggcacaggagatcaccgacgaggccgaagtgcatcgcaccaagaccatcagtcaggtcaatgccgaggtggagcagatccgcgccgacatttccgcccagcaggatgaggctacgaagaaggtcaacgagctgctcgccgatctgaacgaacgccgtgaaatcgccaagaagcagtccgacgagctgatttcagaagcgcagcatacgcgcgatgaggccgaggcatacgcttccgacaagcgtgaggcagccgacaagcaggctgccagcattctcaagcaggccaccgaagaggccgacgagcagatcaacgagcgtcgtgaggcagccaagagcgagcttgaaggtgtgcagcagcgcatcgccgacctgcagacccgtgaggcgcagatcacgcagcgtgtcagtgaactgcgtgccatgtttgccaacgcgttctccggtttcggcgcgaacggcctgtccgtggtcaattccatcgacggcgaacagcatgattccgcagctgaagctgaaactccggcggaatcgcacgacgagagtggcgaaaccgttgcgggtgaaccggaagtgaccttcgacgaggatgttgtctccgacgaacagcagaataatgacgattttgaagaaccgtccgaagacgagcagtctgaccagggcgaggaagcacaggaggaacagaacaatgactgacatcacgccgttgagcgctgatgcattggcaacgctggttgaggatttcgaagccagcgaccacaaccgtatggccatgaacgcggtcaccgcggctggcatcaacaaggtggcacgcaactatgaccgcgcccgcctgatgcagcgccgattctccaccattgtcgacaatggcaccgccacccatcaggatcgttccggccgttgctggctgttcagctcgctgaacgtggctcgtttcgtggtcaagaagaacatggggctgaaggaattcgagttctcccagaactatgccatgtactacgacaagctcgagcgcgtcaactacttcctgcaggacgtggccgaactggtgaaggccggcgagccgtccgactcccgcctgatccagcatctgctcgccgacgtgatgggcgacggcggccagtggaccatggccatgaacgtgtacaagaagtacggtgccgttccgaaggatctgttcccggaaaccgaatcctccaagaacaccggcgaaatgaacgtgcaattgcgtcgcctgctgcatacggccgtcgcgcacatgtatgctgatccggcttcgatcgaatcggtaatcgccgaagcgaccgccgccggacaccgcattctgacgattcacctgggcgagccgccgaagagcttcgactgggagtggaccgacaaggacggcgagttccatcgcgatggtgagatcacgcctgtggaattctggcagaagtacgtcggttccgccgatttggaaagctacgtgtgcctggtcgacgatcctcgtcaggagcatgcgaagggcaagaagatcggtatcgagcacttgggtaatgtggccggaggagacccgaccgaatacctgaacgtgccgaaccagttcatgaaggattgcgtgcgtcagattctcgaagagcagggcattccagtatggttcggtgccgactgccacccgatgatggatcgtgaaaacggcgcttgggccactgatctgtttgaatacggcaaggtgtatggcgtcgacttcgatctggacaaggaagatcgcgtgcgtttcgccgattccgcgatgaaccacgctatggcgttcgtcggcgtggacgtggccgaagacggcacgaccacccgtcgttggcgtgtggagaactcttggggcgacaagatcgcagacaagggctacttcactatgagcgacgactggttcaccgaatacgtgtacgaggtcgccgtgccgaaggcgctgctccctgccgaatatcaggccgctcttgacgagccagccaccatgctccccgcatgggatccgatgggcgctctggctgactgatacgtaaaccgacaaaccgattgacgaatgccgactgcatgggacttcgcaaaaagtccagcatgcagtcggcattcgtgttattccgcttttatccgttaaggtaacttcggtgattatcatccatgcacagtatgcatgaagcaggtatgcaggtataaggaggagcagaagagatgtcaggtcttcgcggtccagatagttcgaaggatgcgcagttgttggataacgccgtgtttccggagaccgtggatatcaatattcgacagctagacccgattccggccccccgatattttctgaaggaaattccactcaccgacgagatgagcgatctggtgttgaagtcccgtcaggaaatccgcgatgtgctcaacggcaaagacgatcgtctgcttgccatcgtcggtccatgctcgattcatgatccgaaagcggcgcacgaatacgcggcaaaacttgccgcggtcaaaaaagaactggaagaccaactggtcattgtgatgcgcgtgtatttcgaaaagccacgcaccaccatcggttggaagggtctgatcaacgatcccgatctcgacggccagttcaatattcgcaagggcatgtggctcgcacgcaaggtgctggccgatgtgctgagccttggactcccggcagccacggaatggcttgacccgatcaccccgcagtacatctgcgacttgattagctggggtgcgattggcgctcgcaacaccgaaagccaggtgcatcgcgagctcgcgtcgggcatgtcgatgccaatcggcttcaagaacgccaccgacggttcgatcaagccggcagcggattcctgcttcgcggccgccttcgagcatcatttcctgtccatcaatcttgacggacgtgtgatttccgccgaaaccaagggcaatcccgattgccatctggtgttgcgcggctcctcgcacggcccgaactacgataccgaatccgtggcgaaggcgttggccgatctgaaggtttccaaggcgtccggcccgagcgaacacggtcttgtcatcgatgcggcgcacggcaactgcggcaaggacgaagtgcgcgaagccgaagtgatcgaaaacatcgcctcccgcatcgcaacgggagagtcgggcatcagcggcatcatgatggaaagcttcctgaaagccggcaatcagaagcccgctccgctcgaccagctcgagtacggcaaatccatcaccgacgcctgcgtgccgtgggaacgtaccgaacagttgctgcacacgcttgccgatgcggtcgaaagccgtcgcgcactcgccaaataagcgcaaataagcgcaaataatcgcaaggaatcgcaaataactaaccgtgcggaatacgcgtaactgcgtaatcgcacggtttttgcatagcgactgccatttgattgatattcttggggagataggtgattgtcaaggagagcagtgaaatgcagcagcagctgaacacgcctgaagagcttcgcgccatccgcgaggccatggatgagggaaagaatccgctggtggctacggatgtgccacgctgggaagaccaggtcggcatcagccgcattgtgaaccgcagggtgcttgaattcgaggtgcttcccacgccggcgcaggtgttgggggacctgccgctcagcgatcaggcgcaagagatcgtcgcctattcacgcgatgagattcgtgcctgcctgtacggccaggacgatcgattgctggtgatcgtcggtccgtgttccgtgcatgatccggctgccgcactcgattacgcccgtcgcttggccgcgttgaaagacgagctgggcggagaattgctgattgtgatgcgcgtgtatttcgaaaaaccgcgtacgacggtcggttggaaaggcctgatcaacgatcccgacatcgacggcagctgcaatatcaaaaaaggcctgcttttggcccgtcgtacactgcttggcgtattggacgcaggtttggccaccgccacggaattcctggaaccaaccagcccgcaatacatttccgacgcggtcagctggggtgcgatcggcgctcgcaacaccgaaagccaggtgcaccgccagctcgcttcgggcatgtcgatgccgatcggcttcaaaaacgctaccgacggttccatcaaagcgccgaccgactcgtgttttgcgtcggcgcaacagcacacgttcttcggcatcgatcacatgggtcgtgcggccgtggtcaaaacgctcggcaatcccgactgccatgtggtgttgcgcggttcgagcagcggcccgaactatgacgccgaatccgtggcgaacgccatgaagctgatccgtgaggaaatgccggtcgaatccgcggcggcacacggtctgatcgttgactgttcgcacggcaattccggcaaagacgaacatcgccaagtcgaagtggtacgcaatatcgcaagccgtatcgccgaaggtgaagagggcatcaccggcatcatgatggaaagcttcatcgagggtggcagtcaaaaaccggcaccgctcgccgaactcacgtacggtcaatccatcaccgacaaatgcttgagctggcagattacggaagcgttgctgcgcgaacttgcgcaagccgtgggcaagcgccgctggaagtgagcgaagcgaaaataagcgaaaccgagcgaaaagcgtgaagcaatcgaaaggaacgaacgcatgagcacaatcgccatcatcggcgccatggacgaggaagtcgccaatatcgcatccgcattgagcgacatcaccgtaacggaggaagccggcgtcagcgtgacgcgaggcaccatcgaaaccaacaagggcactcgcgtcaacgttgcggcaacggtcggcggcatgggcaccgtcaatatcgccgccaccacgcagcatctcatcgacgcggaccagcctgacgccgtgatcttctccggcatcgcaggcaatctcaacacgcatctgcacatcaacgacgtggtgcttggcggcacgttgcgctacctcgacaccgacatgcgtctcgtcggccagtggaagccaggcactgcggaccagccggtggaggaattccactccgacgaccgtctgatcgaagtcgccgataaggtgctgaccgatctgagcgtgcatcacatcaccggcatcatcgccacgggcaactatttcgtggacgatccgaagaaagtggagcaggtgattcgcgaaaccggcgcggacgcggtcgaaatggaaggcgccgcggtggcgcatgtcgcggcgcgcaacggcctgcccgtgctggtcatccgcgcgttgagcgacaatgccgacacggattacgtggaattcaaggaattcgacatttccgaatatgccgacaccgcggcgaaaatcgcggtgaacatcgtcaagcgcatgtaagcgcatgaaagacggcccgtccaacgcatcggttgctggacgggccgtctcatatttcggtatggcgaatctcacgaaagtgaactgcggggaaacttccgatggcgtgagggaatcgcgcacggaaatcgctttccggaaccgctactgttgaagaagaatgacggattatcggaaggttaacgtatgacgctggagcacgtggtgatggcgattgtggttgttgccgtcgctgtggtcgcctttttgctggggcgtgcccgtggcgtgcaattgggggaggatgagatcgacccgaacgatccaagcctgttcggcgcgcagaagaacatgtcgctgttcgggccgcgcgtgcccgtgcagtccacggaacgccagctgatcgccgtcatgccggaggcgttgatcgtcgtcgattcactggcgtcggtcacatacgtttccccgggcgcgcaacgtttcggcattgttgaggacagtgcgatgacgcttgccgaaatccgcgatattctgcgattggtgtcgaccgacagcgtggtgcgcgaacgcgaattgtcgattccgctggatcgagccgcccgtgcggccgcgaaaaacaccgacggcaaaggcattgaggcaggtaagttccgtccttccgacacgctgtatctgcatgtgcgggtcggccagatctccgatgatctttttgcgattttcatttcggatatgagcgagcagcgtcgttttgagattatgcgacgcgattttgtgacgaacgtttcgcacgaattgaagactcctgccggtgcgatttccctgcttgccgaaacgatcggcgacgctgcggacgatcccggcatggtgaagtattttgcgggtcgcatttccaaggaatccgaacgattgacggaattggtgcatcgcttgatcgacttgcagaaggcgcaaagcacggctgcggtgctgaacgcggaacggctttccgtgcttgcgttggtacgcgaggcgatcgtcgaaaaccaagtgaaggccgaatcgaagcatatcaatctggtgctttcgctgaatggcaagcagaagctggtgcacgtcgagggtgccgtaaacgctgtcgatgaggatgatctgttcatcaacgccgatcatgaaaccatcaaaacggcggtgaagaatctggtggaaaacgccgtcaactattctccggaacacaccaccgtcgcagtcggcatcggcagtggcgatgacgaggttgcgattcgtgtcgtcgatcagggcattggcattccggaatcctcgctggatcgtattttcgagcgattctaccgtgtcgatcccgcacgttcccgcgaaacagggggtacaggattgggtttggccatcaccaaacattgcgtgcaggattgcggaggcactatcgccgtgtggtcgcgtgagggggagggatcgaccttcaccatcaccctgcctcaggcacaagcggtggaaacagcggaaactgcagagactgcgggaaacgtacaaactgcggaagcggatcgcatggaagtgacgggcgaaaccgaacgcatcgaaactacgcaatccgagtaatccgaataatctgagctaaaccgaatacagcaaataacaagcaacgttcccatcaacagagcaatggaggagaagcactgatgacacgtattctgatcgtcgaggacgaggaatcgtatcgagagccgctggtctaccagctcacccgcgaaggctacgacgtgtccgccgcggccaccggcgaggaagggctggaactgttcaccaaaggcggcatcgatttggtgttgctcgatctgatgctgcccgggcttgacggcaccgcgctatgtcgcagaattcgtgagcaaagccgcgtaccgatcatcatgctcaccgcgaaaagcgcggaaatcgacaaggtggtcggtttggaaatcggcgcggacgactacatcaccaagccgtactcgttccgcgagctgctggcgcgggtgcgtgcggtgctgcgacgcaaccagatggtggccgacgcgacggaatcctccgatgacgatattccgctgatctgcggcgacatttccatgaagatcggccagcatgaggtgatggtgcgcggagagaacgtgttcttcccgctgaaggaattcgagcttctcgaatatctcatgcagaacaagggccgtgtgatgacccgccaccagctgatcgaccgcatttgggggtccgattacgttggcgacaccaaaacgttggatgtacacgtcaagcgtgtccgctccaaaatcgaggaggatccggcgcatccgaaatatctgaccaccgtgcgcggtttgggctacaaaattgacgttcctgcggaataaagcggaaatatcgcgatagatggaaatatataagataaaacactgcgattccagtactcatcgtaagtttccgaataattgattattaattgataactgaatgtaagaccgtggtatcacggtagtcgccgaagatcggtgaatggaaatgacgaaaacgtccgaagtgtcgtagagtgttcatcttccgttcaccgattttggttttgcgggacccaaaccaccaataggcttgacagtgtcatgaagaacgatggcgacaacagcatatgaaatgtcagaaacatacgccatcagaatgttgacagagggaaaagaataatgcgtaattccattctcgtacgctccattgcagctgtgtccggcattgtgatgctggcttctgtcgcggcttgcggcgacaacactgcttccaacactgattcttcggctagcaccgacaccaagaccaccgaagccgtgtccggcaacttctccggcgctggcgcttcctcccagcagactgctgtggaagcctggatcgccggctttcagggcaccaacccggatgccaaggtcgcctacaacccgtctggttccggcgctggcgtttccacctttctgaccggcgccaccgcatgggccggctccgatgccgccctgtccaatgacgaggtcgagcagtccaagagcgtgtgcgcttccggcaacgccttcgacatcccggtctacgtctccccgatcgccgtggtcttcaacctcaacggcatttccggcaagggcaagaccctgaacatggacgccgacaccatcgccaagatcttcgacggcaagatcaccaagtggaacgatgacgccatcaagcagcagaacccgaaggtcgacctgcctgatctcgacatcaccgtggtgcaccgctccgacaagtccggtaccaccaagaacttcctgagctacgtcaaggatgctgccggcgacgcttggagctacgagctcggcgagaactggccgaacgaggttggccagggcgctaagggtacttccggcgtgatctccaccgtgcagcaggctgacggcaccatcggctacgccgatgcttcccaggctggcgagctcggcaccgttgcagtgaaggtcggcgacgattacgtgccgttctccgctgaagccgctgccaaggttgtggacgcttccccgctcgacgaatccgccactggcgacaaccgtgtggtcgtcaagctcgaccacaacaccaccgaggctggcgcctacccgatcgtgcttgtctcctacgacatcgcttgcccggcatacaaggatgccgacaccgccaagttcgtcaagtcctggctcacctacgtggtcagcgacgaaggtcagcagaccgctgcctccgcagcaggctccgctccgctgtccgacaccatgcgccagaaggtcctcaagtccatcgacgccatcgaaaccaagtgagctttgatacagtaagcgataggctctcggtgaacggcaactgaccgtctgtttcaggccgcagccgcaacatgaaagcgggtgcggcctgaaacggtacctgcaggtaaaacaaaaaacgcagtcatcgcaagtaatcgcagatctgtttcaaacaatcgcaagttaaggagaacccgtgagttcgcaaagcaaaacggcacagcagccagtgagcggcaaaaacgcggataaggtgttcaagggcgtggcctacgcctgcggcatcctgatcctcgtagtgctcgccgccgtcgcgctgttcctgctgttccgcgcatggccgttgatcggcggcgatcagcaggccaacagcgacaccatcagcaacttcaccggcggcaaggcctccagcttctggggctacgtcggaccgctgctgttcggcaccgtgctgatctccgcgctggcactgttgatttccttcttcgtgtcggtcggcatcgcactgttcatctcgcactacgcgccgaagaagctcgccactgtcttgagctatgtggtcgatctgctcgccgcaattccgtccgttatctacggtctgtggggtggcctggtgctggtgcccgccatctacccgttctggaattgggtggccaagtatcttggctggattccgctgttcgcaggtcctgccgccaatccttcccgtaccgtcgtcaccgtggccgtggtgctcgcagtcatgatcctgccgatcatcacctccatgtcccgcgatatcttcctgcagactccgcgccttcaggaagaggccgcgcttgctcttggcgccaccaagtgggaaatggtcaagcttgcggtgctgccgttcggcaagtccggtgtggtgtccgcttccatgcttggcttgggtcgtgcgcttggcgaaaccatggccgtgctcatgatcctgtctccaggtctcaactactccatcaagctgctgcaggcttcgcagaaccagacgatcgcagccaacatcgccgcgcagtatcctgaagccaacgatctcggcgtgtccgtgctgatcggcaccggcctggtgctgttcctcattactttcgtggtgaatttcatcgcccgtaagcttaccgagaaagcgagtgcgtgatgaccgcagtgaataacaacgcttctccgatggacggtgcccccgtcatcgatttcgacaagttcaagccgacgcgttcctttaccgctgcacgtaagcgcaaggatcttgcgatgcgcgtactgatcgctcttgcgttcattgtggcgctgattccgctgttctcggtgctgctcaccaccatcgtcaacggtgtcaagaggctgaacctcaacttcctgagctataacatgaccggtgtggtcggcggcaatccgacgccgtccggtggctacggcggtattcagcacgccatcatcggtacgctggaaatcacgttcggcgccatgatcatctccattccgatcggtctgatgtgcgccgtgtacttggtggaatattccaaccgtggcaagctggctcgcgtcatcaccctgctggtcgacgtgatgagcggtattccgtccatcgtcgcaggtttgttcgcattctcgatgttcacgattctgattggacctggcaccatcaacggtttcgaaggttccgtggcactgtcgctgctgatgctgccgaccgtggtcaagtcctctgaagaaatgttgaagatcgtgcctcacgacttgcgtgaagcgtcgtatgctttgggtgttaccaagcagcgcacgattacgaagattgtgttgcgtaccgctttgccgggcattgtttcgggtgcgattctcgccgtcgcccgtgtgattggtgagaccgctccgttgctgatgaccgcaggctacatcgcctccacgaacgtcaacctcttctccggccagatgaccacccttccggtgtacgtctaccaggagtactccaagctcaacgcgaattgcccggcttccgccgacgcttcctgcgtgaccaccatcccgatggaacgcgcatgggccgcggctctcgtgctgatcctcatcgtgcttatcctcaaccttatcggtcgactcgtggcgaaggtcttcgccgtcaagtcggaacgatgagcggtagtcttacatacagaaacaacatataaggaaccaaaatgggacaacgtattgatgtcaatcatctgaacatctactacggcgacttcctggccgttgaagatgtgaacatcaacatcgaagccaacaaggtcactgctttcatcggaccttccggctgtggcaagtccacggtgctgcgcacgctcgaccgcatgcacgagatcattccgggcgctcactgcgaaggcgaggtgttgctggaaggcaagaacctgtacgacaaggacatcgacccggttgccgtgcgtcgcgatgtcggcatggtgttccagcgtgcgaacccgttcccgaccatgtccatccgcgagaatgtgctcgctggcgtgaggctcaacaaccgcaagatctcgaagtccgatgcggacgatctggtcgaatgggctctgcgtggcgccaacctgtggaacgaagtcaaggatcgtcttgacaatcctggcattggtctttccggtggtcagcagcagcgtctgtgcatcgcccgcgctgtggccgtgcacccgcaggtgctgctgatggacgagccgtgctccgctcttgacccgatttcgacgttggctgtcgaggatctgatcaacgagctcaagaacgactacaccatcgtgatcgtgacgcacaacatgcagcaggccgcccgtatcgccgactacaccgcgttcttcaacctgaaggcagtcggccagccgggtcacctcgagtacttcaccgacacgaccaccatgttcaacaacccccagaacgaagaagccgagcgctacgtatcgggacgctttggctgatcggcaaaagccgatctgccaaagcgtagcgttgacccagtgggtcaacgcaagcgagctttagcgagccagcaaattatgtttcgctttgcgaagctccttaattgcacgcggctgatcggcaaatcatctcttactcccgcttgtgggggattgtcgcacgaatgtgcggtcgaaagtggttgcttcgctaaccatttcgatcccattcgtggcggccgttcccctgagcgggagttttttgtatgtgatacctgatcgcgacacgctctattgataatgattctcaattaagttatgatggtgttatatcacgttagggaggatctatcatgtaccgtattgtgagaattgcgattgccgcacttgcttctgtaggaatgcttgcgtcggttgctgcgtgtggaagcggccgatcgtcgtccgaaaaaaacggaaccatcgaagtggtcgcttccgtgaatcagtggggtaccgtggcgaaaaccttgggcggtggcaacgtcaacgtaaccagcatcatcaattccaccaatgtggatgcgcatgattacgagccaacgacgtcggatatcgccaaactgcagaaagcgcaagtcatcatcgtcaatggagccggctacgacgcatgggcggtcaaagcggcgcaatccgccaacgcaactatcgtcaatgccgctgcagtcggcggggtgaatgacggcgaaaatccgcatgtttggttctccgccgatgtgcgcaaggcagtggcacaggcgatcaccgaagcgtacgaacaggccgacgccgcgaaaaagagtgatttcgacaagctgcacgatcagtggaaatctgaagaaaacaacgtcgaaagcaaaatcgccgaagtgaaacagaaatcggacggattggcgtacgcggcaacggaatccgtggcaagctatctggcggaagacatgggtttgaccgacgcaacgccaagcgggtacgcgcgagccacagcgaacgaaagcgagccgacaccaacggatatcaggcagttcgccgacgcattgaaatcaggtgaaatcaaactgttgatcgtcaatacgcaggaggaaagcgagctgacgggcaaaatcacgaatgccgcgaaatccgcaaacgtgcccatggttgaactgaccgaacagatgccggaacaatacgattccttgacggcctggatggaaagtctggttgacgccttctcgaaagccatcgcataagacggttcactaaaaagcagtacgaaaacaagcgatacaacaataggggcgactccgcagtgagagcggaatcgcccctatttcatttgccgaatttatttactgaaccagtaatttcggctggtggtcaggttgaacctgacgttcagaactacaggatcgcggtgatgatgaagtccagaatgaacagcagcgacacaacccagatcaccggatgcacttccttggccttgcccttgcaggtcttgatcaggcagtaggtgatgaagccgccggcgatgccgtaggagatggagtagctgaacgccatgaatacggaagcgaagaacgccggcacggcctcggagatatcaccccagtcgatttccttcagtgaggacgccatcatgcagcccaccaccacgagcacgcctgcggttgcggcggacggaatggcggagatgaccggggagaggaaggcggacagggcgaagcagatggccacgaccacggaggtcaggccggtgcggccgccagcggcgatacctgcggaggattccacatacgtggtggtgttggaggtgccgcagatggcgccgatggaagttgcgatcgaatcggcgaacagggccttgtccatcttggaggagaagccggaaccgttttcgagggcttcctcgtcttccgcggagaagatgccggtgcggcggccggtgccgatgaacgtgccgatggtgtcgaaggtatcggacatggagaatgcgaagatcgtcagcagaatgatcggcagcttcgacatgtcggagaacagcgatgggaagccttcggcgctgaagatagcgccaaaggtctgcggtagctgggcgaaagtgtcgccgatggagatggagttggccatggtggtctgacccatcggaatgccggcgatggcggtgaccgcgatggcgatcagcatgccgccgcgcaccttgagcacggtgaggatgatggcgaggaacaggccgatgatgaacagccagatggtcggattattcatgacggccagacctggggtggcctgcacggtgtcgccgttcttggcgtcggccttggtggtgaaggtgaagaagccgacgttcaggaagccgacgtaggccacgaacaggccgatgccgccgccgatggcgttctgcagcacttccggaatggcttggatgatgatcttacgaatcttggtgacggtgatgagaatgttgatcaggccacacaggaacaccatgcacagggtctgctgccaggtgaagccgaggccgaagcaaacggtgtaggtgaagaatgcgttgaggcccatgccggcggcctgagcatacggaacgttggcgaacaagcccatgacgagcgtgcccgcgatggctgcgatgatggttgcaaggaatacgccgccccacggcattcccgtttgcgacagtatctgtgggttgacgatgatgatgtacgacattgcgaagaacgtggtcagaccggccatgacctcagtggacatggtggtgccgttctccttaagatggaagaacttttccatttttccctatctctatttctcttgggttggtaggaacgttccgactattgggcggcgcgttccggcgagaattgcgactcgccttgtggaatcgtgggattccgaacaaggcttaaccgtaacacttgagtgagtcatgaagatttcgtaaagcgcgacacgcccggatgacggcaagtccaagcatgaccgtaagttgttcacctgtaaaccacagaccgttggttggagcgtgcaagcgctcacgaagtttggttcgccaagccaacgcaggttgaagaacatacgcccaccaagggctttccgcttagcggtcgaatgttgctctgcctgcgtgcagggcttttttattgtccggcgaaacgttcctgcttcacagtcaatggttgactaaggaaggaacgccatgaagaggcccgaaaaggaagcggtggtcgcccagcttacggataagttccgtgaagctgacgctatctacctgaccgagtaccgcgggcttaccgttccgcagatctctgaactgcgcgaaaagctaggccgcgatacttcctacactgtggctaagaacacgctgattcgcatcgcagccaaggaagctggcatcgaaggtctcgatgagatcctcgccggtccgaccgctgtgaccttcgtgaagggtgacttcatcgaagctgcgaagaccctgcgtgacttcgccaagaccaataaggcactgatcatcaagggcggcttcgctgatggcaccgtctacgatgctgaaggtgcccagaagctggcagacctcaagtctcgcccgcagctgctcgccgagttcgccggcgacatcaaggctacgatgtccaaggccgcgtacctgttcaacgctctgccgaccaaggccgtgcgtacgatcgatgcgctccgcgagaagcaggaaaaggctgcctgatttcattgcggttagccgcgtgaatgatagtgaccataaaagaaaaataattgttttaggtgacggtcacctcttcaatcaaaccgtcgccaagaatgaaaggaagccattatggctaagtacaccaacgatgagctgctcgaagctttcggtgagatgaccctggttgagctctccgagttcgtcaaggctttcgaagagaagttcgacgtcgaggctgccgctccggctgctgtcgccgttgccgctccgggcgctgctgctccggctgaggaagagaaggacgagttcgacgtcatcctctccgccgttggcgacaagaagatccaggtcatcaaggccgtccgcgctatcacctccctgggtctggctgaggccaaggctctggtcgacggcgctccgaaggctgtcctggagaaggccaagaaggaagacgctgagaaggctaagtcccagctcgaagaagccggcgctaccgtcgagctcaagtgattcgcgcggcttgaagccgcatatcacaatcttgagtggaaaccccgttcgccacaaggcggcggggttttccgcatattacgggattttctttcgctgacgatccaataaaatccgatttaggcatgaatgcttccatatcgtgccatacaatgggggaattaggcgaaagttgtcaattaatcgcgtcataatcctgaaatacgtggcaaggcatgacacaatgacaagtagtggtatgtgtgaaaggaaggccgacaacggtgagcgaagatcaacgaacggcacagcagtggaccgtcaaggttgatggaaccgaactgaagaagctgggcagcggcgaaagcgtggaaatcggccgcaagccgttacgtcctctggcggatgacggattcgcgcgccttgacattatggatacgaacaaatccatgtcgaaacggcatgccattgtttcagtcgacgcgcagggcaacgcttccgtacgtgatctcaagtcgaccaatggttcgtttgtagtggccgacaacggccaattgatgcgtctgcccgcggatgaggatttcaaactgccatccacgccaatgaccttgcaattcggcgacgtacgcgtcacttttgaacgtgacagcgtgagcgccatgcccgaatccgagagtaccacgtcagctccggtatctaatctgttctcctatgcagtgtccgatgaggcgtcgcaggagcccgacgccgccgatatgtcggtcgacgacattctcaatctgcgtgccggagagccgaccgcattgttcaacgcgcgcaacgtcgccaatcgtgtgaatctcatgcaacgctccgaacgtcagtctttcgcgccagttcgatccaacgagccggattatggggatctcccgtccgtttcgctggtgcagcataacgacgtcgtggataacgcgccacgtgacctcttcgccgacgccgcagccgaggcagatgccgtggcggaacagcaggcggcggaagaaggggccaagaagaacgccgccgaaaaggaaaagccggctatgctgcccgaatcccaatcgcggacgcaagccatcgcaggcaacgacgtcgaacacgacacgattcccgtgagcaaactattcagcgcaagaccaagcaagccgattatcgtggcattgccggatagcagcgacatgcctgaacaacaagcggaaaaaacgcacgagcagcgcaatgaaattgcagaacaatccggtaccaatccgattcaaccggaagaagcggcgcagcgggccgacgacgagcgtttcaggccgcataacacggagcagccacagattgtgagcgagccgacaccggacgaaaccagcgtattcaaaccggcttttgaacccggatcggtgttcgatcgagtcgccaagggagagcttgccaagcaggaacagaccattgaagtcgacggactgacgtcggatgatgccaaacgcaccgacgatttcaccgtgcagttcgagatggcacgtcatccggagctgctgccgttccttgccatgaacccgtcgctgtacgacgatttgtacgcatggctgggagctttgggcaatgcagacatcgacgcggccctgtcacataatccggggtatgcggaataccgcaaagcggtagggaagtgagtcaatacatgagcgaaagcaacgagaccgtcaccgcgctggatcgtattcgggggtggcgtgagaagtaccgtcttggtctatcgccgtcgccgcttgaggacgtgacgcagctgagcgcccagcttgacatgacgcatgcgcatccgtccggcatcgcgcagctgttcgccagcgggcatgtgcaacttgattccttgttccgcgacaacggcatgttgcgtgccgccgggcgtcgtgtggagcgtgtgctcgacgatcgtgaggcgaaaagccgtgtcagcggtgtgggcgaactgtctttggtggttggcgtggccatctggaaaggcaaccagatgccggtactcatgtatccggtcgaggtgcgcaaagaaggacgcaatattgaaaacggcacggtgatcgcgttcacagggcgcgtacgcttgaatgcggctttcgccgccgtgctgcgcgagaacaacgtcgtattggacgagtccaagctgttcgacggttcgaattacgaaagcggcacgccggaaacatccgcggtgttcgctgccatcacacgccttgcggccaacgcgttccctgattttgagatcgaacggcacattattctcggatgctttatggatccggcatcgcagatgctggtggaaagccggaagatcatcgaccagttggcgcaaggtccgaccggcaataccgccttggacgctttggcgggagacaagtccgccgccgaagcgttggaaggtgccgaaattccggagtacagtccgtttgatgccgatcctcatggggagtatgaggtcggcgatgcggacaataccgtccgatacgcctcgcagcttgcttccgcgggccattcgctgtttgtggatagtgcgatcgccaacaataccgccgagcaggccgcggcgattgcgtcgcgttgcgtgatgaacggacggtctgtgctctatgtgccgtgtgtgaccgatcagaagcgtcgttttgtacaggccgttgccgcaaacgaaatgagcggacagctgctggatatcgccgatgatggtgccaacgctgcgattgaccgtcagctgattgcagccgtcggcttccaatcgggggttgcttcctcccgttttgatcagattgccgatgagctggttggcgtgcgttcgcgtttgacccgttatctgggcgatcttcacggcgtgagtcaggagtggggtgtatccgcctaccagacgattcagaatctcgcgcagattgcggcattgcccacccatccgaccacgcatgtgcgtttgaacaagcagaccgcgcattccatcgcggacaagatcgaggattgggctgcgaaactgcagcgtgcgggcgagcttggcgaatacaccattacggagaacgacaccgcatggtataaggcatcgctgtattccgaagaggaggcggtgagcgcataccagcgtgtggttgagctgttgcgcaaggtgttgcccgccacccgcgagcaggtggccagtacggtacagacctgcggattcccgattcccacgaccgcgcaggagtggagccgtcaggtcatggtgctgaagaacctgcgccgtgtgcttgacgtattccagccggagattttcgaacgtgacattgcatccatgatcgaggcgaccaagccgaaggccgagcgcaaggccgaaggtacgtccatgggcttttgggagcgtcgccgccacatcaaggaagccaagggtttgctgcgcgtcggtgcccaagtggagaacctgcatgaggcgttgctggtggtgtccaagcaggccgatcagtggcatatgttcgtgcctcatggcggctggccggtattgcccgccaagctggatgacattatcgaaacgcaggagaatctcaatcgggatatgaccgcgttgaatgcggtgcttgccacaactccgcagggcggcaatcttgaaaccgttgatttcaatcaggtcgaagagcgtttgaaggccctgtatgacgataagcagtcgcttgatattctgcctgagcgcgcccgtctggaacgtgaattccattcggtcggcctcgacgagctggtcgaagatctgaacaatcgtggcgttgccaacgatgccgttgcaggggaactgcagctggcatggtggaccacggcgttcgaagacatcgtgaaatcctccgcgatcatttccaatcaggatgggtcggcattgcagggcgctgcggagcggttcgcccaggtcgatgtggaacatgtgcgttcggtcggtccgatggtggcgcaggaatccatgcgccgtctgtgcgacatgctgttctcgcgtacgcaggaggccaatctgctgcataccacgcttgccggcgcccgtaatgtttcgctgaactgcctgcataaggagcatccgcagattctcgccgcggcgaagcctattctcgttgcgactcctgccacgcttgcggccatcaccgatccggcgccattggccgacgtcgtgatcatcgatgccgcagcgcatattcaatccatcgaactgctcagcatcatcagccgagccaagcaggtggtggtgatcgcgcatcgcgaaaccgtcacttccgacggtctgaagcgtctcatcgcattgctgccgagcgtgaaaatcgccaatcgtcctgttcgccgcgcgccgaagctcaacgcgttcctggaatcggaaggctacggttccgtgcccttcgacgtggccagggaaggcgcgcagggcgaggtcgcctaccattttgtggccgatgccaatggcgtgccggtcatcacgtccggactggtggaaagcagccagcaggaaatcgacgaggtggtcaggctgatcaccaagcgtgccgccggtttcacgatcgtgcctgcatcgtacatgcttaccgtggtgacgctgacccatacgttccgcacccgactgggagccgagcttaaggcgatcgccaataagaacaaggccatgggcatgttcttgcgtcatgtgcgcatcgtggacatttccgatgtggccggcgcgcatgccaccgatgcgattcttgcgatgtgctacgcgaagacttctcatggaaggctgctgcaacagtttggagcgttggaatccgaaggcggacggggtatgttgctggatgcgttggccgtgccggatcgtcatcttgacatcgtgtccgcattctcgtcagctgacatggatgacgagcgcctgcaccaagctggtccgaagatgctgaaaacggtgcttcgctgggcggaacagctcgatgacagcgtggtgcgtccagtcgtcaagacgaacggttcgaacgtattgctcaacgatcttgccgaccgtattcgtgcccgcggtttgaatgtggccgtcgactacggtttcgacaatggttccaagctgccgctggtagttggcctgaacgacaagccgttcgcattggccgtgcttaccgacgatgcgcagttcatgggattgcagtccaccagagaacgccaccgcgtgcttttgcagaacatcgaatcgcttggctggtccgttatgaccgtgtggagcgttggcgcgttcgtgaatccagacaaggaagtggatcgcatcgtggcacgcttgagcgacctgtatcaggaggtcaagtgagcgtcgacgaaccctccatccaagagcccgcggaatctgaccagcctgccgtgcgtgtggtgtccggatactccgccacccgccgtacggcgcgcaaacacaagcgtgtggttcggcagggtacggaactgttcgatgccgatggcgtcaagcttgaaccgtccgatgtgcttaccgaacgccagcgcaatgctgacgacgacaagcgtattctgggcgagctgccaccgcattggggcgtgttctccgagcgggagcgctgacgttcgtttgctatacgggaggttctgatacgttcagacctcccgaatttcatatattccgcatgatggtgctgcggattcgcttgggaatgccgttacgaaccgacgatggcgatgatcgcgctgtattcttgggcctgcaatacggttgccgcctcatgaggaggcatggcaaacaccgcaagcgtgtcgccgtccgcattccgtgaaggtttcgcggtcaatatcgctcccgtgcacagctcatgcaacgacaccgcatccatatccggtaccgtttccggcgtggcctcgctgaacatcgtggcgctggaaagcgtcaccgtatcgccaatcgtcagactgtcggcggaactcgccaaccgaacttcgaccgccgtatatcctttgggaacaacgggggaagcgcgagccatggccgaggtgacgatgctgccttccgcaatatccacttgggcaatcagcccgacggcatcatcgatatcgtgagcaacgctgcgcagggcctcatcgtatggaatatctcgcaaagcaagcgaatccgcggaaatcacgccgcctttggcgatggacttcgccgcaatgacgacggattgcgtggaaatcgtcaatcgcacgcactgcagggccgcgaatatggcaagtccggcgcacagcgaagcaagtagacgatgcaattgcgcgtttcgtcgtcgtcgatgaggcgccgaagacggtgcgcggttcgtgtgtttgccgtccgtgccttgcagacgttggctaaggtcatgaaaaaaggtcaccattcatgcatgatgaccttacgaatagttgctgcgcaagccggatcgagggttgtggtcggaggatgcgagttatccacaggattcggcgtgtcgccttgttttccaaggtttgctgaccctggttatttggctcgtttccttgcttcggctgctcggttacgtgtattcgttttcgctcacttggacttgtcggtgcgatagaaaccagatcccttgaattcgatcggcggggcggaatacaccttgcggacctgctcttcgccgcattccgggcaaacggtgatcggatcgtcggtgaatgactgctgttcggtgaaatcgtagttgcagttcttgcaacggtaatggtaagtaggcaaagtatcctcgcttcaaccaggttctcaaatttcttaacgggacatatcctagtacgttccctgagacggctgcgtgaacgtcttatcttcggacgtcttattcgcgtatggccgtaaatccgttcggagtgagcacgccatcgacgggaatatcgtggtcttcgtgcggaacaggcttgtccgtcggctcccacggccagcaaaccgccaccacccgtgcaccggccgcgcgatactcgagcgcgcggtcataccaccctccgccacgtcccagacggaatccctcttggtcgacggcaagggcgggaacaatgatcagaccggcgtttttcagcgcttcaggtccgtttgcgctattgcccggctcttgcgggcggtgcgtattgatggacccgtcgctgttggtctggtcctgcagatcgtgaatgtcgccaagttcgctccagccaatatccatgccggatccgagccgtggcaccagcacgtggcaattcgaatcgaataatgcctgcagcatcggcatcatcgacatttcgctgcccatggacgcgaatgcggccaccgtggtgaacgaatgaatgagattcgccttccgcgcctgttcggccaacttacggccggcttccagtcgttcctccttactggtctgctttcttcgtgcgattgcgtgtgcgcgccattgctttttcagctcacgttggttcgcggcttcgtcacagacgctgttttccatgacgtcggcttgcatgttcgtggtcataccgcatgttgtaccacgggatggttgcgcgcaatcggaaatgttatgcgtatggcagaatgagggcgtgacgattttgcgatctttacggggcatgatgcgttcggatcccaatgccattgatgttccgcggttcattcaggcacatgggcttcacgttcccataatcctgcgtccgctgactactgacgactgcgacgaatggaacgaagtccgctggcgcaacgacgattggttgaagccttgggaatccggggatccggtgcatggcgcgtcgatgtcgttcaacgagtgggtgcgtgcgatgcgacgcaacgagcgaaacggcaccggagtggtgttcgccatcgagcatcatgggcgtatcgtcggccagatttcgttaggggccatctgctatggcgccatgcgtaccggcgtggttggctattgggtcgatgagcggtgtgcggggcgtggatatgcgccgatggctgttacgctattggctgattgggcgatgttcgacccttccgggccgcaattgcatcgtgtggagatcgacttgcttcccgaaaacgaacgttcacgtaaggtggcactcaaagtgggggcatcctatgaggggatgcgcaaggcgtacatgttcgtgaacgggcaatggcgtgaccatgaatcgtatgcgttgctgccggagtacgcaccgaatggctttaccgcacggttgatgggcgagtgagccgttggcgaggttcgacacgcgctttcgcgcacatgttcgacacgcgggggcgtgcaccccggagaatgtcggaatgtcacctattcttatgagttatgggttatgaatcgttaagcacggttgtggtgcttgcgattgtgattattctcatggttttctggctgcccaaacggacggtcaaaggcatgaagcgggtaatcgagcaccgagaggaccgcttttcgccgtcgctgcatctggtggatgccgacagtggaacgcgattctccgatgagaccgccgcaaaggcgaaaggggcaataatgcagtccaacgagacgcatgagggcaagctgaccgacgaaaggatcgcgcatgtccgtgcccttcgtcgtgccgcgatccgcagaaggcggattattgttgtctcgatgctggtgatcacaatcgtcgtgttgatgtgtgcgtttgtgttgcatttcagtccgttgtttgctttgattcctgcgtcgctgcttgctggagtgctcgctttgggggtgagggccgccaagcaggccgcagcgtgggagcggaaagtcgccaagtatcgttccaagatgaggaagcgtgctgcggcagagcgcaagcgcgcccaggaagagcaggcggagcgcgctcgtttgcgggagcaggagcttgcggaaattcgcaggatcgccgaatctcaggtgccgaccgatgttatgccggaaggtgagatccgtcaggcgatcgatcgcggcaaggccgaccgtgatgttgttgtaagtaaacgcaaggaggaaaccgaaacgaaatccgctgcggaaccgaacgttgtggatgcgcaagtcgtgccggataagaagaacggtctgtccatccacgatgagcgtgatgaaatcgccaaaaccgagggtgtggatgcatgcgatgcggattcgtccgcagtggccggcgcgtcgcaggatctgatttcgttctcgttgggatcgccacgcaacggtaacgatatcgcgccagccgctccggaaagcatggaaatcaagtccactcgtcaggtcgccaaggccgtgcctccgactgcgagtacggtttccgacaatgtcgagccgttgattgtgccgaccgacgcgatcagcagcatggattccgacgaggccgcagcccgtgtggaggctggtgtgcatctgcaggacgtggataccgtgggattccacgactccgaggtcagcgccgacgttgaggctcccagcgtcacctccgattccctgggtgtgggtttggcgtccatcatggcccgtcgcggggcgtgacggagggaaagcgaacgcacgaaacgcacgaaacatacgaacaagcgtaaagaacatcagcctgaaaccgcatggtttcaggctttttcgtatattttgctctcagcgttagcactcgagttggcagagtgctaataatcgcgctaggatatgtttcagcgcgaaaggacgacgccgtaagtgatcgtcagcctcttgctagcgggtcccggcgcggtaagtaacgatttctcttagaaagaggaggtccacagtgtcgatctcactcacaccgttggaagacaagatcatcgtcaagcaggcggaagctgaaacccagaccgcatccggtctgttcattccggacaatgccaaggagaagccgcagcagggtgaagtcctggctgtcggtccgggccgtcgcaacgacgccggcgagcgcattccggtcgacgtcaaggtcggcgacaaggtgctgtactccaagtatggcggcaccgaggtgcactatcagggtgaggattacctgatcgtctccgcccgcgatattctggccattctcggctgagcgtagcgcgtagctgtttgaagaccccgtcagcgaacgattggtgaacaatcgttgcgttggcggggtcttgttgatttcaagcacttggggttcctgcaataggccgtgcgcagccgatgtatgccgtgttcattggcgttggcgtgctggtgttggcgtcgctgtccagatggtctgcagggaaggttcggaagaaatactcgtgttttttctttttggaatttttttcgggaggatttgctctgattgacaccgacatgtggctgatagtgagaaatcgttggaatttcaacgattttgagactttttggcttccgcgacacgccgtatttgcgttaatcgcatgatctgtggcatactaaacgggttgccggttggggttcaaccaaacaggcagcacggcggatttcccaagcggtcaaagggaactgactgtaaatcagtcgcctcgtgcttcagtggttcgaatccactatccgccacgcctcgatagctcagtggtagagcacttccttggtaaggaagaggtcgtgagtccgattctcactcgaggctctcatggcgggatagctcagctggctagagcgtacgactcataatcgtaaggtcaagagttcgagtctctttctcgctacaaaggtcgacggaacgtcggcatagcaacgaaccacaagaggtgaacttaaatggcaagcaagagcgccgacattcgtccgggcatcacgctggcatgcaccgagtgcaaggagcgtaactacatcacgacgaagaaccgccgtaacacgccggatcgtcttgagctgaagaagttctgctcccgctgcggcaagcagaccgtgcatcgcgagacccgctgagcgagttcaaagctttatgaaacccgaccaatatggtcgggttttttgttttctttcaaccttttcttgacacctttccaactgccttccccgcacgctaagctaagcatcatgaccaatttcgcagatctcacgaccatcgccgtaggtgggccaatcgcatcctttatcgaaccgacctcgcgtgtcggcgttatcgaagccgtcgaggatgccgacgccaaaggattgccgctgtgcgtgatcggcggcggatccaatatgctcgtggccgacacgccgttcgatggtgtcgtggtgcgtgacgcgcgacacgccgtaagcgtgcttgatgaggcggctcccgtcgaaaacggcgaaaaaatcgtgcatgtcaacgccgaagcgggttgcaattgggatgatttcgtcgactactgcgtcaacctcggcttggagggcgtggaaggactttccggcattccaggcactgtcggcgcgtcggtcgtgcagaatatcggcgcatacggccaggaagtcgcatccagcgtcgaaagcgtggaggtctgggatcgcaaaaacaagcagaccaaggagctcaccaatcaggaacttcatttcggctatcgcatgagcgcgctcaaagcgagcatgtacagcgctccggcaacgcctgcggccgacttcttcccgacaccgcgctacgtggtgttgtccgttactttcgcgctgcatcacagcgaaaccggcgtagttggctacggccagctcgccaaagcattgggcgtggaagtgggcgaccgtatggcgaccgcggatattcgcaacgccgtgttgaaagtacgcgcctccaaaggcatgcttgaagattcccatcgatatctgaccgaagccatgcgaggcaccaaaaagagcgaactggtcgccatcgcgcatgacgcacagcgcacgcagacaggcaacgatgaacccgactacaatcgccacagctgcggcagcttcttcatgaatccgattctcaccaaagaacaagcggcaaagcttcccgaagacgcgccacgattcgacgcgaccttgccggatggcacgccgggcgtcaaaacatccgcggcatggcttatcgatcatgcgggattccataagggctacaaaaccagcggaaatgccgcagcggggctttcgaccatgcatacgctggcattgaccaaccgcggcggagccacagctgcagatatcgcggaacttgccaaaaccgtgcaggatggcgttgaacgggcattcggcattcgtctcgttcccgaaccggtcgtcatcggcatgagccttaagtaaacgtaagaacgaagggagaagggaaacgcaatgaacgtattacgtaagaaatccgtcgagcagacgctggcggaaacagaggagtcggggcgctccctgaaacgagacctgacctggtgggatttggccattatgggcgtggccgtggccgtcggcgcgggtatcttttccatcggcgcgcaggcggcagccttccatgcgggtccggccgtgatcatcagtttcctcatcgccggcgtggtatgcggtgcggccgtaatgtgctacgccgaattcgcgtccatgattccggttgcgggatccgcctacaccttcacctacaccaccgtcggtgagatcgtcgcgtgggtgatcggctgggatttgatccttgaaatgctgatggcaggctccgtcgtctccaaatattggggcgtctatctcaacgatttcttccgacttgtcggatggaatatcaataccaacgtcaccatcggatcattcaatttcgatttcgcgccaatcatcgtcgtagctttcttcacggcactgctggtgtgcggcacgaaaatcggcgcacgggtcgacggcgcgcttaccatgctgaaaatcgccatcgtgctattcgtggtaatcgtcggattcttctacgtcaaagccgagaacttcaccccattcattccaccgagcgaaccggcgaccgccaccggatccgggttggccgcaaccatggaacagccattatggcagtgggccaccggcatgacccccagcatttacggcattgccggcatcatctccggagccgcgctcgtgttcttcgcgttcctcggcttcgatgtggtcgccaccacttccgaagaaaccgtcaatccgaagaagaacgttccgctgggtataggcgtgggcatgggactgatcatcgtgctttacaccctcgtcgccatcgtcaccaccggcatggtctcctacaaagacctcgccaagcagaaagatccgtcgcttgccacggcattcgaaatggtcggcgctgactgggccgccaaaatcatcagttttggcattgtgatcggcctggccaccgtggtcatggtgctgctgctcggcctgacccgcgtggtgttcgccatgagccgagacggcctgctgccgcgctcgctcagtcacacgggcaagcacggcactccagtgcgtctgcagattgccgtcggcgtggtcatggcactcatcgcagccagctgcaacgtcagtatccttgccgacatggtgaacatcggcacgctgtcggcattcacccttgtttcaatctctattccgatcatgcgcaagaagcgccccgacctgaagcgagtcttcaaaatccccggcaatccatgggtgcctatcctcatcgcgctcgccaacatctggctcatgctcaacctgagcgtgctcacctggattcgattcgtggtctggcttgcggtcggcttctgcatctacttcggctacggctaccgccacgcccgacttggtacgggagagctggaagttggcaatcaagagtagtcttgaacggtaagtgttaaggaggtaaccatgccatacgttgtcgctcagccgtgcgtcgatgtcaaagacaaggcctgcgtggacgaatgcccggtcgattgcatctacgagggctcccgttccctgtacatcaatccgaacgaatgcgtggattgcggcgcatgcgaaccggtgtgcccgactgaagccatcttctatgaagatgatctgccagacgagtgggcctggtacaaggatgccgcagtcagcttcttcgctgaagtcggcgatatgggcggcgcttccgcagccggcccgatcggtaaggatccggagcaggtagctgctctgccgccgcaaaatcagtgatcggcatttgaaagcggccttttcccgttggaagaggccgcatattttttgtttatagaggattataaggagttttcacgatgggctttcatgagttttcttcgccatacgattggtcgcgtatcgcagcatacaagcgcacggcaaaagccgcgttcggaggcatgatcgacctgtccgtgggatctcccgtcgatcccgtgcccgactcggtgcgcaaggcgctcgcagtggcggcgaatgatccgaatgcgtatggatatccggctactgcaggtactgccgatttacgtgctgcgattgctgaatggttttcggcggctcgcaatgttgatttgcaggcgatccatgctgatgtggtgcctaccgtcggctccaaagagggtgttgcgttgatggcgtcgctactgcatttcggtgaggatgatgttgtggtgcagccgaaggtttcgtacccgacgtatgagatcggcacgcagttggctggagcgcaggtgcttaaggtcgacgatgtggctgatgttgcgtcgtggcgcaatgtgcccggcgtcaaagcggtgtgggtgaattccccttgcaatccgacgggcgaggtgtattcggccgagcggatggctggcattgtcgcagctgcgcgtgagatcggcgcggtggtgctttccgacgaatgctatgcgctgatgcagtggaggggtgctacgaatagtgctgatgatgatccgctgcaatcgacgccgtgcgctttgcgaagtgatgtgtgtgcgggttccgctgaaggcgtgctggtgctgtattcgttgagcaagcagagcaatatggctgggtatcgtaccgcgttcattgccggagatgagtctttgattgcatcgatgagtgcatatcgcaagcagattggtcagattattcccggtccggtgcaggctgcgatggctgccggactgcgtgatctggaatccgtcaaggttcagcatgcgcgctatcgggaacgtctcggcgtgttggtgagcgcgttgcgtgcttacggatactgcaccgacatgccggatggtgcattgtatgtgtgggtgagagccaagtcgggcgattgctggaccgatatggagcagcttgccaagatcggcatcatcgccagccccggcgagttctatggtgcgccggaatgtctgcgtttctccgccactgccagcgacgaggcgatcgcttccgctgctgaacgtttggcgcgctaagccgatatgcaaaagggcttccggcaatcgctggaagccctttatcggcggagtcagagggagtccaacgcccatgcgtcttatggctatgcgcagctgttgatgtcgctgatccaggagtggcgtgcgctgttcaagcgtccggaactaccattcatattcgcccaattgccgaactgtactttggaacccgattgcgattggccaaggctgcgtgataaacaacggcgcgctttgacgttgcggaacacggcgatggtggtgacgatcggatatggagaggacaatgacctgcatcctttggataagcgccatatcgcgcagcgcttgacaacggctgccgagtcgttggtttatggacgtgattgcgagccgatggggccgcttcctgtcatggcgattcacaaggatgacggcattgagatctccttcatccatacgggagggggattggtctgcacgggcgacgtgccttttgacatcttggagccgggaggctcgatatatcgggtgaaggcttgtcggtacgattgccatggcggtcacggaaccgggcgtgcgagtggcgcagtgagagagctctccccagtacagtgtcagtttgtcggccaatgaagcatcgatgataacgctattgccggggacagcgtaaatagttttcgcagttaatcgtgtttgggcggaagcctgtaatttcctgcttttggaatacttaaatctattcgaaagtttcgtaaatatttgcatatagaactttcgtaacaaaaattttaagtatttagttaagtgacttgactttcttgaaaagcaagtcatataatcaagcaatgctttgactgaaatgctaaagcatttacgaaacatgaagatgtgtgttcgtgcatgtcgccaaaggagaaagactttgtattcccacatccgatattggataaggagattcagcaatgaagtttgaataccatgtcaaaccaaccggcagcgatgctgcgtgcggcgacgcggagcatccgttcgccacgatttccaaggccgcgcagatggcctctccgggtgatacggtaatcgtgcatgaaggcgtataccgcgaacaagtcgatccgaaacgcggcggtctgagtgaacatgagcgcatcacctactgcggagccgaaggcgaagcacggccggttatcaaaggctcggaatgcgtgcagggctggacggaattggccgatcatccgcatgtgtggacggtggtgcttgataatacgatgttcggggatttcaatccattcgcgaccccgattttcggtgactggctggaaatgcccaagttcggcgaggatccggacaaacatcttggcgatgtgtatctcaacggtgtttccctcttcgaatcgacgacgttggaaggcgtatgcgatccgcagccgcgtgatacggatgaggatttcgcgttgaagattccctgccctgtgccggatgtggaccgtacacgttatgtatggcatgccgaagtggacgagaatgccggcaccacaacgatctgggcgaatttccaaggtgccgatccgaatgaggaactggtggaggtcagtgttcgtcgcacatgcttcttcccttcccgcaaccatgtcaactacatcaccgtgcgtggctttgaaatggcgcaggccactggagattgggcgccgcctacctcgcagcagtggggcatgatcggcccgaactggtcgtatggctggatcatcgaagacaacgtgctgcatgacgccaaattctccgcggtgtcattgggcaaggaaatctcatccggcgacaacgagtgggcgaaaaccgagcgcaagaccggttaccagtaccagttggaggccgtgttcaaggcccgtcgcatcggctgggaaaaggggctgatcggcggtcatatcgtacgcaacaacgacatctacgagtgtggacagaatgccatcgtcggacatatgggcagcgcattctgccgtatcgagcataaccatgtccatcacattgcgttgaagcgtgaattcttcgggtgggaggtcgctggcatcaaattccatgccgcattggatacggtcattgccaacaacaacatccacgactgctcgctgggcatgtggatggattggcagacgcagggcacgcgcatcacgcgcaatgtgttccacgataacgtccgtgacctcatgattgaagtgagtcatgggccgtatctggtggacaataacgttttcgcctcgccggtgatgttccagaactggtcgcaaggtggtgccttcgtcaacaatctgatttgcggcggcattgaaccgcataccgtccccgaccgttccacgccgtatcactatccgcacaccaccgaggtggccgggtgcgctgtggtgtccggcggcgatgagcgttggctgaacaacatgttcgcgccgcaaccggtgaaaccgactgtcggtgaatatggtttgtccgcctacggcgattgcccgatgtcgatgcatgaatacttggaacgccagcgggccatgtgggcagatccttcgcagggtggtggcgagcgcaatcctctgcagtctctatacgcgggcggcaacatctatctgtccggcgcacaggggctgaacaagcaggaaggcacagccgacgattcggagcgcatgcaggaggacgccccgttcttcggcggcaccgcctccacgagcgttgcgtgtgatgagcccatgccggtgacattggtcgaagaacccgatggactgtacctgcggtgcactgtgccacaggccgtcgccgataccaggatgcaggtcgtcaccagcgatatgctcggcgtgcctcgcatcgtggaggaacgctatgaacagcccgatggcagtgactatgtgctggacactgacttgctggaacaagacttgacggcaacggaacgcaaggccggggcgttgaatggtcttgtctccggagagaatcgcatccgaatctgggaatggaacaactgatatgacaaatgcaaccgataccagcaagacattgggcgagtccatgttcgcacagtgcggatatgcccaagacgccatcgataagcgcgtgtcacaggtctggcatgaaattttcgaaggtccgaacaaattctattgggagaacgacgaaggtcttgcctatgtgatggacaccggcaacaacgatgtacgtaccgagggtatgagctatgcgatgatgatcgccctgcaatacgaccgtaaggacgtattcgacaagctgtggggctgggtaatgcgtcacatgtacatggaggacggtcatcatgcgcattatttcgcatggtcggtcgcgccggacggtacgccgaactcgaatggtcctgcacctgacggcgaggaatatttcgcgatggacctgttcctcgcctcccgtcgctggggtgatggcgaggatatctacgaatattccgcatggggacgcgagatcttgagatattgcgttcataagggcgaacgctacgacggcgagcccatgtggaatcccgacaacaagctcatcaagttcattccggaaaccgagtggagcgatccgtcctaccatctgccgcacttctatgaagtattcgccgaagaagccgacgaagaagaccgtccattttggcatgaggcagccgccgcaagccgtcgctatctgcaggcggcctgcgacgagcggaccggcatgaacgctgaatacgcggattatgacggaaagccgcatgtcgacgagtccaatcattggcatttctattccgacgcctaccgtaccgcggcgaatatcgggctggatgcagcctggaacggtccgcaggaagtgctgtgcgaccgcgtcgccgcgctgcagcgattcttcctgatccacgaccgtactagcgtctacgccatcgacggcaccgccgtggacgaggtcgtgcttcatccggtcggattcctggccgcgaccgcgcaaggcgcacttgcggcggtgcattcggcccagcccgacgcggagcataatgcccgtgaatgggtgcgcatgctgtggaatacgccgatgcgaaccggcacgcgtcgttactatgacaatttcctctatgctttcgccatgctggcgttgagcggaaagtatcggtatgaatgatgattacctcaactaatcctatggtctacacggattttcctgatccagacatcatccgggtcgggggcgtgtattacatggccactacgactatgcatttcacacccgggtgcgatattctgcgcagctatgacctagtgcattgggaattcattgcgcacgcattgaatatcgtggcggatacccctgaagaacgtttggaatgtgaaggtgccaacgcctacggtcgaggcatgtgggcgccgtcactgcgttaccatcggggcacctggtatgtgttgttcgccgccaacgatacgcatgtcagctatctgctgacggcggacgatccatgcggcccatggcgaaagcgtgagcttgacggcttctattacgacagcggactgttctttgacgacgatgatcgagcctatgtcgtacatgggcagtcgacattgcgcatcacggagttgaatcctgaattaagcgggccgatgccgggtgggctcgaccgggtcatcgtgcaggacgatccgcaggctgaccttggttatgagggcagtcacctgtacaagcatgatggacgctattacgtcttcacctgtcacttcccgcaaggcaaaggcaaaacagaagcctgcttgatggccgaatccttggatggcgctttcgaagtgcgtgaaattatcgaagacgacctgtccttccacggttacggagtcgcgcaaggcggtatggtggacactccggacggcgactggtatgcattcatgatgcaggaccgcggcggtgtgggacgcgtgccgatactgatgccgatgcggttcggcgaggacggattccccgttgtcggcgagaacggcaaagtgccgcagtcggtcagcgtgccggctgcaagctgtgccgaacctgtcacgcccatcaacggcagcgaattcatagcccggcataacgccgaaggcggagtcgatgccaactgtctgcagccatactggcagttcaatcacatcccacataacgaatactggtcactgacggaacgtccgggagcattccgcctgcattccggacgcatcagctcgaatctcaatcatgcatggaatacgctgacgcagcgcacgatggggccggtgacggtggccgaagtcaccgtcgacgcgtcgacattgcatgatggcgacttcgccggattggcggcgttccaaggatgctattcctacatcgcgcttacgcgaaggaacggccgcacgatgctgaccgtccaatacaagccggcgaatgacgattccatcttctccgacgatgattgggacagtccagccgtaacggatgcggaaatcatggcggatgcggattgcatgcgcctgcgcgcggtatatgatttcaccgattgcaaggatgaagtgacgttcttctaccgcgatgcggatacgccggaatccgaatggtgtccattggggacagcgcaccggatgatcttcaaaatggatcatttcacaggttgccgtatcggattgttcctgtattcgacaaaagagaccggtggaatcgccgatttttgcgactttgcgtattcgacgccggatacgaaggaaagagagcaatgaagcgacaggtcatagtggcgcaaggaactgtcgaaggcttggcggctgaagatcagggcatcaccgtgtttcgaggggtcccgttcgcccagcctcccgtcggcgttctgcgctggcgtgcgccgcagccggccctgccatgggatggtgtgctgcaagccttcgatttcgggcctaccgcgatgcagccgacgccgggcgcctccgatgatttctatgatcgtgaatggggtaccgatccggctgtgccgatgagcgaggattgcctctacctgaatatttggactccggcattacgcggatatggtgcggatagcatggtagtctccgaaaagctgccggtcatggtctggatctacggcggagcctatcaatgcggcggcacatgtgaaaaggaattcgacggcacacgtctcgcagcgaacggcgtcgttgtggttagcgtggcctatcgtctgaatgcatttgggtttatgacgcaccctttgctgcatgaggaggccgtagaacgcggcgacggcgaaccatatgcgaatttcggattcctggatcagcgtgccggaatccaatgggtgaaggaaaacatcgcgaagttcggcggagatccggaaaacatcacggttttcggtcaatcggccggtgccgccagcgtcttggcccagatctgctcgccgatgaatcatggcctgtttcagaaagccatcatgcaatccggcgcaggcctagggtatttcaatgcgcggcaggacacgctggagcatgcgcaggccaacggaatccgtctgttcgaagcattgggtgtctccacgctggagcaggcccgtgcaatcccggcccgaacggtattggaagccgccgagtccctgcctgttccaccggacagcggacgtgaagatgactggtcgatgatcgtcaattgggtgccatgcgtggacggcctgttccttcccgatcaggaggagcgtatcgtcgagggctgcaaggccaacaacgtcgacatgctggtcggcaacacgaccaatgagttcatcgcttcgactgaagatgggaagcctgtgcatgtcggccagctcggcaatctcacgctgatccgcaaatggaccgcaagcggtgggaccgcgccatactactatcatttcgatgtcgctatgccgggggatgatgccggagccttccattcgtccgatctgtggttctcctttggaagccttgcgaaatgctggcgtccgttcgttggatggcattacgatctggcaaggcgaatggggctgtactggaccaattttgccgccaatggcgatcccaacggaacggaccgtgacggaacgccgcttcctgtatgggatccttgcatcggtgaggaatgccccgccatgcatttatgccaagaaccgggcatgcggacggattggcttaccgaaacggatcgaaaagcattcggcctgtgacggcatgccgttgatgtataaatactgatatgtaaacagggacggtctttgtggatcgtccctgccgcataatggtttgccgttgcgcgtgcaggaggatttcgagactgattatccgacttttcaccgtttccgtaggctggttcgtcggtggcgcctcgcggaggctcagagcatcaaagaccctgttcggcgtcgtgcggcttattgtggggctaggagttgtttgaagtgtcctaggccggatatttcgccgtataggggcgtttctgcgtggattccgtcggatgtggcgtctcaatcgttggacgtggcggtgagcgtgaacgggggtgattatgaggaagactgaactcccccccgctcatgactagcgcggacactatggcgtatgtgcagtgcagtcgtcagctgtcttgttgggtactcaacttgggtaccttgctgggtaccggaaatgttgacattgacgtacatttccgtacattctctgtttgtgccgtatgccttgaaatcgttggtattccgccgttttggcatgaaaaaaagggcttccggatttctccgaaaaccctcaaggcggagtcagagggattcgaaccctcgagccgctaaaaacgactaacaccttagcagggtgcccctatcggccactcaggcatgactccactgttttaccgttttcacagcgcaacagcatgcaactataccatccatttgcgggcaaaacaccatatctcgcaaaaaagatgagaaaacgttgaaatttcaacgaaaatacgtattgtgggattgtgctgccatgctggtttcgggtttgccgacacgccgttgcgttaaggtgcggcactatattcgaacatttgtttcaatatcttgcgaaaaacggttatcatggaaccatgagcaccgcaccgagaatcgcagcagccaaacgtgactggggtcacgacgaggctggctgcacggtgctgcacatcgacatggacgccttctacgcatctttggaggtggcgaggcatccggaatatcgcggcaagccggtgatcatcggcgtgggcaaccgttcggtggtgtccgcagccagctacgaggctcgccaatacggcgttaattcggccatggcgagttccagggcgcaaaagctctgcccgaacggcattttccttccggtcgacatgcgctactatcgcgcgatgtcgcatcgcattttcgaggaagtgttcagtcggatcaccgatcgtatcgaacaggtatcggtcgatgaatgctatatggacgtttccggggcgctgttgcggtgggggagtcctcgcgccattggggcgtggattcgcgaacaggtggtttcgcgttacaacgtcacctgttccgtaggcatcgcggcaaacaagctggtcgccaaaatggcatccaccaatgccaagcccaacggcatgcttatgattcctgtggcgcggcatgcgcaattcgtgcagatgatgccattgcgtggcatccccggcattgggccttctttggagaaacgactgaatgcgtggggcgtcaactccgttgccgatcttgcgcgtatgagtcttgaatcgttggaacaggctactggatcggctatttccgcgcgtgggctgtatcaggcggcccgaggactggatggtagacccgtcgtgccgtatacgcaggaaaaatcgattggcacggaacgcaccttcgatgcggatacgcaagacatgcggcaggtgtgctccatgctccgctggtgttgcgatgacgtggccacgtctttgcgcaggaggggtttcctcgctcgtaaagtcatggtcaaacttcggtttccggatttgagctacgcaacaaaagggcacacactgggctgtcctacggatgcggcgagcgtgctctacccgcaatgtgccaatctgctgctctccatgatgggcatggctccggagtctgcgcatgccatttcccttacgcgccccgtgcgtttggcgggaatgagcgccagtgggcttgtacttgccgaagaagctgtgattcagccttcgctggatgatctgctcgaagaaaacgaagtcgaacagcgtgctgaaatctccgtcggcagcgcccagtcgcagacgcattcggcgcgtttgcgtggcgcggaggcggcgcttgatgcggtgcgtcgaaaatacggtaacaatatcgccagcttcggggtgtagaagcaagggcatatccgttattcttgaagtgatgagttgagaaggtccagagggaggcaggggcgccatgaaatacaggaaagaggcggtgcacgcgaccaatccggaagtgcttgcggccggccgtcgcaaacttgtgtttgcggcattggcggtgcttgccgtcgtgcttgtggcgggaacttggttgttggtacatagtcttcaaccgaagcagaacgatgctgccgtgaagccggagacggcggtaagccagccgaaaacggttgaaaagaagcaggcgactgagcctgcggagcatcatggcaattctccggattgccccgacgccgactgcatcgccatgcttgtcaacggtgatctgctgttccacgaggggctttggaaccagtacgccagcaccaacaccgcggccacggatggcacggcattcgactttaccggcttgttcgagccgatgcgcaaatacattgatgcatccgacattgccgtatgcgaattcgaaacacctatcgcgcagcgaggcggtccatatacgggctatccggtattcaatattccggcagaagtggccgacgccgcgaaaaacgtggggtatcgcgcctgcacgcatgcgtcgaatcattcctgggaccaaggtgctgacggcatcgcgcgcttgtgggacacacttgatcaggatggcatcgcccagaccggctcctataaaaccgaagaggattcgtataagccgttggtcatcgattcgcctaccggtggcggtaagcttggtctgattgcgggaaccgtgtcgttgaacgcgcagacgcctgactacgactggcgtgtggatcgtctgcgtgaatccggagacccgaaccaccaagccgatatcgacagggcggtagccaaagcgaaggccgctcgcgagcagggtgccgatgtggtggccatagccatgcattccgtgcaggagtatttggattacgctgattcctggcagcaaagtgaggctcatgaactggccgataccggtgcgttcgacgtgatttatggcgctggatgccattgcgcgcagccggtcgagaattacaacggcacttggatcatctacggtttgggcaatgccgtgaccgaatcggccaatactgcggacacgttggtgaacaatcaaggcattaccgcgcgtattcaattcgcgggcaagaaaggcgtggccggttcgtggcgtgtcaaccgcattgactgggtgcccagtgccaacgaaacccaaggcaaataccaatggtgttcccttgcaagcgatcatcctgacggcacctgctgggacgaaacgcaagacgccaatgtacgccaacgcatctgggacgtgctctattccatgggcgccgatcagaacgtggtcaaggaatggaatattaccgcggagcaaacgagttcatctggccagtagttttccgtggcacaatatgcctcataccgtgagtcgcatatgcgtaagaactctcgaacatacaatgtgaggtgaaaacatggaaatctacgaaacccaaccggaacgcaccgatctgccactggtggtcatgcccgtcatcatcgaatcgatgatcgaaccgttcgaaaagaacttcgaactgctcaaagacattgcccgcgtgcgcatgtacaaggatttcacgcttgacgaagacaccatcgtcgaacgttgcgccgaagctgacgccatcatggtaatcggattccattgcgccgattccatcctcgatcggttgaacgccaaatgctatgcattcggcggcaccggcgtggccagttacatcgatctcgacaaagccaaggaacgtggaatccgcgtatgcaatgtggtgcactatggcgaccatgccgtggccgaacacaccatcgcactgcttatggaactcgccagacaggtcggcaaactcgacaggcaagtcaaaacaggcgattgggacggtgccgacggctacgagctgtacggcaagaagcttggcatcatcggccttggcggcatcggtcagaccgtggcacgcatcgccggagccttgggcatgaacgtgtccgcatggaactcccatgtgccggagcaggtgttcgccgatctgaatatcactccagtcaacgatatgaacgagctgattgccggttccgacgtggtatccatccatatgccgctgctggactccacaaaaggcatcgtcactgcggaaaacctcgaagctctgaaaccgggaaccatgttcatcaacacggcccgtgcggaaatcatcgaaccgggcgcattgctcgccagactccagcgaggcgacattcctgcggcgctcgatgtgttcgaacacgagccgctcactgccgacgatccgctctgttcgattccaggcatcatcctcaccccgcacaccgcgtggcgcaccgatggcgcctatgtgggcatcaccagacaggtggtccaatccgttgcggcattctgcaagggcgaggatttcaacgtcgtcgtgtgaataaccgcaaaaccggtatgggcaaaacatgtggacggtcggcgtgattgggtaggttgaaagacatgcagaccatactcgattccgccgatcagcccgcgcatgatgcgttcgtcgagaaaaaatcggaattcatcggcgacgcctgtcatatcgactccttggatgaggcgctcgcgtttgtgcagacgattcgcgaccagcatccgaaagcgcgtcatgtcgcctatgctgcggtgtgcggcggttccgacggtcgtttggccgaacgcatgagcgatgacggcgagccatcgggcacggcgggcaaaccgattcttgacgtgttgcgcgccaacgagatgacggattgcgtggttgccgtcacccgatatttcggaggtattctgctgggttccggaggcctgatccgcgcatattccacgggtgcgtccattgcggtcaaagcggcgaacaaagcgaagatcgtgccatgttgcgaatatcaggtgacgcttgactatccgcaattgggaagctttcagaatctgcttgcgtcagtggacggcgagcaggcggatgcgcaatataccgatcgcatcgtgctgtcaattatcgttccgcaggaacaatcgcagaaattcaaatcacgaattatcgaaacgttcaatgcgaccgtcacgccgcggcaaacgggcacgtccaatcgcccggtgcgatactgaaatccaacgatgacgaatggaatattgagcagaacataacgtaaggtggaacgcatgaccgaagatatgagctcgcaagacactactgccgtggaaaccgccgaaaataccgtcgaaaccgttgtggggaacgccgacgaacaagcatcaaaccaagaggttccttcggatttcgagcctttgaccgcaacctacgagcggttgcgtcactccacggatgccgccgaattgagcgaattcgcgcgccgtccgctgcctgaccgttccgaacaggccgctttctcgcgtgccacggcattgctggaagccgtcgccggcaatgcgcatacaccgttggaagatcgcgtttttcttgcggaaaccatgccgtttccgaatattctcgtcaaactgtccaccgacgaatccgttgaggtgcgcaaagctgttgcgggcaatgccaatgataagaattggctggtggggcgtctcaccaaggatgagtccctcgaagtgcgcgatgtcgcgttgcgcaacaagcagacgtcttggaagatgcggctcgaaggcgcgcaggatccgggtatggattccacggcccttgattttctgggatctttgggggtcgacgtcgagccgaatgctcctgccgtgcttgcttccatggtgcgtagggccgttgctttgaacccgaacacgtctgatcagatgttggaaaaacttgcgcaggatgcgtcaggagaggtgaaaagggccgctgaacggcatctttcggaaaaataattgcatacgttgtcatttttatgagatttttgcgcgtggtgcatgtgattggggcatagactgttgcttatgacagaacagaccgaaaatgcaacgcgtctagcccgtccgatcattcgcctggcaaagttggtgggtatcgccaccagttacgtcggcatgagccgcgactaccacgaaatcgaagacgatgttctcgtggcggtgctcaaggcgctcggaatcgacgcttccaacgatggggcgatcgagcagtccatcaccaccattcagcgcgaacgcgacacacgtatcgttcctccgaccgtgctgcacgttgtcggcaaggaaagcaaggttgaggttcacggcggagcgcttgacgttcctgaagcttccatcatgctggaagacggtggggcgtatgccggcaaaatcgagctcgagggtggcagcgataccgtggtcgaggtcgacggcggcttcgtgtgcacctcatatctggtgcttccggcagatcttcccgaggggtatcacacccttgaagtcaccgttggtggcaagacggagattgcaaccgttatcagcgctccggaaaagatcgagctgcttgacgacatgaaggaaggctccctgtggggctggatgagccagctctactccattcgttccagcggttcctggggtatcggcgactatgaggatctgaagaccctgctcgtcgagtccaagaagaagaccggcgccgacttcatgctgatcaatccgctgcatgccgccgaaccggtgccgccgatcgagccatcgccgtatctgccgatttcgcgccgtttcattaatttcagctatattcgaccggaatccatgccggaatatgccgtgctttcgccggaagacaaggcgaaagtggatgaactgcatgagcaggtcaagccgctcaacggcaatgcgcggatcttggatcgcgaaaccatgtggcgtaccaagatgcaggcgttgtggatcatctacaagtccggcctttccgcacagcgtcaagccgagttcgaccagtatctcgccgaagtgggcgatgagatcgaatcctatgccacatggtgcctgtgctacgacaagtggggcgcctcgaatggcagcgacgacgattgggtgcgcaagtacaatcgtgattccgaggaagtcgcgcggcttcgcgcacagtacccggacacgcttgaattctatcgttggctcgaatgggtcgccaccgagcagctgcatgcggcccagcaggcggcgcgcgaggccggcatgaagatcggcatcgtcgccgacatggctgtgggcgtgcatccggccggttccgacgtgtggtggaacccggagcgtttcgccaagggcgccacggtcggcgctccgccggacatgttcaaccagcagggtcaggattggagtcagccgccgctgaatccaatcgctctcgaacagaccggctacaaggtgtaccgagatatggtgcacggcatgttctccaatgcgggcgcggtacgtattgaccatattctcggcttgttccgcttgtggtggattccggaaggcaagaaggccatggacggcacctacgtgcattacgattctgacatcatgctcggcattctcgcattggaagcgtcccgcgccggtggtgtggtcgtgggcgaggatctcggcgtggttccggcatacgtgtccaagtcgctgtccgagcacggcattctcggttgcgctgtggaatggttcgagcagttcgacggcgaattccgtgcgccgaaggattggcgtccgtatgcgttggcatccgtcaacacgcacgatttgcctccggcagccggctacttggagtacgggcatgtcaaattgcgtgaacagcttggactgctgtccggtccggtcgaagaattccagaagtccgcggaagccgaacataacgccatgctgagcatgcttgtcgacgaaggctatctcgacgcttccgcgctggaagacgagcttgccaacgaaaacgagatcatcgacgcgctgtaccgcggtttgaagggatcgccatgcaagctcatggcggcgtccatcgtcgacgcggtcggcgaaaagcgcacgcagaaccagccgggcaccagcaacgaatatccgaactggcgtattccgctggctgacggcgatggcaatgtcgtgccgctggagcagttgttcgacaatactcgactgcaggagatcgcagcgattatgcgcggctgagcttgcagcggattgaggctgattgcagctgatttcgattggcggaaggccggcgatgcaaggtagggagacctgccaagcgtcgccggcttttgcgtgtcgattgctgtgtttccgtattcgcaagtactaggggttgatgtgttgcgaatgtcaaggctggcgatatactagtagattgttgtgtttccctacggggtccttcaaagcgcttttcccactcgccatcgaggactttcagggagcccacggataatgagacctgaaaaaggcatcattccgcgcctaaccaacgcagagatgttgatggaaggtccggaacacaatatatagaaaaggtacatcgtgaaaactttcactccgaagccagctgatctgactcacgactggtacgtcatcgacgccaccgacgtggtgctcggccgtctcgcttcccaggcagccatcctgctgcgtggcaagaacaagccgacctacgctccgcacgccgattccggcaaccacgtgatcattctcaacgccgataagatcgctctgaccggcaataagttgggcaaggaactgtacatgcactccggtcgtccgggtggcctgcgtcgcgatagctacggcaagctgctcaagaccaaccctgagcgcatcatcaagtccgctatcaagggcatgctgccgaagaatcgtctggccaaggtccagctggatcgcctccacatcatctgtggcaccgagcatccgtacgctggccagaagccgcaggttttcgagatcgctcaggtctcgcagcaggctaagtgaaccgaagggagataagaaacatggctgaaaacaccaacaactccgcggttctcgagaccgaagaggagctcacctcgtacaccaccgagaccaacgctggcgctggcaccggtacttccgctatcgctccgggctatggcaccggtcgtcgtaaggaagccgtcgctcgtgttcgcctggttccgggcaccggcaagtggaccatcaatggtcgcaccctggaagagtacttcccggccaagctgctgcagcgtgaggtcaactccccgatcgtgcttctcaagctcgaaggcaagttcgacgctatcgtcctcgttgacggtggcggcaccaccggccaggctggcgcaatccgcctgggcgttgcccgcgctctgaacgctatcgatcgtgatgcgaaccgcgcagccctgaagaaggctggcttcctgacccgcgacgctcgcgtcgtggaacgcaagaaggccggtctgcacaaggctcgtcgcgctccgcagttctcgaagcgctaaagctttacggcttatacgaaacccctcggaaattcgacttccgaggggtttcttggtattccagacggtattttgactggcgtttagatggttggcatctgcttcatcgcgctgatgctcaatgccggaagcgtccacaatgtcggatcatcttccgacagcccatcatcggcggattgcagattgtccgcatcgtctttcatttgccagtacatcatgttgatgcggtgcagatggttgcggagcctgcccgcgggcttgctttccgattcttcgtcgaattccgacacccgttcgatggacgttcccaatcccggatattcgccgacaatctccgatgaggaccagaccatctcccattcgatgtctttcggcagatgaaaacgcgtgacctcatcagaaccgttgatcagaatcagcagacttggctcgtcgggggatagcagctgcatggcgaacgaacggacggaaggattcgtccaatccgcatcatttggcatctgtccattcggcaaataccaatgcacgcgatcggatttcttcagtaaaccgatttcgctcaggcgagtgaagaaatcctcatgattgtacaaatcgcgggatttacgcaatgtgattaaacgggaagtgagattgaactgcttcaattccggcgtttgttcggtactgtacagccaatcccaatcaagccaggtggtgtcgttatcctgcgtgtaggcgttgttgttgccgttctgcgaattgccgaattcgtcgccggcaagcagcattggcgtgcctagcgaaagcagcagcgtacccagcaggttcatggtggcgcgttgccgttgctgcacgatgatttgatcgccgctggggccctcgtgaccgaagttgacggaatgattgtcgtttgttccgtcgcggttgttttcgccgttggcctcgttatgcttggttttgtacatggtcagatcggctgtggtgaagccgtcatggcatgccacgtaattcacggacgcggtcgaaccgcggcctggatcggtggcgaacaggtcggatgatccgcacaaacgtgtggccatctcctgcatggtcatttcgccgtattctccaccgcgcatgcgatccacgtcggtcagccagaatttgcgtgtgcaatcgcggaacctgtcgttccattcggcgaaggggatgccgaattcgccggtgcgccagccatttggaccgcaatcccaaggttccatgatcattttgagattgccaagcagcatgtcggagcgcaatgcatacaggaacggatggtagcgggtgaattcaccgtcgagacgtgccagcgtcgccgcgagatcgaatcggaatccgtcgatgcaatgcgtttggcccaatagcgcaacgaatccacggcgaacgtggtgacgtgcgtgttggtgaaatcaagcgtgttgccgcagccggtggtgtcgtacaggcggctgatcttatctttggtgcgtcgataatatgccagattgtcgagtccgcgccagcatacggtcggtccttccggaccggattcgcaggtgtggttgtagaccacgtccataatcacttcgaatccggcctcatgcaaggctcgtaccatgtcgatgacttcctggcgtactgcggccgcaccggcctcctgggagcgcttggtggcgtatgaggcttccggcgcgaaatagccgagcgtcgaatatccccaatagttgacgcgtccgcgttcctgcagaaacagttcggattgcttggcttgaatcggcagcagctcaatggaagtgacgcccaaatcctgcaggtaggagagcgtcgccggatgtgccaaacctgcataggtgccgcgaagctctttgggaagccaaggcgcgttggctgtgaagcctttgacgtgcagctcgtagatcacggttttgctccatgccacatgcgggtgtgatggctcaccgtcatgcttgttggtggcacgatcgtctatcgccacggaaacgggaacatgccccacggagtcgatggtgctcatcgggccgaatggcgaacctttgactttgccgttcacgatctcgcattcataggagaacgctccgggatcaagctccattgatccttcgatgcctttggcatatgggtcaagcagcagcttgtaggggttgaaactcacgccatgatcgggatcccatgggccgttgacgcggtatccgtattgcatgccgtcccatgcttgcggcacgtgcacgtaccacagtccgtagttggggccgtccatgcggaacagtgtttcgcgaagattgagcgaggggatgcgtctggtgcagatgcgctgttttttggcctggtcgatgaacgtgagtccgggttcgttgaacagccgtgcggcgtcggcatagaaggcgctcggttggtcaagtggttcaagtacgcaaaaccacacctggtctgctgtttctgagcggacaacggcgtccgcaccaccatcgtcggtgaaatagaggcctgggcgggttgcgtaacgatgcaaaggtgggttcttcataacctcattctaaacactttgaaattatctgttgacttactatgtcgaggctgtcgacgctcgtgccggtctgatccggccgtgagcttgaactcgagcaggtgcaggacttcctcgacggcaaaatcgccgccgcttccaaggctgtcgtcaaaatcggtgctgacgctgtttattcgtcctgaacagcctggaattagcaaaaaagcgtcacgatatgacggcaaatgcgctgccggcatcgccgcatagcgcatatcctaatcacaaaagggaaaaacgtatcgtaccaaccatcacaaggagggtattatgaccaaaccaatgtctgaattcaccaccgatctgcagcattccggcatgccggcgaaggatctcgacgaaaccattgaattctatacgaagaagcttggttttgaattggccggactgttccataacggcgaaaaccgttgcgcattcctgcgttacggccatctgaccatcgaaacgtgggagggggatccggctccgttgaccactggtgccatcaaccattgggcattcgacactcccgacatcgaagccgcattcgacaacgcgaagaaactcggactgaatttcaaagataacgaaatccatcatatcgacagcttctgggagcacggcattcgctacttcaatgtatacggaccgaacggcgaaaccatcgaattctgccagattgtcaaataactatcatgagatgattaccgtcaaataatcgctgaaaaaatacaacaagtgaaacagacggaagcgaacaaagaagcgtgcgttgaaccttatatacgggttcggcaacacgcttcttttgttatgcaagcgatgcgattaatgcgattaatatatgtgtaaaagcggtcacatatcgcatagttcgcgtacgtacggttccacaaaacgcagggccgcgccgataatgtcttgatggtcgagcgccatccccttgcgcagggtgaaatccgtggtgccgaatggcgtatgttccaccacgcgttcgcgcagtccggcaatatcgtcatcatcgagatattgtgctgcctcaccgctgatgatcacgtcaccggccagcaccgagcgaatgttcgttaccgccagcgccacataatccagccattgcgagaatcgtttgcggtgctcctgctcgccttgttccaataccgagaagaagccgggcaggctttcgccgtcctccatcagcgtttccggcgagcaatacgtgtccatgcagcctaattgcccgcaatagcaacggtttccgcctggaatcagcgtcatatgttcgattgagccattgcattggtttggcccttggtagagcgatccgtccacgatgaccgcgcctcctgggcgtcgttcgaggtagatgcagacggcatccttcagattgtggtcgaaccagagttccgccatggcagaagcgtcggaatcgtgaatcatcagcgacggatagttgaggccgtggctgagttcgctgagtttcaggccggtgttgcccatgattttgccgaaggtgatcgactgtccgtctgccgatacgatgccttgcatgcagaaggccacgccgagtaccgtgctgccttgtttcgccagttcttgcgcgaaatcgttgatgatgccattcatgcgctggtagtaggcgtcgttgttgcgataggggagtgtgcgctgtctggtggctacggatttgccgttcagatcaatggcgatggccgtgatttgcgtggtttggatgcgcacgccgatagctacgctggagtgtgccgcgaattcgtagatttgcgctttgcgtccgccggtggattgctgcatctcgcctttgacgatgagcccgtcggcctccatggcgcgcagattctgcgtgatggttggcaggctgagtcctaattcgtgttcgaacatctgcttggtggctgaaccttgggtgtagatgaacgcggtcatagccttgagattggcttctttgaccgatagggcggattgggctttcactggttgatccttcctgcgcaacttcttttccaagactacttcataaaagtcctttccttatgtctcgtgttggtctgaaataacgggtgttgcaaaaaagtataaaaaatggccgtgtataagggattttctaccacttttctgcgttgaaaatatgtttatcaacaaaaaagttgagacggtgacaacgacgttccaccaagaaaagaggcatgttatgaagataggtctgccgcgcacgctattggccggcttgatcgccatagcggtgttcatgaccggcgatggctttgaattgacctttttgtccaaatacatcgtggaccagggattcagctcttcgcaatcgtcgctgatgttcaccatgtacgggctgatggctgcgcttgccggctgggcgtccggtgtgctggctgaaatgttcggtgccaaacgcatcatgttgatcggcgcaagcgcctgggttgttttgcatctgctgttcgtcggtgtggcgctgccgagcggcgtctatccgctgatgctaggcgtgtatgcgttgcgaggtgttggctacccgctgttcatctactcgttcgtggtgttgatggcgcaaaccatcgatcccgccaagctcgcgtcggctatggggtggttttgggccgcctactcgttcggcattggcgtattcggcgcatatttgccgagtttcaccattccgctggtgggcgagtactactcgctgtggctttcgttgccgttctctatagctggactgctgatttgcctgctgctggtgccgaaaagcaagggtgctgacacctcttccatgagcaatgccgacaagctgcgcgagcttagtcgaggagccaccattctggtgcataatcgccaaattgcattggctgcggtggtgcgtgtgatctgcaatctgacgttgtatggctttcccgtcatcatgccgctctacttagccactaccaacaatggtggcggagcttggtttgaggtttcgcaatggagtcagatttggggattccagtttgtggtcaccattttcggcaatgtgttctggggtcgtatgggtgattcgtatggttggatgaggcaaatgcgctggtttggctgctggttctgtgtgatcggcacgctgggcatgtattacattccgcagtttttcggggcgaatatggtgcttatgtgtgctgatgcggttgttcttggattgggaatttccgctttcgttcctatgggagccgtgtttcccgcgttggcgtcggaacataagggtgctgcgatttccgcgcataatctcgcttccggcctgactacatttttcggtccgctgattgcgacggtgctgatttccactatcggattcggcggcgtgtgctggacgtatgcgatctgctatgcgatcggatcgttggccacgctcggcattcatcctcatcaacccggatttgacgatcgtggccatcgcattaccgcgatcgaacgtaactaatcgcaattgaatatcaattgctcaatcatcatcatttttctcaaaaacaccattatccacaaaggagaataatcatgaaggcagtcgttctcgaagagcagggcgtcatcaatgtacgtgaggtgccggacgcccccgcacctggtctaggcgagctgaagatcgcgccgcataccgttggtgtgtgcggttccgatctgcactattacacgcatggtcgcgtgggtaaatatgtggtgaggcagccgatgattctcggtcatgaggcttccggcacggtggttgaggtcggtcctggcgtcgaaggcttcaaggtgggcgatcgtgtggccatggagcccggcattccggatatgagttcgcgtgccagcaaactgggcatgtataacgtcgatcctgcggtgcgtttctttgccactccgccgattgatggctgcctgtgcgaaacggtgaaccatcctgcggcgttcacctacaagctgcccgacaatgtgagcttcggtgagggtgcgctgcttgaaccgttggctgtgggcatgtggtccgccaccaaggctcgtatcaagccgggcgatgtctgcgtggtcaccggatcaggcacggtcggcatgctgaccgcgtcgtgcgcgttggcgggtggcgcttccaaggtgctgatctccgatgtgtcggcaatcaaactggcgattgcggctcagattccaggtattattccggtggatctcaccaaggaggatctggtggagcgcgtccgcgaggaaacggggggctggggtgctgatgtggctttcgagtgctcgggctcgccgaagtcatacgagacattctggaagctgattgctcccggtggcgctgccgttatcgttggcattccggtcaatccggtggccatcgatattacggagctgcaggctaccgaggtgcgcatcgaaaatatcttccgttatgccaatgtgtatcagaaggccattgacctcgtggctaacggtaaactgaatctgaagccattcatcaccgacacctatgcgatggaggatgcccaggcggcgttcgatcgcatggccgagggacgtcctggagacattaagctgcagattaccgtgaaaaacgactgacgttacgcacgttacggaacgacgaaaggggtctgtgtcatgggtgctgttgcacaagtcaacgataatcggcatgggaaggtgtctttggctcagacctcttttggtggattcgtgccgaaaggtggaagtccgaacgattccggcgtattggagatcattgtgccggacgcgcaggcttcggtgcgttgggcgaagcatggctacccaagctcgttggcgaaatggcatcatcatcctcatattgaaattcatctaattcgggaaggtaccggattgatgatggcgggcaatgccgttgttccgtatgaggccgggcaggttgcgctgattggttcaaatcttccgcataattgggtgtccgacatcgctccgggggagcggcttcgtcagcgtgatgtggtgtgccatgtgcgtccggaaaccatgcgtctgctgatgtctggatttccggaaacgtctggttttgcaatggtgttgaaacgtgcggggcaggcattggtgctgagcggtgaatccgctcgtcaggccggttcgattctggaaaacatggaggaacatagtcttgcttgccgtgttagtgatctgattcgtgtgttggatgtgttcgcgcatgcccccgcagatgaatcctatacggtggttgcgtccggatacgatccggctgtatgccgtggtgcggaacgtgtggtcaatgatgccatcgagtacatttcatcgcatctgagcggtgaaattagcatggatttggccgcccgccaggccggaatgagcgtttcggctttctctcgtctgttcaaaagggctgcaggaatagggttttcggattttgttcgacgattgcgtatcgggcatgcatgcagattgctgacgaccacgaatcaaagcgtcgcttcgattcgtcgcgcttgcggatatggtaacgcttcgaatttcaatcgtcgcttctttgaagaaacaggcgaaactcctactggctggcggaaaaaatacattggacgaacaagataaataaatcgactttgtaaaagctcgatatgattgatatcatatagaaaatacttttataaaagatatggaggtgagacttgagaaagtgtgtgtgatttatgataaaaagcaacaaaaacgctcaaaatgatgtttttgaggctttttgattccataaaagaacgcaatctaaacattaaatgaacagaagataacatttctcttgcgacacgacacagtggaacatcatattacatactcactaaagtgtgtcctaggtcacaaaagaccagcaacgcgtccatccgcttcgaggcggatggaataacgggaaactactttgcaaacccccaaagaatcgaggaggacttcaagtggcagacgcaaagaaggaagagccgaccaagccgactccggaagagaagctcgccgcagctgaggctgaggtcgacgctctggtcaagaagggcctgaaggctcttgacgatttcgaaaagctcgatcagaagcaggttgaccgtatcgtcgccaaggcttccgtcgcagcactgaacaagcatctggtgctcgccaagatggccgttgaggaaaccggccgtggtttggtggaagacaaggccaccaagaacatcttcgcctgcgagcacgtcaccaactatctggccggtcagaagaccgtcggcatcattcgtgaagacgatgtcatgggcatcgacgagatcgccgaaccggtcggtgtcgtcgccggcgtgaccccggtcaccaacccaacctccaccgccatcttcaagtcgctgatcgcgctgaagacccgctgcccgatcatcttcggcttccacccgggcgcacagaagtgctccgtcgaagccgccaagatcgtgcgcgacgcagccatcgcggcaggcgctcctgagaactgtatccagtggatcgagcacccgtccatcgaagccaccggcgccctgatgaagcatgatggtatcgccaccatcctcgccaccggtggcccgggcatggtcaaggcggcatattcctccggcaagccggccctcggcgtcggcgctggcaacgctccggcatatgtcgacaagaacgtcgacatcgtgcgcgccgccaacgatctggtgctctccaagcacttcgattacggcatgatctgcgccaccgagcaggccatcatcgccgacaaggaagtctacgctccgctgatcaaggaactcaagcgccgcaaggcctacttcgtgaacgacgaagagaaggccaagctcgagcagtacatgttcggctgcaccgcatattccggccagaccccgaagctcaactctgtggtgccgggcaagtccccgcagtacatcgccaaggccgcaggttttgagattccggaagacgccaccattcttgccgccgagtgcaaggaggtcggcgagaacgagccgttgaccatggagaagctcgctccggtccaggccgtactgaagtccgacaacaaggaacaggccttcgaaatgtgcgaagccatgctcaagcatggtgcaggccacaccgcagccatccacaccaacgatcaggctctggtccgcgaatacggccagcgcatgcacgcatgccgcatcatctggaactctccgagctccctcggcggcgtgggcgacatctacaacgccatcgcaccgtcgctgaccctcggctgcggctcctacggcggcaactccgtgtctggcaacgttcaggcagttaaccttctcaacatcaagcgcatcgctcggaggaacaacaacatgcagtggttcaagattccggccaagacttacttcgagccgaacgccatcaagtacctgcgcgacatgtacggcatcgagagggccgtcatcgtgtgcgataaggtcatggagcagctcggtgtggtcgacaagatcatcgaccagctccgcgcacgttccaaccgtgtgaccttccgcatcatcgactacgtcgagccggagccgagcgtcgaaaccgtcgagcgcggtgccaccatgatgcgtgaggagttcgagccggacaccatcatcgccgtcggcggtggttccccgatggacgcctccaagatcatgtggctgctgtacgagcacccggaaatctccttctccgacgtgcgtgagaagttcttcgatatccgtaagcgcgccttcaagatcccgccgctgggcaagaaggccaagctcgtgtgcattccgacctcttccggcaccggttccgaagtcacgccgttcgctgtgatcaccgatcacaagaccggctacaagtacccgatcaccgattacgcgctgaccccgtccgtcgccatcgtcgatccggtgctggcgcgtacccagccgcgcaagctcgcatccgatgccggcttcgacgccctgacccactccttcgaggcttacgtctccgtctatgccaacgatttcaccgatggcatggcgttgcacgcggccaagttgatttgggacaacctcgccgagtccgtcaacggcgagccgggtgaagacaagatcaaggcccaggagaagatgcacaacgccgccaccatggccggcatggcattcggctccgcattcctcggcatgtgccacggcatggcccacaccatcggtgctctgtgccacgttgcccatggtcgtaccaactccatcctgctgccgtacgtcatccgctacaacggctccattccggaggaaccgaccagctggccgaagtacaacaagtacatcgctccggaacgttaccaggagatcgccaagaaccttggcgtgaacccgggcaagactccggaagagggcgttgagaacctggccaaggccgtcgaggactaccgtgacaacaagctcggcatgaacaagagcttccaggagtgcggtgtggacgaggactacttctggtccatcctcgatcagatcggcatgcgtgcctatgaggatcagtgcgctccggcaaatccgcgtatcccgcagatcgaggatatgaaggacatcgccatcgccgcatactacggcgtcagccaggccgaaggacacaagctgcgcgtccagcgtcagggcgaggccgccacggaagaagcttccgagcgtgcatgagtcgcttcatgtataggccatcagcagtgacctatatataaggtgcttgcgttatatcggcaagcatcatagataacgaggaatttggttggattcgttcaaccggattcctcgtttctttatataacgagagagcattttcggatgatgccggaatgacgatccgttacattcggcacttcgattcggggtttgcagcaggacttctgaccgcgacacgcgaggatttcttaagactacccctgatgcttaaataaagaagttgcctgattttagggctcgcaaattggaattaaaaaagcgagcgtggcacagtgatcacgagagtgaaaactgcatggctgcgcactgatgtggtatggccacggaacttccacggttccgggaggtcttctgcgccggtgccctttgagaagcaggctggtaaacagtaactaacgaatcgctagaaagggcggaaggcaatggcgggacagaaaatccgcatcaggcttaagtcctatgaccatgaggtcatcgaccaatcggcgaagaagatcgtcgaaacggtgacgaacgcgggcgcaactgtggttggcccggttccgctcccgaccgagaagaacgtgttcgtcgttatccgttctcctcacaagtacaaggattctcgcgagcatttcgagatgcgtactcataagcgtctcatcgacattgtggacccgaccccgaaggccgtggattcccttatgcacattgatctgcccgcagatgtgaacatcgagatcaagctgtaagggaggagggaaccattatgtctaatcgcaccgcactgttgggcaagaagctcggcatgtctcaggtctgggacgagaacggtttcttcgttcctgtgaccctcgttgacgtctccaccaacgtggtgactgctgtcaagtccgaagagtccgacggctacaaggctgttcagcttggctacggccaggttgacccgaccaaggtgaccaagccgcttgccggccacttcgccaaggctggcgtcaccccgcgtcgtcacctcgctgaggtccgcaccgataacgccgaagagttcgagccgggtcaggagctgaccgctgagctgttcccggagggcaccctggtcgatgtgaccggtaccaccaagggcaagggcttcgcaggcaccatcaagcgctggggcttcaagtcctatcgtcgtacccacggctctcacaagaacgagcgtcgtcctggctctgttggcgcatgcgctaccccgagccgtatcctcaagggcaagcgtatggctggccgcatgggtcatgtaaccaacaccacgctgaacctcaccatcgtttcgtcggatgttgagaacggcgtgctcgccatcaagggcgccatcccgggcccgaagggcagcatcgttctcgtccgttcggcagtgaagggagcctgataaatcatggcaaacgttactctgaacgttaccgataaccagggcaatgcaaccggaaccgttgaggctccggctgagatcttcggcttctccgccgaagaagtccagtcccgtatcccgctgatccaccaggttgtggtggcccagcgcgccgctgctcgtcagggcacccacgccaccaagactcgcggcatggtttccggcggtggccgcaagccgtggaagcagaagggcaccggtcgtgctcgtcagggctccatccgcgcaccgcagtggtaccacggtggcaccgtgttcggtccgcagccgcgtgactactcccagcgcaccccgaagaagatgaaggccgctgctctcaagtacgtgctttccgatcgcgccaacgcaggtcgcgtggcagtcgtggacttcggcgtttccgaagccccgtccaccaaggccgctgttgccgctcttaccccggtgaccgagaacaagttcaccaccgtggtgctctctcgcgagaatgtgaacgaatggctttccgttcgtaacatcccgaccgttcacccgatcttcgccgatcagctcaacacgtacgatgtggtcaccgctcagtacgtggtcttctccaaggaaggcttcgacgctttccttgctgcgaaggctgagccggctgcaaaggaggcctgattttcatggtcgctattcacaagcccgcacacgatatcatcctcaagcctgtcgtttctgagaagagctacgctctgtccgatcgcggtcagtacaccttcgtggtggccccgaacgcgaacaaggtccagatcaagcaggcaatcgaagagatcttcaatgtcaaggtgacgaacgtcaacaccctcaaccgcgccggcaagcgtcagcgcacccgcaacggtttcggccagcgcgtcaatcagaagcgcgctatcgtgaccgtcgccgagggccagacgatcgacatcttcggtaactgaaggctagccgagaaaagttaaaggaagaactagattatggctatccgcgtttataagccgacgactgcaggccgccgtaacgcgtccgtctcggacttctccgagcttacgcgttctacgcctgagaagtcgctggttcgcaaactcagcaagactggcggtcgtaactcttacggccgtatgacctcccgtcatcgtggcggcggtcacaagcgccagtaccgtctcatcgacttcaagcgttgggacaaggacggcgtgccggcaacggtcgctcacatcgagtacgacccgaaccgttccgcccgcatcgcactgctgcactacgcagacggtgagaagcgctacatcatcgctccggaaggtatcaagcagggtgacgtcatcgagaccggcgcccaggctgatatcaagccgggcaacaacctgccgctgcgcaacatcccgactggtaccgtggtgcacgcaatcgagctccgcccgctgggtggcgccaagatcgcccgctccgctggtgcagccgtgcagctcgtcgctaaggatggcgcttacgcccagctgcgtatgccgtccggagaaatccgcaacgtggatgctcgctgccgcgcaaccgtcggtgaggtcggcaactccgatcacgccaacatccagctcggtaaggcaggtcgtgcacgttggatgggtaagcgcccgatcacccgtggtgaatccatgaaccctgtcgatcacccgcacggcggtcgtacccgcggtggcaagccgccggtttctccgtggggcaagggcgaggttcgtacccgccgtccgaagaaggcttcgaacaagatgattgttcgtcgtcgcccgaatggtaagaaccgtaagtaagggagtgtcgagtagatgactcgtagcatcaagaagggccccttcgtcgacgcccacctgcagaagaaagtcgacgagcagaacgagaagggtacgcacaacgtcatcaagacgtggtcccgtcgttcgatgatcacccctgatttcatcggacacaccttcgccgttcacgatggtcgcaagcatgttccggtgttcgtcaccgaatccatggttggccacaagctcggtgagttcgccccgaccaagaccttcaagggtcatgtgaaggacgacaagaaggcacgccgctaaaggagagtaaggacacatggaagctaaagcaatcgctcgtcacgtccgcgtgacgccgcgcaaggctcgccgtatggtcgacctcatccgaggcaagaaggcgaccgaagccatcaccattctgaagttcgctccgcaggacgcatcccttccggtgcgtaaggtcctggagagcgccatcgcgaacgctcgcgtgaaggccgacaaggccggcgagccgttccgtgagaacgacctggtcgtgaaggagacctatgtggacgaaggcgtgacgctcaagcgtttccgcgctcgtgcacagggccgtgccgctcgtatcaacaagcgcaccagccacatcacggtcgtcgtcgctaacaaggaaggaaaccgctaaagatgggtcagaagatcaatccgtttggctaccgcctgggaatcactgagaaccatcgttccaagtggttctccgattccaacaaggttggcgaacgctaccgcgacttcgttctcgaagatgacgccatccgcaaggccatgagcaaggatcttgagcgtgcgggcgtgtcccgtatcgtcatcgagcgtacccgcgaccgcgtgcgtgtggatatccacaccgctcgcccgggcatcgtcatcggccgccgtggcgccgaagctgagcgcgttcgcgccaagctcgagaagctcaccggcaagcaggtccagctcaacatcttcgaagtgaagaacgcagcactggacgcccagctcgtcgcacagggcatcgctgagcagctgaccaaccgcgtgaccttccgtcgcgcgatgcgtaaggcccagcaggatgccatgcgtgcaggcgccaagggtatccgtatcaagctctccggccgccttggtggcgccgaaatgagccgttccgagttctatcgcgagggtcgcgttccgctgcagaccctgcgtgccctcatcgattacggcttcttcgaggccaagaccacttacggccgcatcggcgtgaaggtctggatctacaagggcgatatgaccgagcgtgagttcgaagagcagcaggcacagcagggcaacaaccgccagggccgtcgcggcgatcgccgtccgcgccgtggtcagcgtaacgctgcccagcagcagaacgcagcagcagaggctccggccgcagctgaggcacctgccgcaacggaaacgaaggagtgagctgagaaatgcttatcccaaagagaaccaagtatcgtaagcagcaccgtccggtccgccgtggtatgtccaagggcggcaacgagatcgcattcggcgatttcggtattcaggctcttgctccagcttatgtgaccaaccgtcagatcgaggccgctcgtatcgccatgacccgctacatcaagcgtggtggccgcgtgtggatcacgatcttcccggatcgtccgctgaccaagaagccgctcggcacccgaatgggttccggtaagggtactccggaattctggatcgctaacgtccacccgggtcgcgtcatgttcgagatcggtggcgtgtccgaggatgtcgctcgcgaggctctgcgccgcgcaatcgacaagctccctatgaagtgccgtgttattgctcgtgaaggcggtgacatctgatggcagtcggaactgcagactacaccatgaagaatctgaacgagaagaccaacgaggagatcgagggcttcctcaagaagtccaaggaagagctgttcaacctgcgcttccagtccgcgaccggtcagctcgaaaataccgcccgcctcaaggcggtcaagcacgacatcgccaggatgtacaccgtcctgcgcgagcgtgagctcggcatcagccaggcccccgaggcgaccgaaacgaaagctgaggagaagtaatggctgaagagcgtaacttccgcaaggttcgtcgcggttacgtcgtgtccgataagatggacaagacgatttccgtcgagctcgagcagcgttcgacccacccgctgtacggcaaggtcgtgcgttccactcgtacggtcaaggtccatgatgaacacaacgaggctcacattggcgacctcgtgagtattatggagactcggcccctgagcaagaccaagcgttggcgtctcgataccatcatcgagcgcgctaagtaaataagttcggcaaggctccgtgagtcaccccgcctgcttcaagcaggcaggcggggtgcttggggagaaccagctcggctaaggagaatcaatgattcagcaggaaacgcggcttcatgtcgccgacaacacgggtgcgaaggaactcctcgccatccgagtgctcggcggatcgaagcgacgctatgccggcatcggcgacgtgatcgtcgcctccgtcaaggacgccatccctggcgggtcggtcaagaagggcgacgtcgtcaaggctgtcgtcgtccgcactgtcaaggagcaccgtcgtgtggacggctcctacatcaagttcgacgagaacgccgccgtcattctcggctctggccgtgaaccgaagggcactcgtatcttcggaccggtcggtcgtgaactgcgcgacaagcgcttcatgaagatcgtgtccctcgccccggaggtgatctgacatggcagccaagattaagagcggcgacctggtcaaggtcattcgcggcaaggatcgcggcaaggaaggcaccgtcaagcaggtgctcaaggacgatcgtctgatcgttgaaggcgtgcagatcgtcaagaagcacgttcgcgctacgcagcagggccagcaggccggcatcgtggctgtcgaggctccgatccatcgctccaacgtgatggtcatcgatccggagaccaagcagccgacccgcgtgcgcatcgtcgaaaaggaagaggctcgcgacggcaaggtgaagaccgtgcgtgtgcgtgttgccaagaagtccggaaaggagctggcatgaccgataccactgtcgaagcgccggcaactccgcgcttgaagcagaagtacaacgagcagatcgtgccggagctggagaaggaattccactactccaacccgatgcaggtcgctcgcgtccagaaggtcgtcgtctccatgggcgttggcgccgctgctcgcgactccaagcttatcgaaggcgcagtcaaggacctcaccctgatcaccggccagaagccgaagatcaccaaggctaagaagtccgtcgcacagttccacctgcgcgaaggacaggccatcggcgcttacgtcaccctgcgtggcgagcgtatgtgggagttcctggatcgccttctgaccatggctctgccgcgtatccgcgatttccgtggcatcaacggcaaccagttcgacggtcagggcaactacaactttggcctcactgagcagtccatgttccacgagatcgatccggattcgatcgatcaccagcgcggtatggacatcaccgtggtgaccagcaccaaggacgacaaggaagctcgcgtgctcctgaagcacctcggcttccccttcaaggagaactgatatggcaaaaaccgctcttaagaacaaggcggccgctaagccgaagttcaaggtgcgcgcttatacgcgttgccaggtctgcggtcgtcctcactccgtctaccgcaagttcggcctttgccgcatctgccttcgtgagaaggcccaccgcggcgagctgcccggcgttacgaagtccagttggtaaataacgacgctgaaggtccgcggcccaatcgctcaatggagcgtgcgggcggcggaaaccacggcgagaaagggcaataagcccaaatgacaatgacagatccgatcgcagacatgcttacgcgtctgcgtaatgcgagcgcggcaaagcacgagaccgtggatatgccgtactccaagttcaaggcgaacatcgccgagatcctgaagcgtgaaggctatatcaaggacttcaccgccaaggaagccaaggtcggccagactctcgaggtcaccctcaagtacggtccgaacggcgagcgttccatccagggcatcaagcgcatctccaagccgggcctgcgtcgctacgcaaagtccgatgctctgccgatgccgctcggtggccttggcatcgcaatcatctcgactagctcgggactgctgacccagaaggaatgcctcgatcgaggcatcggcggcgaaatcgtcgctttcgtttggtgagaaaggagagctgaaacatggcatcgcatattggtaagctccccgtcaccattcctgctggcgtggaagtcaagatcgacggtcagtccttcaccgccaagggcgccaagggcactgactcctacgagattccggaaggcatcaccgctcaggtcgaaggcaacgagatcatcctcgttccggctgacgatctgcgtccgacccgtgcaaagcacggcctggctcgttccatcgtggcgagcatggtcaagggcgtgcacgagggttacgccaagactctggacatcatcggcaccggttaccgtgctcaggcgaagggcaagggtatcgagttctccctcggttactcccacaccattaccgttgagccgccggaaggtatcgagttcgaactgccgaatccgaaccaggtgatcgtcaagggtatcgacaagcaggctgtcggccagtgcgccgctaacatccgcaagcttcgcgctccggaaccctacaagggcaagggcatcaagtactcggatgaacgcatcctgcgcaaggctggaaaggctggtaagtaatgagcgtccagattttcggtaagggcaagaaggtcgcgcttcagcgccgtcacgctcgtctgcgcaagcgcatcagcggtaccccggagctcccgcgtctggtggttacccgttccaaccgtcacatggttgcccagatcatcgatgacaccaagggcattaccttggtgagcgaatccactctgatgagcgatttcgcaggtttcgaaggcaccaagaccgaagctgccaagaaggtcggcgaactgattgccaagaaggctcaggacgcaggcatcaccgcggttgtgttcgatcgtggcggcaacaagtatcatggccgcgtcgcagctgtcgctgaaggcgcccgcgagggaggtctggcactgtgagcgacaacgaaaaggaaacccaagtggctgaagaaactcagaacactcaggctgctgctgaagctaccaacgaggatcgcaagtcccgtcgtggccagcgtggtgagggtcgtcgtggcgagcgtcgcaaccgtcgtgaggaatctcacgagaacgagatgctcgatcgcgtggtgaccatcaaccgtgtgtccaagacccacaagggtggtcgtacgttcagcttcgctgccctcgtggtggttggcgacggcaacggcaccgtgggtgtcggctacggcaagtcccgtgaggtcccggctgcaatcgctaagggccagctggatgccaagaagcacatgttcaccgttccgcgcatcaagggcaccgtcactcacccggtgatcggccatgatgctgctggcaccgtgctcctgcgtccggctgctccgggtaccggcgttatcgccggcggtgcggtccgcgccgtcatggaatgcgctggcatcaccgacgtcctgaccaagtcgatgggctccgccaccgccgttaacgtggtgcgcgcaaccgtcgacgctctcaagaagctcgaagagccggaagagatcgcagcccgtcgtggcatgtccctcgaagaggtggctcctgactccctgctgcgtgctcgcgccgaaggcatcgccgaggctcgtaaggcccgtgaagaagcacaggccaaggccgctcagaaggacggtgagtgatgactaacctgaacatcaagctgcaccacggtctggtgaactccactccgaagcagcgtgctgcggctcagactctgggcctgaacaagattggcaagaccgtgacccgtgaagacacgccggccctccgtggccagctgctggtcctccgtcacctggtcaccgttgaggaggctgactgattatggcagatattctgcagatgcatgacctgaagccggctccgggcgccaagaaggatcgcactcgcgtcggccgtggtgaaggctccaagggtaagacctcgggccgtggcgacaagggcaccaagaagcgttaccaggttcgtccgggcttcgaaggtggccagctgccgctgtacatgcgccttccgaagctgcgtggcttcaagagcccgttcaagaaggaatatcaggtcgtcaacgttgctgctctcgcggaactgttcccgcagggtggcgaaatcaccgttgccgatctggtcaccaagggtgccgtgcgtgacggctacccggtcaaggtcctgggcgacggcgaggtttcggcagcctacaccatcaagggtgttaaggcttccgcttccgccaagtccaagatcgaggctgccggcggctccatctccgaggactgattccaaggaatgtagagctgactgaagcttgcaagtgaggcttctcccgcttagacgggggaggcctcacttcgttttggtccagtacggggaacaaaacgaaaacaatgcctcgaaatcttgtaaaaaaccgacaaaggatggaacactccacgtgtaggtagacgccgtacgctagactcgatcggtagagtctgttttgcatgggtgcgcaggcgcgcacgtcgatggaaggaatcccaggtgaggacgttaatccaggccttgaaaaccaaggagttgaggaacaagatcctcttcactcttggtatcatcatcatttatcgtattggttcgttcattccgaccccaggcgtcgactataaggtcgttcagcagtgcctcggttcgatggatagcacctccgaaaacttcattggtctggtgaacctcttctccggcggcgcaatgttgcagctatcgatcttcgcactgggcgttatgccgtacatcacggcatccatcgtcatccagctgctgcgtgtggtgattccccgcttcgaggcgctgcacaaggaaggccagtccggcgaagccaaactgacccagtacacccgttacctgaccatcggcctcgctgtgctgcagtccaccaccattctggtgaccgcccgctccggcgccctgttcaactaccggtgctctcaggttgtgcctgacggttccgtctggaacctcgtggtcatggtgctcatcatgactggcggcaccggcctcatcatgtggatggccgaattgatcaccgataagggtcttggtcagggtatgtccatccttatcttcatgtccatctgctccggcttcctaccgcagctttgggagatcggttggggcaccaaaggcaccgatggcaattgggcgaagtttgccgcggtcgtcggtgtgctgctggtcatcatgatcctcgtcatctacgtcgagctttcccagcgtcgtattccggtgcagtacacccgtcgtatgattggccgtaagatgtacggcggatcctccacctacctgccgctgaagatcaatatgagcggcgttattccaccgatcttcgcgtcctccattctggccatcccgaccctgatcgcacagttcggcaaatccgaccagtcctgggtcaagtggatcaactccaacttggccaacaccacttccgtgtggtacatcgcactgtacgcgttgatgatcgtgttcttctgcttcttctacacggaaatcaccttcaacccggacgaaaccgcggacaacatgaagcagtacggcggcttcattcctggcatccgcgcaggcagcgctaccagccgttatctgagctacgtgatgaacaggctcaacaccgtcggtgccgtgtacctactattcgtggcgcttattccgaccgtgctcatcatggcgctcgacctcaacaccaagctgccgttcggcggcaccaccatcctgatcatcgcaggcgtcggccttgacactctgcgccaggccaaggcccagaccgaacagttccagtacgctggattcctgttcgagggcactgaccacaaggaaggcaagtaaaacctcaaaatcgtgataccgtttcgacgtgaaacggtatcacgattttcatgtaaccaatcgagaatcagaaagcctcgcaagaggctcaatgaaacggagaataacatgcgactgctgattatgggaccgcagggcgtcggcaagggcacccaggctgcgctgctgagcgagcactacggtattccggcaatctccaccggcgatatcttccgctacaacatcaagaacaagaccgagctcggtgttgaggcactgaagtacatcgacaagggcgaactggttccggacgagctgaccaacaagatcgtcaaggatcgtctggccatggatgatgccaagaacggttggatcctcgacggctatccgcgcaacgcatcccaggttgaggcactggacgccatcctcgccgatctgaacactcctctggacgctgtggtggctctcgacgctgaccatgacgtgcttatggagcgcatgaagaagcgtgccgagatcgaaggccgttccgacgacactccggaagcaattgccaagcgtctcgacgtatatgccaaggaaaccgctccgttgctgacaacctacgaagagcgtggcctgctgaagaccttcaacggcgtcggctccgtcgaagagatccaggccaccatcgtggctgagcttggctgatatagctgaaaatcgggcagattcaaatcgtatgcaacgataagaaagcccaataaaataccacaaatcaatcgaaaacgggaattgcgacacgccgaacgtgccatagttcccgttttcgtgtattcttgcaagttggtgtgtcttcgggcacgcatagtaatcgccaaagaacggaacgaggctcatggctaaagacggtgtgattgaagtcgaaggacaggtagtggaagcactgccgaacgcgatgttccgcgttgaactcgagaacaagcatatcgtgctcgcaaccatctcgggcaagatgaggaagaactatattcgcattctgccgcaggatcgtgttgtgctggaaatgagcccttatgatctgaaccgcggccgtattacgtaccgttacaagtaaggtacacaagcaaaggaaaaccatgaaggtcagccctagtgtgaagaggatctgcgagaactgccgcgtgatccgtcgtcacggccgcgtcatggtgatctgcgtcaacccgcgccacaagcagcgtcagggctgagagcagatccagcggcataataagtacaggcgctgagtcacagatcgcgcaagcggtatgaaccccgggtacgcaggcccgggccgggaaaccggacgactcggtgcaagacctgcggaaaacagaaggaatcgcaatggcacgtcttgccggagtcgacatccccaatgagaagcgcatcgagatcgccctcacctacatctttggtgtgggtcgcactcgtgccaaggaaacgcttgccgcgaccggtatcaacccggacattcgcgtcaaggatctgacggatgagcagctgatcacgctgcgtgactacctcgagggtaactacaagatcgagggcgatctgcgtcgtgaaatcgatgcggatatccgtcgtaagattcagatcaactgctaccaaggccagcgtcaccgtaagggacttcctgtgcgcggtcagcgcaccaagaccaatgctcgtacccgcaagggcccgaagcgcacggtcgccggaaagaagaaggccaccaagtaataggtggctgtcagttcagaccacgagacgtaagtttcatcgcctgaacaacaaagcaaattcgttattaggaaacgagggtcaatggcagctcaaaagcaagccgcgcgcaagccgcgtcgccgcgaccgcaagtcggtcccggttgggcaggcgcacatcaagtccactttcaacaacactattatttcgatcaccgacccgtccggcgcagttgtgtcctgggcgtccggtggcgatgtcggtttcaagggctcccgtaagtccacgccgtacgccgctggtatggccgctgaatccgcagcccgcaaggctatggagcacggtctgaagaaggtcgacgtgttcgtgaagggcccgggttccggtcgtgaaaccgctatccgttccttgcagtccgccggactcgaagtcggttccatcaccgacgtcaccccgcaggcacacaacggcgttcgtcctccgaagcgccgtcgcgtctgagcactagaagaaatcatcaatccaacgccgcttatggccggtgagtgcaccaccggcctgaagctgaaaggataaccacagtgcttatcgcacagcgtccgacacttaccgaggaatctctcaaccctcagcgttcccgcttcaccatcgagcctctcgagcctggtttcggctacacgcttggcaactcgctgcgccgtaccctcctgagctccatccctggagcggctgtgacttcggtgcgtatctccggcgtcccgcatgagttcaccactctgccgggtgttgaagaggacgttaccgagatcctgttgaacatcaagggcatcgtgctcaccagcgaatacgatgagccggttgtcatgtatctgcgcaagagcggcaagggcgaggccaccgcgggtgatatcactccgccggccggcgtcactatcgccaacccggatatgcatatcgcaactctcgctgaagatggcgagctcgagatcgagttcaccgtcgagcgtggccgcggttatgtgccagcccagatgaacaagcaggataacgccgagatcggccgtatcccggtcgactcgatttactccccggtgctcaaggtgagctatcgcgtggaagccactcgcgttgaacagcgcactgacttcgacaagctcatcctggacgtggagaccaagccggcaatctccccgcgtgatgctgtcgcatccgcaggctccaccttggtggaactcttcggcctgtgccgcgagctcaacacccaggctgagggcgtcgaggttggacctgccccggtggcagaggaaaccaacccggagatggccgttccgatcgaggatctcaacctcacccagcgcagctacaactgcctgaagcgcgagggcatccacacgatcggcgagctggtcgcccacaccgagcaggatctgctcgacatccgcaatttcggtatgaagtccattgacgaagtcaaggaaaagctccagtccttgggtctggccctcaaggcttccccgctgggcaacttcgataccaacaacctcgaaggcggcactttcttctcgccggaagacgagtgattcgccgcttttgacctaaccgcttcgtcggattcggatgttcgggcgactgcccacctgagtccgacggggctttcaaggagaaacaatgcctacaccaaagaagggtccgcgtctggcctccagcccggctcatgagcgtcttatgctcgcgaacatggctaccagcctgttccagcgtggccgcatcaccaccaccctgccgaaggccaagcgccttcgtccgctggctgagcgtctgatcacgctcgccaagcgtggtgatctgcacagccgtcgtcgcgtgatgcgtgtcatccgcaacaagtccgtcgtgcacaagctgttcaccgagattgccgagcagatggagcagcgtgagggtggctacacccgcatcgtcaagattgctccgcgtcgtggcgatgccgctccggcagccatcatcgagctcgtcaccgagccggtgagcccgaagcaggctgtggtcaaggaagccgaagctgcaaccaaggttgccgctgaagaagctccggttgtcgaagaggcaccggttgaggctcaggaagccaccgcagagaacgccgagtgattggcatcaagcaggcttgactagctgatgaaaaggctgggaatcgaaaggttcccagcctttttgttatgcgttgtcatatgttgttatgcgccttttgttatgctcattgccgtgagattacgtatcgacttggcatatgacggcaccgatttctacggatgggcgaaacagcctgacatgcgtaccgtgcagggagaaatcgaacgagtgctgcataccgttcttcgtgtaccggaaggcgatgatgacgagccgctgcgcctgaccgtcgcgggtcgtaccgataccggcgtgcatgcgtcgcaccaagtttgccatctcgacatcaatgaggagacgcttgcacgttgcgtcgggcatatgcaggtcgaaccggtgatggcgttgaagcgacggctgcaacgcatgctgccgaatgacatcgccattcgttccatcgaggaagctcccgaaggattcgacgcacgtttctccgcactggaacgcacttacgtatatcgcattgccgaccgatcaagcgaaatcgatccacgtatccgcaattgcgtgctgcatatcgacgatgatctcaacatcgaagctatgaacaaggcagctgaaatgacgatcggcctgcatgatttcggctcgttcgcaaccccgaatcctggaggcaccaccatacgcgaggtgaaaaccgcgtattggcgtcgtataccgcagcatccgctgatcgacgacggaaatacgatgggggagcgatatcgcacgcctgcggtcgaatccggactgctgtgcttcaccatcgttgcggacgctttcgcacgcaatatggtgcgatcgctggttaatggttgtgtgcaggtaggcatcggcaaacgttccgtggattggttcgccgaaaaaatgacgacgccgttgcgtgaaggcagcaccggtccgatcgctccgcaaggattgacgctggaacatatcgaatatccggaagacgaccagttggcgattcgtgccgaagcgattcgtgcgaaacgtactttgtaagagcacatactgtacggatacacagaagattgcgctatacaatcgcaccaaatatcgcatcacaaaaccacatcacgcaatcgcaaaaacgcaaaaacgggatataaccgcgattacccccgtttgcttcgtaagtccatggatttcgtttccacggaaggcattgccgtcgtactgacgccgtggcgatacaattccgcgtttttcgaacatgcgtatctggcggaaaagacgggtgccgcgctggcgttcccagaagatctcgaagtcgttgacaacaaggtgtatttccttgattattccggcaaacgccatcgtgtgggcgtggtctaccgccgcctgtcggacgaatatcttgatccgttcgcgttcaatccggattccgtgatcggtgtgtcgccatgttggtctcaccgcgcgttatatcgccggattgttgggtggagagggcgccacgcatgcctgggtggaggtgtaccacaacgagcgttggatcggtcttgatccgacgcacaaccgtatggtcgacgacaactacatcacgatcgcgcatggtcgtgattaccgcgattgcatgctcgatatcggcattttctccggctgcaatgtgcagcagcaccagtgggtgaatgcttccgtgcacgagcaggagttgtaaataaaaaaaccgaagcgccgttgctccggtttttctacttgcggataaggcgagattcgaactcgcggaggggttcgccctcacacgctttcgaggcgtgctccttagaccgctcggacacttatccattgtgctacttgaaaacaagcaacttcatcattttgccacagctttggcgattgtcaaatccgattgagggatttttgcgatgtctgcgattgctcggcgtgtcttattcgcgggaacactgcgtcgcattgtgtgaagacggttgcgcggacagcgtacgcaagtctgcgctatgcgaatagcgcttcgtcgaatgccggataaccccagtcgagtgccagatccacgcggtcggcgatcatgctggcgagcatgcccagtgactgttcccgggagtcatccgaatggtcgtccgaggttgtttgggacttcgtcgaggcgttcgacgaagtcgagcttgccgcaacggctgcgatttcgctgcgcgcgcaattcatttccaggacggcatcggttggcgcgtacaagcccgttgcggaatccacgatggtattaggattggcgagcagctgcgtgacatcataggttttcgcacgattgtcttcggctccggaaagagaaatcaggcgttgcgaagtggttttatgacgatcgctgatgtcaagcgtcgcatgaccgaaggaacgcgcggcgaacacctccatcgcgaaccccacctgatcttccgcagcagccatggctgcaagcgaatccgtatcgacatcaagcgagtcaatgccatcgcatcgtgacagcgtgggctgtgcgatgtcaatcgcaagccgtgaggccatcaatctgacggcgtgacgggcctgcgcgctgcgcaacgtgccatcggcgaatcgcgccgggcaatatgccgcggtgttggcccaatctgaaaccgcctcctgcgcggcaagatagcgcatgacgatatggcgtgacctgtctgccatgatgtcggcgttggcagtcgcgtctgcatacgccctttcgcaaggacttggctgctgttcggcttcggcgcgacctgcgattcgaggagcggaacacgcggccagtgatgccacaagggcgctcgcgcacaccaagacgcaggcgcgtctgacagtcgacaaggccaaggggaaaaacggggagcgtgtctgcatgaaacattagactagtagtcgactgtgaccattgggccgagcgctcggaataacttcatataggaggtcttggaagtatggaactggacctggcaggaatgcaccagctcgcagctgggcagggaatcgatcccgagacgctggatgccgcactctcggaagcattgcgactggcatatctgaaaacgccgcacgcggcgaagcatgctcgtgtggagcttgatccgcgtgccggaagctttaccgtttgggctcaggatgagatccccgtcgagccgaccgaggataacccgcaccctgcgccgactctgggcgaggaatatgatgacaccccgcgcgactttggccgcttggccgcagccaccgcgcgtcaggtcatcagccagctgttccgcaaggccgaggacgacaaggtgttcggcgcgttctccgggcagaagggcaagctgatcaccggcattgtgcagcaggatgtgaaggacacctccaatgtgcacgtggccgttggcgacgtcgaagcgttgctgccgcgtcgtgaacaggtgccgggagagcgttaccgccatggtgagcgcatccgcgtgtatgtggtgaatgtcgcacgtggcctcaaaggcccggaaatcgtggtgtcccgctcccatcccgagctggttcgccgtctgttcgaacgtgaggttccggaactggtttccggtgccgtctcgatcatggccatcgcgcgtgaggccggtgcccgtaccaagatcgcggtgcgcgccaacaccgagggcgtcaatccgaagggcgctctgatcggccccggcggtgctcgcgtgcgtgcggtgatggagaaccttgggccggagaagatcgatatcgtcgactggtctgccgatccggcgaagttcgtcgcggcggcactgtctccggcggtcgccaccggtgtgcaggtaatcagcgagaagaaccagaccgcaatcgccttcattcatgatgatcagctgtcgctggccatcggcaaggaaggccagaacgcacgtttggccgccaagctgaccggatggaagatcggcatcgaatccgccgaggcacacgccaagaagatggccgaagcgcaggcttcgaccagcggggaaaccgccgaataaccaacactttcagcagcggtaagcccgtgggcgttcaatccacgggcttgagtatgctggactcgataatccaaagcgtgggggtacgtgccgtcatgcccagggaaaagacgaggtatcacgaacatggttgcacgatgagaaggaacaagctcgccgtgaatcagtagcggtcgcgctcgtatgcgcgcggcccaagataggagaaattgagtgccgaaagcacgcgtatatgaacttgccaaggaatttggcgttgacagcaagactgttttgaacaaacttgaggcgatgggcgaatttgtgaagtccgcatcgtctaccgttgaacctccggttgcccgtaagctgaggaatgctttcgcttccaacgcgcagggcaacgcatccgaatccaagaagcctgcggtcccggccaagaagccggctgccccggcagcttcgcctactcctgcgcctcgtgccactccggctgctcccgcggcatccgcggcaaagcctgccgctccaaagccggcacgtcctgcagcgtccaagtccgaagccccgaagcccggccagcgcatgcctcgtccgggtgattcccgccagcatggcaatcgtgccaacggcaacgctccgcgtccgcagggcgaacgccgtcagggcggcaagccggctccggttccgggacctcgcgcacagcgcaacaataacaataccaatgctccgcagggcggcaatggcaacaatgccgccaatggtgcgaagccgcacactccgggcccacgtccgggtaacaatccgttcagccgcaagcagggcatgcataccccgactccgggtgacattccgcgtccgcatccgatgaaccgtccgaacgccaacaacaataacaacggcgaaggtcgtcgcggcggacgcccaggtcagggcggcggccagcgtggaggtttccgtggtcgtccgggccaaggcaccggtgcgaagccgggtcagtggggccagcatcgcccgggtcagggcggcggtcagcgtccggcaggtggtggcaaccgtttcggtggcggcgccaataccaatggtggcggcttccagggcggcaacagcgctccgagcaacggtccggcacgcggcggcggtcgcggtcgtggcggtgccgcaggcgcgttcggtcgtcagggcggcaagtcctcgaaggctcgtaagaaccgtctggcaaagcgtcaggaattccaggagatgaaggccccggtcatcggcggcgtgcgtattcctaccggcaacggtcagaccgttcgtctgcgtcagggcgcatcccttgccgatctggccgagaagatcaacgtcaatccggcggcactggtcaccgtactgttccaccttggtgagatggccacggcaacccagtccttggacgaatccaccttccagatcctcggtgaggaaatcggctgggacatcaagatcgtgtccgccgaagaggaagacaaggaactgctgcagcagttcgacatcgatctggacgaagaagaacttcaggaagatgaagatctgaagccgcgtccgccggtcgtcaccgtgatgggccatgtcgatcatggtaagacccgactgcttgacaccatccgtcgtaccaacgtcatcgcacgtgaggccggcggcattacccagcgtatcggtgcataccaggtgaccgtcgatctcgaaggcgaaccgcgtaagatcacgttcctcgataccccgggccacgaagccttcaccgccatgcgtgcccgtggcgccgaactcaccgacgttgcgatccttgtggtcgcggccgatgacggcgtgatgccgcagaccgtggaagccatcaaccacgctcaggcggccaacgtgccgatcgtggtggccgtcaacaagattgataagccgggcgcgaacccagacaaggtccgtggccagctcaccgagtacggcctcgttccggaagagtacggtggcaacaccatgttcgtcgacatttccgccaagcagggcaccaatgtcgacaagctgctggaagccgtgctactgaccgcggacgctgaacttgatctgcgtgccaacccggatatggacgctcgcggtgccaccgtggaagcccgactcgacaagggtcgcggtgccgtggcaaccgtgctcgttcagtccggtactctgcacatcggcgattccatcgtcgcgggaacgtcgtatggccgtgtccgcgccatgctcgacgaaaacggcacccatatgaaggaagccacgccgtccactccggtgcaggtgcttggtttgacctccgtgccgacagcaggcgatctgttcctggtggcctccgatgaccgtaccgcacgtcagatcgccgaaaagcgtcaggccaccgagcgtgcggcccagctggccaagcgtcgtaaggtcgtgtcgctcgaaagcctcaaggagcagttcgccaaggctgaggtcgacatgctcaacatcgtcatcaagggcgattcctccggttccgtcgaggcgctggaagattccttgatgaagatcgaggtgtctgacgaggtcggcatccaggtgatccaccgcggtgtcggtgccatcacccagaacgatgtcaacttggctaccgtcgacaaggccgtcatcatcggcttcaacgttcgtccgaaccgtcaggtggcggatatggccgaacgcgaaggcgtggaaatcaagtactactcgatcatctacaaggccatcgaagacatcgaagcatccctcaagggcatgctcaagccggaattcgaagaggtcgtcacgtcccactccgagatccgcgagatcttccgttcttccaagttcggcaatatcgcaggtgttatggtgcaggacggcgaagtcaagcgcggtacgaagtgccgtattctgcgcaacggcatcgccaccgtcaatgatctcggaatctcctcgctgcgtcgcttcaaggacgatgtcaactccgtcaaggaaggctacgaagcgggtatcaacctcggttcgttcaacgacatcgagcttggcgatatcatcgagaccttcgaaatgcaggaaatcgaacgcaagtagtcgattgattcgaaccagcaatcgataacaagaaaggaacgcccacagctgacatacggctgcgggcgttccgtaatacaacagaacttacctgattaaaggacaacaatggcaggaaccaatcctcgcgccgcacgcatcgcggcgttgatccaacgtgtgatcgcatcctccatggaggcgcaattgcacgataagcgtctcacaaacgtgaccatcaccgaagtgcgtgtgaccaacgatctgcagatcgccaaagtctattggacccagcttggccgtgaaggccatgagcagggcgaacgccgccgtgcacagcaggcactgaaccaagccaagggtcgtctgcgttccctcgtgggaaccaaggccggtctgcgtttgaccccgcagctcgaattcgtattcgacgaggtgccgggcgaggcgcatgagatcgaagacattctcgccatcgcgcgcaagcgtgatgaagaactcgccaaggctcgtgaaaccgcccagtatgcgggcgaagccgatccgtacaagcatccggaagaggatgacgacgatgatttcgacgatgatgacgtcgaagtcgaagattgggatgatgacgaagaagcctgaacattccggcctgctggtcatcgacaagccgcagggggtcaccagccatgacgtggtcgcggccgtgcgcggcgccctgcatatgaagcgtgtcggccatgctggcacgctcgacccgatggccaccggcgtgctggtggtgggtttcggcaatgccacgcgactgctcaactacattgtcgaccataacaaaacgtacgaggccaccattcgccttggacagcgcaccactacggacgatgccgaaggcgagctgttgccggcgggggagcgggcagtgaactttccttcgcgtcaagccgtggaacagctgatcacagaacggttcaccgggcgtatcgaacaggtaccgaacgtctactccgccattaaggtcaatggccagcgtgcctatgatctggcgcgcgaaggcaaggatgtggagcttaaggcacgtcctgtgaccatcgaagagttcaacgtgcggcaggcgcgttacggctacacgcatagcgatcgtgccggcacggaacttgctggcgcagtcgtggccgagaggacaggagatggatggattgccgacactgcaccgcatgaagatatgcagcccgttatggaactcgacgtgaccgtgacctgttccgcaggtacctacattcgcgcgctcgcacgcgatctgggcgaggaactcgggttgggaggccatctgacgatgctgcgacgcacacgtgtcggcagattttcagtgaatatgcccaacgtcatgagcgcccacgctgaatccaaaacattcaccaatcgtgaaggcatggaagtgacgcgcaatcgtgcagtgcttgacgatgcagatcatgcgctcgatcatgcgctcgatcccgtggccagcgctgcggcttccatgaatatgctggccgtgagcgatcaggaagcggccgacttgcgtttcggacgcagaatcgcgcatgacatacgtacgaccacggcggcgtacgttgaggaaaccaacgatttggtcgccatcctcgaacgtgcgaaacgcggtgaggctaaaccggtcgcggtattcaactgaaccatccaatcagactacagatacgaattcatacacaagaaggacatgatgaagacaatcacgctcacgcctgatgccagcggcatggtggattggcctacgctgagcaacgataagaaatccgtggtgaccatcggttcgttcgatggcatgcatcagggccatcaggcggtgattcgccgcgtggtggaactcgccaagaaggaacagtccttctccgtggtggtgctgttcgatccacgcccagcgctcgtgcacggctacgcggcgcaaaacggtggccaggagccgccggcgggcatgatcgacgcgcaggcgctcaccagcatgcaggagcgtctgcgcgccatcaacaagctgggcgtggattacacgctcatcgtgcgttacacgctggcgttcgcggcgaaatcgtaccgattcttcctcggacaaatggtgggcaagctgggcatgcgcgcgctagtgctcggatccgatgcggccatgggtgcgaaccgtgccggcgatgtgaaggccatcgagaatctggcgctcgccaccggcgtgttccagcttgacgtggtcgacgatcgtggaccgggcgaaacccgcgtgccagccaatgcgaagccggttatgcccaccgaccatggtgagccggccgatccgctggaaggcgcgtccaaggcggaacgtcgcgcatggagcaagaaaaaccaggcgaaggccgtgcgcgtgtggagctccacgaatgtgcgctacctgctgggccaggggcgcatcaaagacgccgacgcgattctgggacatccgcatgccgtggaaggcgccgtggtgcatggcgaggaacgtggacgcaccatcggcttccccacggcgaatctgagcgagaatgtggcaggctatctgccggtcgacggcgtatacgccggttggcttgtggacttgggcgcgaagacggcggacgatgatgcgcaggacgcttccgaaggtgtttcgcagcagttcgattcctctgccgtggacgcgcgacttgccgatcattcgccgtatcgttggcccgctgcgatttccatcggcaccaagccgaccttcaacgaggtgaccggcatgaacgatcgcgtggtcgaagcctatgccgtcaccgacgattggcttgatttatacgatcaccaggtacgtgtggaattcgtaggattcctgcgtcctcaaatcaaattcgattccgcacaggatctgatcgatgagctgaagcgcaatgtcgaggaaaccaagcgaattactgcctgatgctaatcacaacgatgatcgcaataataatcacgataatgacagtgattaatgaatgctgatatttccagtaaaaacgtatcagtattcaaaaatagtgggactcttacgtaagcatttacgtaagagccccactagtataggttaaaaaaataacataatgtatatgcttcgcgtgcatacatgcgaaaacggtatgtagggtgtgtattatcgcaacatggcgccaagcgcatcctgcaatgtgtcgacctgaacgatcgacaatccgggaattgcgatttctctacgtaatgtcggcactacagcggtggtgaaaccaagacgggcggcttcgcgcaaccggtattccaatcgcggcaccggacgcacctgcccggtcaacgaaatttcgccaatcgcacatgtggtgcggctgatcgccttcgatttcgaggcgctcgccaatgcgccgacgatcgccagatcgcatccgggctcgcgcgcctggcctccggcgatggtggaaatatacagatcgttcgccaaaagattgacgttgccatgcctgtatagcaccgccaccagcatggcgatgcggttggcgtcgacgccgttcgcggcacgtcgtggcgttggcagtacggatttggtgaccagcgactgcacttcgatgggaagactgcgatgaccgtccaacgtgaaggtcacgcacgtgccctccaccggagagggatctgcggaattggacgaggaaagaaacagtccggacgggtccgtcacctcttcgatgccttcgccgctcatatcgaaacagccgacctcatcagtagggccgaaacggtttttcaccgcgcgcagcatacgcaatgcggtttcggtgtcgccttcgaactggcagaccacatcaaccaaatgttccaacgtgcgcgggccggcaatcgacccgtctttggtgacatgaccgaccaacaataccggaatatcaagcgttttggcggtgtcgatcagcgcgctcgccacttcgcgcacctgagtcgagcctccggagatgccatcgacttcctgcgagacgatggtttgcgcggaatcgacgatggccagcgcaggcttgcattgttcgataagccccagcgcggttgacaggtcggtggtggcggccagaagcagattcggttcgaccgcgccgatgcgcgaggccctcatgcgcacctgcgcctgcgattcctcaccggaaatatagagcaccgtgttgcgttcgggctgtgctgcggaaagacgggcaacattgcctgcggtctccagcagcagcgttgatttgccgatacccggttcgcccgcgataagcgtgacggaaccgggaacgatgccgccgccaagtacgcggttgaattccgtgaacccagtgtcgattctggaaatgttttccgtactgatttccgtgatcggtttcgccgcggaatcgggcactgcatgcgatagcgtacgcgatgtgcgtccgggagcggcggtgcgtgacgatgcggaggggcgcgcttcatggaattcctcgatggtgccccactggccgcattcagggcagcggcccagccatttcggcccgctccagccgcattcggaacatacaaattgcgaggacgtctttgccatatcgctgacaatacggatattttgggacaatcgttttcggagatattaagggggtgctggtgcgggatgatggcgagatcacggtttctggattcgagcgtctcacggatatgaaagaataacagccatgtctactacgcaaacttcctcttctcatggcaaactgatcgtggctgtcattgccgccgctttggtggtcgtgctcgccttggtgtccgctttcatctggcccggctgggctctgaacaagggcgatgaagcgtccactcagggcaccaccacctcgcagggcgcgtcgcaggatgcctctgagccgaccacgccgtccattgacgctgtggcgttgccggatgacgccagcgaactgttgaaggccatgcctgattccgtgttgaatttcgcgcgcaccaaggccgatgccagcacttcgtggagcggcgcttccccggtcgaggagtacacgttgacgtattccacgggcaaggacggtcaggatatcaccttgaaagtggcgcaatggtctcagtctgatgatgcgcaaagtcagtatgacaatctgaccggtgccatgaccggcaaggagctgggcggcggcaatgtgaaggtttccggtgaagcgaccggcgcctatagcgccaaaaccgatccggacgacgaaaccaaggccatcgcggtctggcgcaacgataccgtggtgttccaagccacgggagccaaggattcggtgcagcgcttctaccagcagttcccgctgtgatactgcctacggctggttgtgcgatcctatgattcatgcatgattcacgtaagattcagccgtggaccatgcggactgcgtttgcctgatcttccgataaaaaggtgcgtgcttccaccatatgaatgcggttgtgtgcgttagtccccgaagcagtgtagtattgggcaagttgcaaacttttaccctttgagtttaagaacggaggctgagatgggctcggtcatcaagaagcgccgcaagcgcatgagcaagaagaagcaccgcaaactgcttcgtaagactcgccaccagcgcaagtagtcttcaggcgcggttgaagcgtcgcttaaacaaaatcccgtatgtcttcttgaggtatgcgggatttttgcatattgcaaagaaataaacgaaaagtacgagaatcggaaatcaatagatgcaaaaagaaggctgtgcgttcgaagttgaacgcacagcctcatatggtttcgtgtaggttcgcgaaaatccgcggaaaatgcggaacttacgctacttcaaactcacttgttggagttggtgagcacgcgcggaccgttgggatcgcccacgatgacctggtccaccatgtgcaggaacaggccatgctccaccacgccaacggtgttgatgagatcgtcggccagagcctccgggtgttcgatgcattcgaggtgcagatcgaccacgtagttgttctcgtcggtgcgcaccggctggccttcggcgtcgaggcgaagcaccggcttgtagccgcgggattcgaacttcttgacgacctggcctgcgccgaacggaatcacctcaaccggcagcgggaacttgccgatggtgtccacaaccttggactcgtccacgatccacacgatcttgttggagttggtggccacgatcttctcccacagcagagcggcgccgccgcccttgatgccgttgaagttcttgtcgacctcgtcggcgccgtcgatggtcacgtcgatgtgatcaacgtcatcgatgtcgacgatcttgatgccgtagccttctgcctgctcctgagtgcggcgggaggtggtcacgccggtgaactccaagccttcctcctgcacgcggcggccgagctcgtcgaccaggaagcgcacggtcgagccggtgcccagacctgcgatcatgccgttctgaatcagcttggcagcttcgatgccggctgccttcttcaatgcgtcctgctgtgccttgtccatgatcctccttcgatatggggttaagaccgtctccatattatcggatgtgttgatttttgtgcgtttgcggacatgtcatgaacgaaggtgtgccattggtggtcagcaaatgttttcacaggatgtttcacgcactttcgaggcgttaaggtcgaaagtgctggctcgttagttgtgcttgactgcaaatggcgcttcgtcgaggacgagcgtgccgtcgccttgcacgtagccttccaccgcgatgtaaccgcggatcaggcgtggcttgccgtcgaacgtcggactggaatttggcgggggagtgaagcgaatggcgcccgacaccgccaatcccgaaggactggcgcgatgcggcagtttcggcaagtcggcgacggcgttcgttggcgccgacgcgtttgcggattcggctgattcgctcgttggcgccggcgtgttttccgaggaattcgcggattgttcgttctgtgcatcgtcggctggctgccgctcgtcatgctcgtggggaaaacagtccggcttgagcagcatttcggcatacgatttgcgcggtgcctcggcgtcaggcgtcgtgccatcaggcatggtcgtatcaagcgcggtggtcggttccggcatgtcgtcggattccaccgacatttcgttggacgtcaacggcaatgtcgcctcgtcgggcgctggatagccttccggctccaccagcatatcggcgatggaacgtggacgcggctccggatcggccgcgcccatcagatcatcggccgatccttgagcggacttgccttgcccgcgccccatatggtattcgtccgtagtgattttgccgtcaagcagcatttgggcatcatcgggaacatcggtaccttgcgaatattcggaagccagcagcgactgccaaccctccaaaggaagatatccttcacggatcttcgaacggcaatcgcccgcataggtgcgcgccagctcgtccaccttctcattgccggcattgccggcatgacccttgacccatacgaatttcaccggtccggggcgcttggagatttcggcatcgatcgcgcgaatcagatccgcgttctttaccggcttcttctgcgagttcttccagccgttcttcttccagccgtgaacccacgtggtggaacagttgatcgcatactgcgaatcggtttcgatcaccaacggttcggagccggggtgcgcgcgcaacgcctccagcactgcgcacagctcgccaatctgattggtgccgttcgtagctccgccggcatcgcagtcgctgtcatggtgatgccccggcttgccgcctgtggcaagctcatgatcggcccaaccccaacccatcggaccattcggattgcctaaagcggaaccgtctgtagaaaccgtaatcgtcatatctctaccctacgaaagccgtgagacgctgccatacgtggtgaactgcgaactgtgatcgggcgacgtcgaacgggaatctcaatcatccaaacacagcatgacggaagcgcggaacagcgtgccgtcataatcgaacgaggttgcgccatgatgccgttccgcggtttcgcgcacggtggcggtgcccaaaccttcacccccatgcttggttgaggcgaaagcgtcgccaacctgcataatggaggaatcgtgcgtgttgtcgaccacaatgaacagtgatgcgggcggcccagtgcgatatttgatgcgcaccctgagttttttctccccatcctgttgtttcataatggcctcagacgcattttccagtagattgccgaccatggaacataattcggcattattgatgttgagatattgcggcaccgacgctttgacgtcgacttcagcccctatatggcggatccagtcacagtagtagaccagcaccgcgttcaacgaagcatgttcgcaatactgcatggggatgggctgcaacagcctatgattggccatctcctccaaatacgaggtgatgccgggcatatcgtcggccgcggcgagagcctgcaacgtctgaatatgatgccggatattgtgcttgatctgcctcgcttcgttgatgcgttcgttcatatgctgcagctgcaaggtctgcatggcttcgtaatgttcgcgtttgctggcttcgcgcagtcggtccgcctgctggaccatataccagatgaggaagtaggccatggtcatgaaaccggaatatgcgatggatacggtgaaggcgatgctaagcacgcgggtgtcgagcagcgatgcgttgtcggcgggcatgcaccacaccacaattgctgtggaaatgaacgggaaaagccagatgaccctccaaaaattcctgctgatggaaggtgaatcgaatgttgcggaaaatgaatgatggaacggatggaaaagtgtagtcgccgcaatcaaatcaaaaatcagcagactgatcattcccggccatccgacacgtaaattcatggactgctcattcagaacagctaaatccacggccaaagacaggtaataaatgatcgcgacgatatatgcggctgttgaaacgacgaaaagaagctgcccccaaggaagattcgtcatcttacgtaaagccaataccacaaccggagccgaaggaatcacggaccagagcgaggggacgtgggcgaggcaacatgcgatgccgcacaggaagaagacaatcacgccggaaatcatgagaataaggccgtcgcgcttgggattctccatatgatgccaggtcatgtacaggcagagaagcaggcccgttagcgcgtttagctgctcgccgatggcgaagaacatgcatgatggcgcgatcgatgcgagtgcgtcaagcatggctagtcctccattctcatgcgggtgaacgtgtattccgcgtattttctgcaggtggtggtcaccgcggttttcgtgatgggaatgtgcttgccgcctttcatcacgaattcattgttgctgatgcctgacacgtagtcgaagttgacgagcactcctcgcgcggtgcggtagaagttgctgaatacggtgagacgatgttccacatcggagaagttggtgcggattttcgcgcaggtgccgtcggcgaaggtgaattccacataatgcgcgctggaaagcgcgtaggcgataaggcgacggtccatggtgatggcgggattgccgaaagccacctgccatgcggcgtccgtgctgctttgtgcattgcccgtcgattgatgttttttcagatgagtgaccggtgttttcgtgtcgagctgcgctgcgacgcggtccatggtcgcatggaacgcgtcgtgattcaggggcttcaacagatatccgcttgcctgcacctcgtagccgagcacggcgaaatcagtgcttgacgtgatgaacacgatcgggcaatcgtcgttctgtctgcgcagcgtccgtgcgatatcaagtccggtcgccgcatgcgtggcggtttcgtcgtccgacagatagcagtcgagcagcagcaggtcgtatcgggcgtctttccagcttttgatgaaggattccgcatcggcgaaggtcacgcattccacgccgatatcgcgggtgcgtttgaaatattccgcgcacatgacggccatcagttggcgttcggcggcgtggtcttcgacgatggcgatgcgcatcgttcacctcccatgaagattggcggggaccgctggactgagtgttgtgtcgctatcattcaagcgtaatgcgaagcggggccggcagggggtgatagcgtgcgtgtcatgccagaattcggcgtttcgtgccatatcgcacgattcgtgttcgttgcgattcgtattcaggcggatatgcgagaagcccgcctttttcaggaaagcgggcttctcagtgagtttgcgaatgattggcgaatggctggattacgccgattcgtcaatgatcactcggccaaggccttgtccacgacttcggtggcttcggcgagcaccttgtcgagggcttcgggggattcgaaggactcggcgtacaccttgtagatgttctcggtgccggaaggacgggccgcgaaccagttgttctcggtggtgaccttcaggccgccgatcttggcgtggttgcccggggcttcggtgagcttggcggtgatgtcctcgccggccagctgggtggccgcgacgtcgtcgccggaaagcttggcgaacttctgcttctgctccaaggtggtcggcgtgtcgactcgcttgtaccagctttcgccaaagcgatcgacctgctcctgatgcagctgggccgggttcttgccggtcttggcggtgatttccgcagccagcaggtcagggatcagaccatccttatcggtggtccacacacggccgtccttgcgcaggaagctcatgccggagctctcttcgccgccgaaggcgacttcgcccttgaacagcgggtcaacgaaccacttgaagccgaccggaacctcaacgagcttggcgtcgatggaagcggccacgcggtcgatcagggaggaggacaccagcgtcttgccgatgccggcgccttccggccagcccgggcggttgccgccgaacaggtactctacgcacacggcgatgtagtggttcgggttcatcacgccccagttcgggcatacgatgccgtgacggtcggcgtccggatcggtgccgccgaccaggtcgtacttgtcccaagcgccgttgttgagggagtccacaagacccttcatggcgtacggggagctcggatccatgcggatcttgccatcatggtcgatggtcatgaagctccaggtcggatcgacctgcgggcgcaccacgtcgatggtcaggttgaacttctcgttcatcagcggccagtagttgacggaagcgccgccgagcgggtcgatgcccaggcgcacgccggaggaacggatcacatcgaagtcgatgacgttctccagatcggcgacatagtgctcgcggaagtcgaagcgctcgaccaggtcggacttgacggcctgctcgaacggaacgcgcttgatgttcttgaaatcgccgagcagctcgttggcacgatccgcgatggcgttggtgacgtcggacggagccgggccgccggtgaccgggtcatacttgaagccgccatcggtcggcgggttgtgcgacggggtcaccacgatgccgtcggccaggccttcgccggtgaagcgctgggtgccatccgctgcgcggttgtgggtcaggatggcctgggacacaaccggggtcggggtgaagtcgtcgcgggaatcgatgcgcacggtcacgccgttggcgacgagcacttcgatggcggtcttccaagccggctcggacagagcatgagtgtcgcggccgatgtacagcgggccggtcacgccggccttcttgcggtattcggcgatggcctgggtgatggcgacgatatgggcctcgttgaacgaggtcttcagagacgatccgcggtggccggaggtgccgaaggagacacgctgttccggaacgttggggtcggggacgacgtcatagtacttgccgatgacctcgtcgacattgatcagatctgctggggtagcgggcattcccgcattgtttgcaaccatagtcactattctgccacgcttttgcgtcagatgtgcgtaattgtcccaattatgcgcgatgaatacgttgtctgtttagtgcatgttcggatgtgtgtacatgaattttcgaaaatggcggattctgcgcttagccgagttgcgcaatgtcaaacgatggtgtatagttctatgctattcgactgatgcagggttgctagtcaacataaagacgcaagacctgagatgtggctgaactatagccatatctcaggtctttttttgttgcccgaagcggtgttgctcggatcgaatcggttgtaagggaaagaaaggaaatcaggatggctgactcactcgcatcgcagatcatcactgcaatcggtggtcctgaaaacgttcgcagtctgacgcattgcgccactcgactgcgctttgaactggttgacgcatccaaggtcgatcagaatagtctcgagcacatgcagggcgtgctcggcgcggtgccgcagagcggcgaccgcttccaggtggtcatcggcggtggcgttgccaccgtgtacgaaaacatcatgcatctgcccgaaatggccggtgtcggcggtgcctccgcatccgacgatggtcagaagagcaatgccgacgtcaaggccgaagcccgttccaaggcccgcggcaaggtggcttggctggactccttcttcgagtatctctccgattccttccgcccgattctgggcgtgctgctcggcgcttccatcatcatcgcgctggtcaacctgcttatttcgctgaacgtcattccgaatgacgaggtttccgcgggctgggtattcgtgaaagccatctggaagggcgtattctacttcctgccgatcatggtcgcctacaacgcgtccaagaagctcaaggtcgacccatggctgggtggtgccatcatggccatgctcatgaccccgcagttcaccggcttgatggacgccaagaccaccacgtgcgtggagaacgccgctctgggcaccaagtcttgcatggccagcatattcggtctgccgatggcattgagcgactattccggcaacgtgttcgtgccgctgctcatggccgccgtgcttgctctcgtctaccacggattgaagaggatcatcccggaaagcgtccagctggtcttcgtgccgttcttctgcatgatcatcgttggcgcgctgaccgccttcatcatcggcccgatcggcgtgtgggtcggcaacggcctcggcgtcggcttggcctggatgaacacccatgccccgttcatcttcgccatcatcattccgatgctgtacccgttcctcgtgccgctcggtttgcactggccgctcaacgccctgatgctcatgaacatccagactctcggctacgacttcatccaaggcccgatgggcgtgtggaacttcgcctgcttcggcgctaccgctggcgtgctcttccttgctgtgcgtgacaaggataaggacatgcgccagaccgctctgggtgcgctcgcggccggcctgctcggtggcgtttccgaaccgtctctgtacggcattcacctgcgttacaagctcatctacaagcgcatgctggtgggctgcggtctcggtggcgtcgtcatcgccatcctcggttggctcttcccgtccgtcaccgccgccggccagaccgtgcatggcgtgaccaccaccgctttcgcattcacctcgttgctgaccattccggtcttcaatcagatgtgggtgtatgcagtgtccatcgccgtgtccttcctcacctccttcttcctgatcatcaccttcgactaccgcactccggaacagaaggccgaagtgctggcccgcgcggctgccaatcagaagaccgctgtctcgtcggtcgaagccaagggagtcgctccggctgctgccaccgcgactgccactgttgccgccaccaagactgaagccccggctgctgctgccgccaccaccaccgtggtgaacgctccagtcgcaggccatgtgatttccctggatgaaaccggcgatccggtgttcgcgtcccgcgcactaggcgaaggcgtcggcatccagccggcagacagcaccgtcgtcgcgccggtatccggcgtgctgcagaccgtcgccgaaaccggtcacgcattcggcatcaaaaccgatgatggcgtggaagtgctcgtgcacgtcggcatcgacacggtgaagatgaacggcgaaggcttcgatgtgaaggtcaaggccaacgaacacgtgaacgcgggggacaacctcgttgtcgtcgactttgataaggttaaggaagctggatacagcaccaccacattgatgacggtgctgaacacagtggccttcgcgtccgtcacgccaaagaccggcgtcgacgtcaaggccggtgagtcggtgatcgacattcagcgctgaccaatcgcatagtcggaaggggccgacgtggacgttcttcgcgtattcaacaataatgtcgtactggcaaaagacggcaacagtgaggtgattctcaccggtcgaggtataggtttccaagccaagcccggccagcatgttgacgacgcgaagatcgtccgtcggttcgttcccgcagatggcaaggatcccgaccatatggcccaacaggtggccgggattccgcccgaaatcattcgtctcgttacggacgccatgaaccgcaccggtctgaaggaacaggccgacagacagcctgcattggtgctggcattatccgaccatatttgcggtgcgattcgccgatcgcaaaacaagcagaccatcgaatatccgctggaagccgaagtgcgttcgctctacgcgagcgaatactccaaaggcaaagctctggtcgatgcgatgaacacgtatctgggcggtgcgctgccggattgcgaagccgtggctttggccctgcatttggtcaatgcgggcttctctaccggcgatctttccgcaacctacaccatgaccggcgtcatccagcaaatgctgacggtcatcgaaggctattacggcatcagccttgaccagaacagcgtcaatgtggcgcgtttcatcacgcatctgtgctatcttttcgtgcgcatccaccaacatgaacagcttgatgacgagcctgaaccaatcgtggaatccatcaaaacctcatatccgaaagcatcggattgtgcgaacaaacttgcgatcatcgtcaaaatgcgattgaacgtgagtctttcggaagcggaaatcgcctatctcaccttgcatgtcgcacgagtgacttctcatgcgacggaatcgcatgagaatgacgatatcaatgcgtgatctgcagaatcatgcgaaatgcatgattatcgataattacgattgataattactgatttgcgttggcggtactggtttcgggagcttccggcacgcgcacgcacagcgacttgcgctccacactgaaacgaatgtgctgcgtttcgggaagcatgtcgccatccacctgagccaacacgggcttctccaacttgatttccgcgctgacgccctgaatctggtcaaccgtggaattcgtggacagcggactctgctgggccttgccggtgatcgtctgatgcagcacatcgccgaacagattcgcccaaccgatcaaaccgccggatgtgtcaatgatctcgtaatcgagaatgccgtcatcgtacacggcgtcgggcatgagcgaaaataccggaatctggccgcaattgccggccatgaacgtgcggaaggtcaatccgtgcgtggtgtgcgtgctgccgtcggcgctggtaatggtcacatcacccttgtacttcggggcgaacaggttcttcacgcccgacacgaaataggcgagccagctgatgttcttcttcaactcaggatcggtgtcgtcgatcatcaccgcatcaaagccgatgcccgcgataataaggaacgcatggccgtgatcggcggcttcatcatcgagcagcgtcagtcggccgacatccaccaaacgcgaaccatgagatgtggcgacggtcagtgccgcatcgatatcatccacaggaatgcccatattgcgggcaaacagattgccggtgccaatagggatgatgcccagcgcgtggccggttcccgaaagtgcgctcgccaccgtgcgcaccgtgccgtcgccgccgaccgcgaccaccacgtcggcgccatgctccaaggcttccagcgcgcaggcgcgaccatccttatcaagctgcgttccgatatattcaacctgcgtgagatgcttcgcctcgcagaactcctgaatatgctgcttgcgttgttccgcctgcggtttcgaaggattgatcacaaacgcgtaatgcacctgatcatcgtcgcgcttgtcgagctgttccgcaagtttgcgatgcttatacgcgcgtactgcgaaaaaggcggccgcgcacaccgctgcgaccgcaagaacgacaatcagaatgataacaggcataggcatgtcatctattgttcacggaagatgcgaaaaaagcgaatcaagactgatttattcgacgattcctgcacgttgtatacaaaaatgagaggactgcggcgggtgtcggctttcagcactaggctaggaggcatgcttgatatccaattcattcgtgaacatgctgacgttgttaaggaatcccagcgcaagcgtggcgaatcggtcgaactggtcgacgaggtgctgcgctccgacgaggttcgtcgttcctctctgaaggaattcgaggctgcccgtgcgcagcagaaggaaatcggcaagaaggtcgccgcggctccggccgacgaaaaggccaagctgattgccgaaaccaaggaactctcccagaaggtttccgaatacaaggccgcagcggacgccgcagccgaagaatacaccaccgccatgtggaagctttccaacgtggttgagccggaagctccggaaggtggcgaagacgattacgtggtggtcaagaaggttggacagatccgcgatttcgcagccgaaggtttcgagccgaaggatcacctgaccctcggtcgtggcgttgccggcatcgatatggaacgtggcgtgaaggtcggcggttcccgcttctacttcctgcgcggccaggtggcacgtatgcagatcgccatgctcaccatggctgtggaccaggccgaagagcacggcttcacgctggccatcaccccgacgctggtgcgtccggaagtgatgcgcggcactggcttcctcaactcccacgccgacgaaatctaccgtctgcgcgaacctgatgagcagtatctggtcggcacctccgaagtggcgcttgccggcatgcacgagaacgagattctcgacctgtctgacggtccgctgcgttactgcggttggagctcctgctaccgccgtgaggctggcgcagctggcaaggatacttccggcatcatccgcgtgcaccagttcgacaaggtggaaatgttcgtttacaccaagcaggaggactcctacaaggagcatgagcacctgctggccatggagcaggaaatgctcggcaaggtcgaggtgccgtaccgcatcatcgataccgctgccggcgatctgggctcttccgcagcccgcaagttcgactgcgaggcttgggtgccgacccagggtcgctaccgtgagctgacctccacctccaactgcaccgaatatcaggctcgccgtctgaacattcgcgaacgtatggaagatggcggcacccgcgccgtttccacgctgaacggcacgctggccaccacccgttggctggttgccattcttgagaaccatcagcagaaggacggctccatcgtcatcccgcaggccatgcgtgcctacatgggtggcaaggaagtcatcgagccgaccaagtgggaagcctgatagagtttgggtttgcttggcagagtctgatagcttgggttgctcggttgagtgtggcgactcgggtttgtttatcggttccactgagttgctcagctgctaaactgctgaaacggacttctgcaatacgaaatatggaagtctgaggatgaccggcatttggcatttgccgatttctggcttttctggcttatgggaagggactcgcggtgagcgggtcccctcttttttgttttcgccgcgttctttcctttgtccttgctcgctttcttcccctcgttctttgggttgtgctatattagcgtttcgtgcgtgatgcacatgggtaggtgtctgagcggtctaaagagacggtcttgaaaaccgttgaggtgcaagcctccgcgagttcgaatctcgccttacccgcctataaggcttactgagagcgctctaagcgcccggtaagccttttttgttgctgcaatccgggtaaactccacccaagttcggctcagcaccgtccaagtctcaattcttccatccactggaacaatcttcccgctgttggccctgtgagcgtccagattcttccagtgggtggaggatttgggtcgctgggatggtctgtggcggggtgattcttccagtgactgggggatttttcccgctgggggcttgtgggcgtctgtttttctccagtgggtggaagatttgggtcgttgagaggcttgtaaatgtccactttcttccagtgactggaaggattggggagggattgtgatgttgttcggtgtacgatcaggctgagttgtgagaaaggctgctgtgactatgcgtgagaatgggatgcaaatgaaggaacgagcgatgggagctatggctgggcttgcgttgggcgatgcgttgggaatgcctacgcaaagcatgtcggccaagcagattcgccggtattacgacggtccgatcacgaaacttatgaatgccgtgccgcagcagccgatcgcaccgaatatgaaagctggtgccgtcaccgacgatacagaacaggctttcgtactcgcacggcgacttatcgacgataacggctgcattgataacacccgatacgcccacgatctgctgcaatgggaagctgcgatgaaggccaagggatcgcttgacctgctgggaccttccaccaaagcagcgctgcaaaaacttaccgaaggcgtaagtctggaagagaccggccgattcggcaccaccaacggcggtgcaatgcgtgccacgccggtgggcatcgcattccgtccaggccaagcgctcgccgacgccgcctggcgatcctgtgtggtgacgcataacacggtgcagggcattgaagcgaccactttggtggctgcggcggtgagctttgccattgaaggagaacgtgactttttgcacctcgcggtggaattcgtacggaagcttccacagcgtggcaattggtcggcaaaggcttcggtgcttgcgcgtgtgcaatatttcatgaattgggccgaaactgatggatgcaggctcaatgacaacgaattcgctgctgtgctgcaacggaattgcggtaccagcgtggaatcgaacgagtccgtggccgccgctttcgccattgcggcgcgcttttttgacgatcccacgcatgctttgtgtttcgcggcttctatcggtggcgacactgacaccattgcggctattgcgggcgcgatgctgggggcgtggcatggtatgcaaggtttcgacaaaaccatgcttgatcaggtgctttcacaacttgctgaagataatcaccttgatttggtcggcactgttacgtcgctacgcgcgttacgcgacgatagtgcgcttaatgatgtcaatatcgtttgatctgcaggaaccgtagttagcgaaactatgacggaagtgcgaaaggcatcgcaatgactggaaaagttatttctcttgggcaggttattgtcgatctgaccatgaatgtggacgcggtgccgcgtgcgggtgaagatgtgttcgccggcaatgtgcaaacgcaggttggtgccagcttcaacacgctgtatgccgtgcgccgcatgggcgttaaggcgtctcatgctggtgtgattggtacggggccgtgggcttcgcagattctgcaaacgttggaaaatcaggaaattcagcatatcggcaagcgggatgccgtgcacgattcgggattttgcgtggcgttgaccgacgcgaatgctgaacggacgttcatttcgacgaggggcgcagaagcgtacggcagtgccgatgcgttcgattctgtgaatccagaaaagcgggatgtcgtgcatgtgagcggatacacgttggtgcatcacactgcggacgcgctgcttgcttttgtgaaaagaacgactgaacatcgtgagttcactgcggtattcgatccttctccgatgatctcggcagttgatgatgacgttttccgtgtgatgctcgcatatcgtccgatatggtcgtgcaatgaacgcgaggcaacgttgattgcgcaacgtttggcggcgctcgatagtggcgattcttgcgattgcaaggtttcgcgggatatgctgcaagagattgagagtgcgaatgtcaatgaggagacggttgcgtggctgtgcgatcgattgcaatctcctgtaatcgttcgcgtgggcgcggatggtgcgtggtcggcgattcccggtgacgaagtgctgcgaattccaggttttccaatgaaagcggtggataccaatggcgctggtgattgtcacgcgggtgtgttgtgcgccctgctgtgcgaaggcgtgccgttggaggaggctgtacgttgtgccaatgctgcttcggcgttgtctgtaacgcgatcagggccggctacctgccctgatcgaaaggaggttgagcggctcctaggaagggcgttctaagacttatggtacaaatgactataagtggttatatcatgtgcacgattgcgctgacgcggcgtgcatgtcgcttgcccgcggcgttgctcggcagattcaaggagattagtttcacatgagcaatgagaaagggaccctctccatcgaggagcagggtatcgacaccatatccgaagaggagcgtaagggcacgccggccagtctgttttggccctggttcgctgccaatgtttccatgttcgccatgtcgtacggcgcgtgggcgctcggtttcggcatttcgttctggcaggccaccgccatgaccattattggcgtggtcatctcgttcctgctggtcggcatcatttccatcgcgggcaaacgcggcaacgcgcccaccatggtgctcacccgcgccacgttcggcgtggaaggtgccaaagtgccagcggctctgagctggatcgccacattaggctgggagatttcactgaccaccaccgctgtgttggcattatcaagcaccatcgaaaaactcggttggggctctggtgtcgcgcccaagatcatctccaccattgtggtggtcggccttgtggtggtcgcaggtattttcggatacgacctgattatgcgttgtcagcaggtcatcaccatcgtgaccggtgtgatcaccgtcggtttctttatcctcggctggggacatattgacttttccgccattgactcggttccggcgggatcattgccggccatgctcggctgctgcttcttcgtgatgaccggctttggcttgggctgggtgaatatcgctgccgattactcgcgctatctgccgcgcaactcctccaatggcggcattgtgttctggaccacattcggtgcgtccattgccaatgtgttcctgattttctacggtctgctgctcgcggtttccaatgccgacatggcggaaaacgttggaaatgatccgattggagccatggcttccattctgccgacctggtacttgattccgtacaccattgtggccgtgctcggtttgatgtccggctccattatggacaattattccaacgggcttgcgctgctgtcgttcggtgtgaagttgccgcgtaccgtggctgccgcgctcaccgccgctttgactgtgcttggtgtggtctacgtgactttcttctccgacacgttcattggcccgttccaaggctttctgaccacgctcggtgtgccgatggccgtatgggccggcatgttcgtggccgatgtgatcattcgcaagaaggattacagcaccgctgatttgtatgatccgaaggggcgttacggtgcgtggaacggtaagtctttcgccattcttgtcgtcggtaccgtgcttggttggggattggtggtcaacactgccgccagctggctgaactggcaggggtatctgctgttccttatcggtggcaaagaaggtagttgggctgccgccaatcttggtgtgattgttgcgctgattattggtcttgcgggatcgttgatgttccagcgtggcgatattgccaagcaggaagctgatctgccggtttcggaagcatgagttgcttattgcgataatacaaggaaaggaaaagtcatgattgcggaagatgaatggctggtagttatcgacaggcagcgtgtttttgcggaaagtgaatggtccgcatgggcttgcccggacggctcctatcacactactgatgaagcgttcgcacgattggctaaggcgttcggcgatcgtgtggtctatacgcgatatgttgcgcctgagtcaccgcaaaacgcttgggttgattatttcaaagattggccgcagtttttggttgctcccgacgatccgatgtacgatctcaccgcggataccgcggaattggcgcaaggccatgccgtggtcagttgcgacactttcggcaagtggggaagcgtgctgagcgaagccattaaaggcgctaaaaagatcacggtatgtggtgtcgccaccgattgctgtgtgcttaccactgtgctcgccgcggctgacaatggtgtagcggtacgcgttgctgctgacgcttgtgcaggcagttcgccagaaaaccatcagatggcattgagcaccatggcattgttcacgccgctggtcaccgtcactgatactgattccatcgtaggataggtaaggactttgattctgcggggtttgttgagttctgctcagcaaaccccgcttttttgtatgtcgtgcatattgcgccaaaacttggatgatgctcggctggcatcggtaatgagccattaatcttgcggtgcgcttttgtaactgcggcgtaacagtgcggtggtgattgtaacggacgattccggcacaatcgtgggtatcgacagtttcgtgaagaggttttactgacggacatgtctctcacaggaaaaatcccatgtatgaatcgaggccaccatggcacagcagatcactagcttgcttgacgatcctacgcaagcggtcagtctagacactttcagtgggctcaccaaaggatgccccgcaccattctggcttttccaaggcgtttgcgcggcttggggcatcgaccaccagcgggcgcaactcaacctcatcaccgtatccgagaacgcgacgttcctgctgttgctggacggcgagccccaaggcgtggtacgtgtctcgcagccgggctatgtgggaggtcccgaggcggtggcgtcggaaatcagctggttgaatgcgttgcatgatatcgaaggtatcagcctgatcaatccggttcccaccatccgtggcacgttcgtaacgaaaatcactgatctgaacggtgtcggctggacggtgatctccacgaaatatgtggaaggaaccgtgctggaagatcttgagaatcctgcaccgtattacgagacgatcggtgaatgggctgcgaaattccatgagcagtcgcgcacgtggagcaaaccgtacggtttcacccgcttcaattgggatctttcgaacatggttggtccggcaccgcgttggggacgttgggaaaacgccaatctcaccgacgaagagaagcagctgtgcgacaccgcgctgtggaaggccatggacgtggtgatgaaagtgccgagaaccaacgaaacttgggggcttatccatgccgacttgcgcccgtcgaacgtgattcgcggcaatgacgggagactgaccgtcatcgatttcgacgatgccggatacagctggtatctctacgattacgcttcatcgctgagtttcatcgagcatgaaccgtatgctcccgatcttgccaaggcgtgggtcaagggataccagcgcgtcgcaggttcgttcacggatgaggaactgcgtatcatgtccgcgctttccatgattcgacgcatgcagatgctcggctggaccaccagccaccgtgaggatgccctgcccgacggtctcgctgcacagcaggctcccggcagcgtgatgtgcgcaaaaaactatcttgaggatccgctctggctgctgcattaggcaagttgcatgaaacaagcgtaattacgcagaaaccagacaatccaagaaatccaatcgtaagcacgtaaaaatacgcaattacgaaaatctcaatttttataacttaacaacatctgaccgcaaccaaccaaacgaggaatcaatggcataactcgccgaacaataagagaggaaggcgattacaatgactgcgtcaactgtttcgggacgatcgataggcggcgtgacctacgttgaaaccgacaaggactatttcgcaaaacgacagcttaagcgaaccgcgggagcgttcggtctatgggccatcggcatttccgcggtgatctccggcgacttctccggctggaacggaggcatcgcccaagccggatggggtggcatgctggtggccgccatcgtggtgtacctcatgtacgtgcttatgctcaactccatcagcgaaatggcgtcggccatgccgcacacgggtggcgcgtattccttcgcgcgtgccgccatgggtccgtggggcggcttcttcaccggccttgcggaaaccatcgagtatgtgatgaccgcagccaccatcgtctacttctcgtcggcatacgctgatgcgatcctgtcgaacctgaccggatattcgcttgacgatcatggcttggcttgggtttggtggcttgccttgtatgcgattttcgtagtggtcaattggctgggcgccgaaacgtcgttccgtttcgccgaagtcgtgtcgatcgccgcgctcgccatcgtcgcactgttcggtatcggcgctttcgccactggtaaggccgatttctccacgctgctcaatatcacgcctaccgaaggcaactccgcgttcctgccgttcggcccaggtgccatcttctacgccatgccgttcgccatgtggttgttccttggtattgagcagctgcctctggctgcagaggaagtgcgtgagccggaaaagaacattccgaagtcgtcccgcctgtgcattttcacgctgggattgtccgcgctgctcatcgtgttcctgaacccggctgtggtcggttccgaagcgctcgctggttccgatgagccgttgctggatggctatcgtgcgattctgccgggcaatctcgccgcggtgctgtccgcattcgcgttgatcggtctgctcgcttccatccaaggcattatgttcgcgtatggccgcaacctgtattcactgtcccgtgcaggctattatccggcgttcctgtcgctgaccggtaagaagaagacgccgtactggggtctggtcgtcggcgcgatcatcggtttcgcagccctgttcatcatcgcgtacggcggtgatggcgccggttcggtggtgttgaacatcgctgtgtggggtgcggtgctggcatatctgctgcagatggtttcctatgtgatcctcaggaagaagatgcctgatatcaagcgtccgttcaccagcccgttcggcgtgccgggcgcggtaatcgcaggtttgcttgcattctgcattttcgttgccgtgctgctgaacccggattatcgactggccgtctacgccatggtggtcatctacgttctcgcgaccatcttcttcgcggtttacggacgtaagcacctggtgctttctccggaagaagagttcgccgcttccggcggaaaggtcgcatataagactgaagactgactgattttctgcgattatcgtttcgttttcttgaaataaaacgatattgccaaggccgtgttcatctgggatgcggcctttttcaatcatcggaaatatgtaaaaaggtcaaccaaataggtggaaaacagcggaaatggtttgtttctgcgctgtatcagccactcaacattactgcgttaccgtgtgggtaacgccacaggaagccaacgaaagaaggaatcatggcaactcgatcgaccatcatggacaccaatagcttccgtccggaaatggcggccgcgctcgacccagaaacacgcaaactaaccgaagagcgtgacgtgcttggtccggcctaccgtttgttctaccgcaatccagtgcatctggtgaagggccgtggctcgcatctttgggatgccgacggcgaggaatacttggacgtgtacaacaatgtcgcatccgtcggccactgtcacccgcgcgtggtggatgcacttacccagcaggcttcgatgctcaacacccacacgcgctacctgcatgagaacatcctgcattatgcggaagatatcctctccaccatgcctgacgaacttgaccgcatcatgttccagtgcactggttccgaagccaacgatctggccattcgcgtagcacagacctacactggcggcgaaggcgtgatcgtgaccagcgaggcctaccatggcaattcggcactcacctccaagctttccccagcgctcggcaccgcgcaaacgcttggcttgaccatgcgcatgattcccgcgccggacacttaccgcttggtcattgacggcaagcctgccgcagaatgcgccgccgaggaattcggcaactggatggctggcgaagtgcgcaaggccgttgccgatatggaacgtcatggcatcaagtttgcggcattgcttgccgactccatcttctcctccgacggcgtgtaccccgatccggtcggctatctgaagccggtgatcgacaccattcatgaactgggtggcgtatggatcgccgacgaagtgcagccgggcttcactcgcaccggcgacgcattctggggattcggacgccaaggcattgttcccgatctggtcacatccggcaagcccatggccaacggtctgcccacgtcgatgatggccgcccgccacgaagtacttgaaccgttcgcaggctccattccttacttcaacactttcggcggcaacccggtatgcatggccgcggcccaggcggtgcttgacgtgatgcgtgacgaagacaccatgggcaacgccaagaaggtcggcgcaatattcaaggatgccgtcgcgtcgcttatgccggcacacccctgcatcggcgacgtgcgtggcgcgggcctgtacatcggctgcgaaatcgtcaagccgggcaccaaggaccccgaccagcagacagcgctcgatatcctcgaaaccctgcgtgacaaccacatcctcacctccgtatgcggccgttacggcaatatcctcaagctgcgcccgccgctggtgttcagcgaatccgatgtggattggttcatggatggattcacgaagactctggaaacattgaagctgtaaaacgacagataaccataaagaaagggcgcggatatggaagatcataccggcattgggcgcacgcgaagcgctacgagcgaactggtctaccgtatccgcgctcgcattcgtgaacaggagcttcttcccggagagaaactcggatcggaacgggcgctcgccgaaagtcttcgcgtcagccgttccgatttgcgcaatgcgttgaccgtgttggaatccgatcatgaaatcatccgcaaaatcgggcgtgccggaggcatcgtcatatcggacggacgtttggaacgcaatatcaacacggtggaatcattgccgacgatcgcgcgaagacaaggcatgcgcgtttcgtcgaaagtattgcaggcggtgattgccccggcttccgtttccgacgtgcgtttgctgcgattgccgggcgagcatccgatgatctacgacattacgcgattgcggtatatcgaaaatcggccgctttcgttggaacggtcgcatttgccggcatatctgtttcctctgttccttacacgcgatttgacgaccccgttctacaccatgttcgaacgtgattatggcgtgtatccgtgcaatgtcgacgaaacattggaatcggtggtcggcgacgagcaggagaacgagctgctgcagatcgaggcgggaactccgctgatgcgcattcaccggatcgcctatgcgtcggatggatgcccgttcgagcgtgccactgacgtgtatatcgctgatcgcatgcgattcaccatgcatcattccggctatgtacgcctgtccgcaacgtctacgcagaatatgacgaaataagccggaagattcttcggttatacgatgcggcggtcggcggcccagcgggtgagttcggtgcggtttgacagctgcagtttgcgtagtacggagctgacgtgcgtttccacggttttgatggaaataaacagttccgcagccacttccttgtacgtgtagccgcgcgcgatcaggcgcatgacttcctgctcacggttcgacaagcggtccagctcgtcatcgtggatcggtccgcttgcagggccgcccatgccagccggtgagccattttggaaagcggacagcacgaatcccgccaatttcggcgaaaacacggcatagccctcatgcacttgcttgatggaagaaatcaaatcatcgccggaaatcgtctttgtcacatagccttgcgctccggcacgaatcaccgaaccgacatcctgcggcgaatcagacaccgacagcgccagaaacacggtattaggggagtatgcgcgcgatttcacgagaatctcggctccgccgccgccctcgccgccggggacatgcacatcaagcagcaccacatccggcttcgtctgcgcgatcatcgccaccgatccctcgacatcggccgcttgcccgacgatgtcgaaatgcggctgcagcgttgcgataacgcccgcacggaacatttcatgatcgtcaacgatggcgatgcggatctgctgttcctgctcgttcattgctgctcctcgaaatggttggtaggttgattgctgaattgattggtacgttgattgttggattgacggttatggtgattgggaaaatcggtttgttgtgagttgctttgcggctcgtgcgattgctgcgcattcgtgtcggcggctgtggttgcggatgcgggcatgtctgcgattggcatatgcatgcgcacctccgtgccccattgcggtctcgatacaatctccactgtaccgccacgtcgcttgattcgtccgataatcgattcacgaatgccaaggcgattcgcgggaatcgcattcacgtcgaatccgttgccatggtcgcgcacgaacacttccaccagtttgctgcttgcctcgcagtagacggaaatcggctctcctccatgcgctaccgcattgataagcgcctgttgcgtggcgtcaagcagcgcatcggtttgcgcgcttggacgtgcgtcgcccaccgtcaccacttcgatcggcttgccatgcgtgtcttccacatgtgcggcgatttctttcaagccggcgttcacggaacggtcagacgtggtgcgttcctgatacagccattcacgcaattcgcgttcctgcgaacgcgccagcgaaaacaccgtctgctgatcgtcggcatgcaactgaatcagcgccaacgtttgcagtacgccatcatgcagatgcgcggtcatgtcggcacgttcctcttcgcgttccttcgatgcgcgttccgtgcccaaatcgcgaatcagcgccatgatccatggcacaatcgcaagcaatacgccaatcagcagtgccaaaccggcgcacagtatgcgaatcatggaaaacgcgtcaaaatgcatgcaggaactgacgtacaaagcgtatgcggcgaaaataatcgcaatgccgccaagcatcgtccataactgaccttcttcggcattgaaacgcaaccaggagacgccgataccgaccagaccaagcagcaggggcacaatcagagtgcgttcaacaccgcctgcgaacatgacgaaacagatggaaagcagcatcagaccagctaatgcaagcaaagcgggttttggtgctttcttcagtgtctgctcaagactttcgctggaagattgcgtatcgccatgcgttccgtcgttgcatgcagtcgtatcttcaaaagatggtggttgcgggtgcggaccatcttgcgtagctgtaaaagattgatattccggggaaacgggatatgtcccgtacggcatgttgccccgggaaagcggtgcctgccatggcgaacgcttgccggcaataatgtacgtctgctgtatggggtctcccacgggaagtgccatccacaggaaaatgtaagcgatgagccctgcaccgaacagacatgtggtggcgaggaaaaacaggcgcacccatagcacggcaatgcccaaatgcatgctgatcgccttgcacacgccagctcccatgcgtccgtatggaggacgcatcaacggcagtttggccggttgcgtcggcagcggacgtccctcatgcagggcctggtcgcagcagtagcgcatatatacggcgctcgcctggtcgtactggctttgcgtgtaccacggttttcctaaggatttcatacttctattgtgccctgtgggggacgccgtttcagggcattcatatagtgttcagggcagattcagggtgttccccgatacatgtggcatgcgcgagttgctgtaatggaaccatgagcaatgcaaacaatggtccgctgggcgatcgcggcaacgcagggccgcagccttctgctggacaaccgtatcatcggcagcctgcgtacggttcgccgcaaccttcccgcggcggccgtttcttcgcgtggattcgttccagccaggtcaagcgtggacatgaccgttggattggcggcgtgtgcgatggcatagcacgtcgtcttggttggaataccacgttggttcgtgcgcttatggtggttgccacactgtttttcggcgcgggtgccgcgttctatggcctggcgtggtttgtgctgccggatgagcgcgacaatcagattcttgctgaggatttgattaacggcaagtgggattggaattgcattggcgcgctgttgtgctgccttgttgccatctgtttgccgggggcaggatggtttgctttcgcgttggccgcgttggtgctgtggcttctgctcaataggcagatttatgcgccgaatgttcctccaaatcagtggcagcagcccccgtatggtcaggctccgtacggtcaaccgcaatatggtcagcctcaatatggaagtccttcgtacggacagccggtgcctcctgcatcgccgtctccagcgcaatcgaatccttatactcagccgatgcaggcgagcggcgcatataacggggtggccaacacggcttcgtcaccggaatcgcaatcgcctcagcctcagcgccctcagcctcaacagcctcagtatcatgcctaccaacagcaggccaatggtccggccgcttttgccacggccaatgttccaccaacattcaccgctccggtagccccggtggcgcagacgcctacgcagccaagaagggggcgccgtaagccggctggtccactgctggtattgatgatgttcggtctcacgatgatcgcatgcgcgctatgcgtatggtgcattatgacgtacggcgttcaaggcgggcagcggggcaccgaatacacgttgcaggcatgcgcggcattcgtcggtggcatctgtctggtgacgggaatcgttattgtcgcgctcggattcgcgggcagaagaacgggaggattgcatcctctgacatggatatccgtattcatgtcgttggtcatggtgatggctttggcgggttattcgctgttcagctatcggattgacacgagcattccctcatcctacaaaagggtcaatgtgtcgggaatgaccaccatgggttccaccgccagtgaaatgagcgaatacgagcagggcatcgtcgcgcaaggcaatgattacgccaccgacgtgctgcatatcgacttaagcgattacgcgaaaaacaacggtccgcacaaagtggatcttcaggatggcacgcagggcacgacttcctgccctacaggaacgttgaatgtggtggcctcaagcgcacaggtcgtggtgaccttgccgaacggctgctggtgggcgttcgggtctaacggtaatttctataacatcaccgatttcgtcggcagttcggacgggctcacgttggattccggcaatatctatgtctcgcttatgggcaacgattccacgaaatcggtagtgaaaaagcgtgcgctgggaacttacgatacttacgatcggagttgcggctcatacggagatgaatccggcatcgaggatttcgatgatgagaccgatacggaagatggcacggataccggcgccgattccactaggaccgattccccattcaaagacggggatgtggacaaggcctaccgcgaaatctacgacaatcatcaatattggccgtgcttcaccggtgatggcaaggctccggtcaggccagccggactacggatcaatactatggcaacggtcggcggcagcgtcgcggtgcagtatgtgtccgacaacacattgggcaaagcgggaaaggagtgaccatgagcgacgacaagacccaggaaatgccggtcatggctgatgccggagatatgcctaccgaaacgttgcatgccgtggatgcgcagtccacgtatgaccagtcgcagcacagtgggcgtgcgacgcaggatgataagccgcgcgtggaatccgctccagcgcaaggcgttccgacctataccgcttcggcagccggtgcgaatggcgggcgcaagaatcggcagattggagacgacatcatcagaccttccggaagaagtggttcgaccatcgcgctcggcgtgttcacgtgcttcatgggggtggtgacgctgctttgcggcatgcatgtgccaatgaatctctggtggtggtccagcgatccgaaacagtccttcgtattcctgctcgggggcatcggcgtgctgcttatcgccgtcgccgtgatttgggcgatagtcagcgcggtgcatgcaaaccgatccaagaatggaaacgatgtggacggcggcgatccattcgacgctccccatagttcggataccacggccttttcgactgattcggataagtcaccggtttcggaacgatcgtgagagtcagctgaataacccctgatgccagccgcaccaacgaaatcgaggctgacatcgcaaacaaatacgtgaccaccatggcatgaccaaatccaacacttgcttttccatcttgacgttggattttggtcgtaccatggcggtcatttttatggtgatgtacggggcttactgcagttttcagtaattgtcacggtgtgttttcactgtgtttactgtgcggcctcagcctgtgccaaatcctcaaatccagccaaacgaaccgtattgcgaatcgtctcttcggtgagattgcgccgctcatgccgcaaacgctccacaaaatcgtggtacaacgccacggtacggtcggaataggtgcccaattcgccgcgcagatacgtttcgaacgacgtggtctctggcgtatcttcgacagtggtcagcacacgcatcgcctcgccgagatgaggaaaacgctcacgaaaatcacgcgcccacgacacctgaactgttatgatgccttcctgcaagacgttgcgattcgcggaaatccggggaatatacggcgcaatgtttgcacaatactcctgtggatatgtggattgcatcatgcgaccatacttttccgtcatcaaattacgtccaacacggtcggcttcctgcaagtccgaccggtaactgcgcagcaattcctccggccacgtcatgaactgactggcacgcatctgatgaaacatcggccaattgccttggcaggacgcgcggccgccctcattattggtttgctgaaactgattccactccagtttgataatggattcaacaagatttgctgtatcgtgaccgtctattacatctgaaattacgctgctattcatatgatttcgattcttgatttcgtctgattattgctctgagaagctggcacaaggcaaactggacgctgatcgggagaaccgggagcgctgggagcgtgaaggacggattgctccaacaagaaaacaggatatggaattgtgaggcatctgattttctatggaaaccggatgccttttgcattgtttggaggtggaagaaacgaatgtatttgaagcagtaaaacagtctgttaccacaaggcaggctgctttggtttatggaatttcagtaggacgcaacgggatggcttgttgcccgtttcacgatgacaggcatcccagcatgaaggtggacagacggttccattgttttgcctgtcaggcagatggagatgtgattgatttcacttcccgtctttttggactaagcagtaaagaagctgccttaaagctggcagaggacttctcaatcagctttgaccgcaaaggccacgatccgccacaaaagagagtaatcaaaagaaaaatcagcgaggaaatgcgataccggcaggcagagcagaaatgctttcgggtgctgtgcgactacctgcgtttgctggaacgatggaaagaagaatatgcgcccaaacaaccggaggatgactggaatcctttgtttgtggaggctctgcacaggcagccatatatcgaatatctgttggatcttcttctgtctgacagcatagaagaacgagcttttgtagttgctgagtatggaaaagaggtgaggaaaattgaacagcgaatatcagagtttatcgccagccacccagcaggctgtgatgagcgcagccgaagccatagcgccggaaccgagcgttgatgaggtgcggcagagcctttctgttaccgacaagggaaaaacagccaacaccattgacaactgccggattgtgttctgctgcgatccactcctgcgggatgccatccggcttaatctcctgactgaccgggtagacattgtacaggacttggggtggcgcaggaataccagcgctctgacggatactgatgtgaaatatcttctcctctattttgagagaaactatgagctgaccagtgagaaaaagatcacggctgccctttctatcgtagcaaacgaaaattgttaccatccaattcaggatgtgctgaacagtcttgtctgggacggtacaccacgcatccgatcctgtctgcaccattttcttggtgctgatgaaagtgactatgtggaagaaatgctgaaacatttcctgctgggtgctatacgccgggtattccgtcccggttccaaatatgaggaaatgctttgtttggtgggcggtcagggtgccgggaagtccacattcttccgactgctggcgatccgggacgaatggttctctgatgacctgaagaagttggatgacgaccgggtattccaaaagctacaaggtcactggatcattgagatgtcagagatgcttgccaccagcagcgcaaagagcattgaagaaatccgttcctttattagccgacagaaggaaacctaccggacaccttatgaatctcagcctaaagaccggcttcggcagtgcgtgttcggtggttcctcgaataccctggactttctgccgctggatcgagccgggaaccggcgctttctcccaatcatgatttacccggagaaggcagaggttcacattttggaggacgaggacgcttccagagcgtatctgttgcaggtatgggcagaagctatgagcatttaccacagcggcaagtattccatgaaattcagcaagtccatccagcgtcaactggtggaggtgcagaaagacttcatgccggaggacaccgaagctggacagatacagggatttctggaacactacaccggaaacatggtctgctcaaaacagctgttcaaggaggcgctgggacatacctttgatgagccgaagcggtggcagctccacaatatcaatgagatcatgaacacggtcgtgaccggttggaagcctttttccaatccccggatgtttgccggatatggcagacaaaagggctgggaacgggacacttccggcaacgaactacccagcaacgaaggtggatttgtagaactgagtgaagaagaatgccgtcagctggaacttccgcaggagtggatcgcctgacaaggacggtctgttgccgggatggttgccggttggttgccggttggttgccgggttcgttgctgataaatttatggttttgatatagaaaaagcccgcaagtaaaggctttttatgatctatctatgttttcggcaacgaaagcaacgagattttacaagaaaatttgaaaagtaagaaatcagggtcagacgatagtttacaggttttttgatgtccgttgccggacttcgttgccacagctaccgtctgatcccctattctatggaggtagcctatggagaaaaacaagaagcagaataaaaaagtccagtttgtagtggttcgtgagttttctggggacaaaaccatgcgggaagcctttgagcagctgatcgagcgtcagacctgcgaacacttcgaggaatggttagagcatcaggaaatggcacgaaaagcggcgtaaagcagttgaatcatggacaggggcatggtattataatggtatcgtgtccctgttcatagaaggagaacactatgagcaggaaaaaacaagtgaatcagaaaatcacagccctttattgccgtatctctctggaggatggcggcgataatgagagcatgagcatcagcaaccagaaacttatgctccgggactttgccgaaaaaaacggaatgttccagtatgagtattatgtggatgacggttatacaggccgcaatttcaaccgcccttcttttcagcgcatgattgccgatattgaggcgggaaagatcggctgcgttatcaccaaagacctgtccagactgggcaggaattatatcgaagctggcagctatatcgaaatctttttcccaaaacacaatgtacgctatatcgccattacagacggagtggacagcctgacccgtcaggaaatggacattacgccgtttaagaatatcctgaacgatatgtacagccgggatatttccaaaaaggtgctggcagggcgtatgacccgttcccggcaggggaagttttgtggtgggcagccgcccctcggtttgatgcgtgacccggaggataaggggcatttgatccgtgaccctgagacagcaccggtaatccgaaaaatctatgatatggcgctggatggctggggatgtatgcggattgcaaagcagctcatggatgataaagtcccaatcaccagagtaaaaagtaacacagaatgtgatgtaaattactattcatggggaagtgcaagaatcagccatatcctgcggaatcccttttataagggcgcacatctggtctgccggacacatcagaaagggattcgctccaacacctatgatattatccctcgtgaggactgggaaattatcgaggattgccatgaagcaatcatctccccggaagaatgggagcaggtgcaggaaatcattgaccgcagaccaaccattatgaagggcaactcctgccccttttataacctgttccacggtatcatttattgtgcgacttgcggaaagtccatgcaggtgcggtatgaaaaggttggcagaaccggaaagaaccgttttaccggcgaacagcgggaaccgattgataaggcgtattatatctgccagacctataacaggctgggcaagaacgcctgtaccagccacaagatcgaagccagagatttatacaatcttgtgctgaaagatattcaggagctggcaaagactgcgctcaaagatgccgatgctttttatcagcggctgagcagccggatggagcgccggtatcttctggacgcttcccagacacagaaggaatgtcaacgactggaaagcaggaattgtgaaattgatgagatgtttctgagcctatataccgataaggcaaaaggaatcttgactgagcagcgttttatgaagctgacagcaacactggagcaggagcaggaagccaaccagaagcgcctgcgagacctgctgttgatgatgcgccactctgacgaacaggaaaatgaagtccgcacctttagcaaagaaatccggcgttatgcagccattgaagaactggatgaagcggtgctgaaccggctcatcagcaaaattttggtgggcgaagtcaagaagattgacggacagaaggtgcaggaagtcagaatcgtctataactttgtcggagaaatcccggagattacagcataatcatttcgcctcatctctcaatcagcgagggatgaggcttttctttttgtaaaattgcgatagatatattcacaatttttttacaattaaattcttagtcagacagtagaaaaatgatgacgactccccctacagatgctataatgttcgcatatagatatggcaatttgacaattactttttcttattggtatctgtctttttcttattaacggaggtactgaaatgacattttatgaacagatggttcctgcactttccatattgctggaaataggcgagaccttaaaagcaccgatttacggcacactattgcaaaaaaaacgaaattacacatttggatatttaggattgagcgaaagtgcgctattggtatccctacttcaaggtgattcgaaaaaattaaagggaagcagccgtatccctttcagcaatatccagaaaacaaaagtgcgaaaaagtctgtttccgcttcaatatattctcaaaatctatttaacagatggagatatgataaagttccgaatatctaaaaaagtctatggatttactacacaggaagaaaatctggacatcttcctgaacaaaatgaaaacttatatataaccagaaacattaacagcagaaatgctgattaaaatcttaaccccttacttgaaggagattacctatgtatcaagaaaacgaacttaaaaaattgtatgagcgtctaaaagcgcaatatcctcagtatcagttggaactttcaggagacagtctgactctgaatcggctctactgcaagattgaggtaaaccgatctggcgtaaagctgtatgtaaatgaaaaactgtacgaccaatttactagtgaagatgtaaacgatacggacgatctgtatgaactgattgaggcatttttactggatattcagcacgcaggtatgaagcagggaaacgaaacctacatttttgcaacaaggcaggccgccaagatgggaagccgctttctgatgggaatggctatatgctttactattttgatgattggtctaatcactgcgaacagcccttggctattcctgctgattttccttcttccggcagcgtcgctcctgatactaaaacaaatgcaaaaaaagatcttccaacgctgctggttctgccctgcctgcggtcagtccttgccaatgggcgggaaaggtcatagttgtgagatggagtatgtatcccaatgtcctcactgcgcccatgtgctggaacaaccgccggagttagaggtcgttcagagggaatatgctactcaaaagcctctggaaccgccccatgacctgcctgtgcagggcagtaagctgccttgcattatttgtggtagctttacgattgctttttctctgattctgctgccgctgatttttgtttcggacgggaatgagcctctggacatggtgggcgtgtggactggtgtggggatgcttctgtacctgctcggattcggtttggcgctgctgctgtgccgccacgctgaacgggaagaaacccagcagccggtggtaatcgtgcgagagcggatggtagtcacggttcttggcgtaattgtctgggtgcttggatttgttctgaccatcatgggtgtcatcgtggctgggacgccaccctttgcaccagatgtcaccgcctttgtagccattcccggtgtgttactcttcctgctgggcatatggatgcttttggctggacgcaaccggtctttgtttgtgttccaggataactctattttgtatattagcagttggggcaggaaacgaaaatttgcaccgggacaggtggcttcggtacggctgacggccaaccgctccatccatttactgaacagtgagggaaaaaaattagcctctatcgaaaccaatatgttgggaattccacggtttgcagagtggctcgaaagtaccaatcttgctgcgacattgactcctacgatggaaaaacaaaccagacaagaggaacagcaagagaacaccgtccaatggcgggaggagtaccacacccactggcatgaccatatcaaaagtatccggattggattgtgggttgttattgtattgtttgccgttggcgttcttattcctattccactatatcttttcgctgacgcaaagtttactactgttatgaaaattggtgcatttgctcctattccatttcttttattttgtttggtgtttgctcccgtactctcctttggagacaagcctcagaacgccaccccagagtggagagccatgcacatccatgtcccgctgattatttgtttgttaataggatatacttatttctggcaagttagtgacatttggggcgatttggtgcttcgggaggaagatggcaactggggatggctaattcggatactttccatcaccatagtgttgattgtgctgcaagttcttcgttcaccgaagcggaatcgggtagccgcagggttgtacatgggagtggttggactgtccattgcttgtggacttcattactgtgtaaatgcagctcttattggaccagcccaacattatccagctattattgtggatagccatgcagaagatccagatgtagatgatgatgattacaaattgactattgtgatggataacggggaagaaacagaccttgtagttactgaaaaagtatatgagatggctatgaatggtgaaccactggaaatttgtcatagagaaagtccttttggcgtggtttttctgggtattcatatgccgtcaacagaataaggtagtccagaataattgaatttcataaaagatagaattatttaaggatgtatgacaagcgttctaaattaaaagaacttcacagttttactaagcgggaaatctgaaaaggtttcctgctttttttgtcccaaattaaaggtaataccgtaaataatatcaaaacaaaacaagaaggcaagcgatataaaagatggatttcttttatgccgcttgccttttgggaattcaccacttgactttgtggcaaagatttgcaatgcttgcgatggattttttggctgcaggcacgtcacaggctgtgcagacaactcgcgtcggacttgatatggttctcaacatacggccgctgccattccacaaacgtttcgtgggattcggtcaatccctcccgcagcaattcatccacaacatcactgcagatgcgctcaacagtggcgataatgcgctccgccgcaggcttcgcacccttgccgccctcaccgaaaccgacaccgccgaaacatgcggcggaactcaatcgcaatatgtcttccaactgttcgcacacgccggccagccttgttgccatacggcggctcagcttgcgcatggcagcaaactgccatttgtaatacggcagatacccaacgctcaccggctcattgatcagaaacatcaacgaagccgtggcgttcacgaactcatgaatgctcaacatcgcagcagcaccatcgccacgttgcagcatgcgcggcagattgtattgccccgcctgagccatcatgcccaaacggcgggaaatcaaggaaagtcgaacatcttccggcatgaacttgaacccctgccgagttttggaaaacacccccaacggatcagcgaacacctgaccgtttgtggcagtggccaacgtatcttcctgcaaacttagccaagatgcaacatcgttctgcgccggagcctcacgaaacagcgtgatccgctcgaaaaaatcgccgatacgaaacacgccatcacggcggaactcgccttgcgcacgcggcgtaagtggcgattgagatgcggcaagagcgtcggaattagccgaaccatgccctgcaaaatgcggcttgccctgctcggcaacagtgaaatcgcgactcaacgcatcgtaatcagcctgcaattgctcgccaatcgcatcataatcctcatcggtaagccacaggcagaaacgcggcgcgaaatcatgatcgcgcgacagctcatcgtcgaaaccgaaacattccgaaccataaccgaccaaacctgcggcaatccgcccctgatatgccgaatatgcgccggcaagcaacggtttgccgagatcattccagaatgcgcgagacaaagcaagtcccgaaatatggtgagaaatcgcaggaatcgaagatgcgccggattccgtcatatagtgcggttcacttgattgctgagattcgattgatttcggtgaatgctgagattccaaggattcttgcgattcttgatattcttgcgattcccgcgttttatgagatgatggcatgtgcttatgcaacgcctgttttgccacttcaagattgactgcagtcgtgtgatagtagtcggtgttgcgtccgtagcattcctcaatcacgctcaacgcatgctcatagccggaaaccgcatcctgcaggcagccggccatatagcaggcctgcgcatagccggccagcgccgaagcataatgcgcactatgttccaaatgcccggtacggtagattgtcaacgctttctgggcgtgctgtatggcatcgctcgcccaataccggtccatctgcaggagcagcaatgcaagattggtgtgcgtggaggcaacgtcgatgtcagcgctcgcatcgggggaagattgctccaacaggtccagcgcctgttccagctcgcgcttcgcctgattgagacgaccggtttcgctgtacaacatggacatattgttatgcagcgcggccaggcgtcggtcggtgggggagaaggcggacgtggccgcgtcaagcgcctgacggtacagctgttcggcctcctcgtactggcctgcggctcgcatgcccgtggccgcgttgatcagcgtcgtagcccacgcctgcgggtcgatttcctgaagatgcaaatgatccgcaatgcttaacgattcgcggataatcggcagattgtcggtatggcgaccttgcgaacggtaaaaccccatcgtttcgttcaacaccgtcagcaaaccggcgtcattatgactgtgttcggcttcggtccgcgccttctgcagatacggttcagcctgttcaggagccttatgcgcatcgaaaatcgcatcaagaccacgcaaaaattgttgtacatcaaatgttgcgcatccgtcatcgcaattattcatattcagattgacatcactgtctgccatcgcaatcccttcatcggtgacttccatcatctcccgaactgcagacggcatcgcagacggcgaaaacaacgaaagatggggaacatgcgatacgtcgtacaaagaacaacgggatatctcatcacaataattgtgatgggatatcccgttacataacagaaataatcgaaataactgactgtcgaatgtcagacatgcacttcgcgcatacgctccgtagcgcccgtatgcgtttcgtaacggcgtgaataggtgaccagcataatcaccgcgatcaaggcgatcggagcgccggcgagaccggtgtaatggtagttcatgacggttgctgtcaatgcggcaccaccaacgatcgaaccgaccgcattgccaaaattgaacgcgatctgcacggccgcgcccgcaatcagctcgccgccgccctcaccggcctgcaccatcagcagctgctgcggagacgagttgaagaacagggcgaaaccaatcaggaatgtcagcagagcggtggtcacatgattgccaggaacaaagaacaccagcaacaagccaagcgtggcaatggcctgcgaaagcccggcggtggcaccaggcttccacaaatcagtcaaacgaccgcccgcaataccaccgatcaccatgccgaaaccggcaagcaccattaacaggggaaccagcgaagaatcccatccaccgaccttctgcagccacggtgaaacgtagctccaccagcagaaaataccggaattgccgcagaataccgccatgagaataaaccacggaccggcgtgagtgaggaaacggaactgtcccttaatgccagcgtccttaatcggcgcgacgaatggcacccacgcaatcaccagcaccatcgtcatcaacgcccaaacggcaagaatcgtgaacgccaaacgccacgacagcatttccgaaagcaatgtgcccgcaggcacacccaacatattggcaaccgtctgacccgtcaccatcattgacacggactgcgcttccttgcccttatcggccaaagtcttggcgatcagcgtggccgtgccgaaaaacgcgccatgcggcaagcccgaaatgaaacgagcggccaacaacatgggggaattgaacgaaaccgcgctcaacgtgttgccgaccagtgcgatgatcatgaacagaataatgagattcttcggcggtaccttacggccgaacaccagaatcagcgtgcccacgcacacgccgatcgcatatgcggaaatataatggcctgccgcaggaatgctgacctgcatggcggcggctgtctgaggcaaaatgcccatcatcacgaattcggcggcaccaagaataaaggcgccggaagccaaagccagaatgcttcttttcacagtctctcctccatgaatgtgaagcgtgttggtgtgcgcgcttgtttacgcgcttgtgtattacgtgttttttgatttttcaggtggttgcgtctcgcatatgctgttttgcaccgctgatgcgctggaaataaaaaaggcggaaccgaagttccgccttgagttgtcgggctggcgggatttgaacccgcggcctcttcgtcccgaacgaagcgcgctaccaagctgcgctacagcccgtttggcaacagttggaaatattacacgattgcttaagtaatgcaaatacggcgtgtcgcgtgtggtgtagtggcttctcggtacactgtgggcttatgagtgagaccatcgaatcgcaagaaaatcagaatgaagaggctgccgttcccgctatgactacggtggagcgcgccgaaatgctgctgcagcaggatgcggctatctacgccaagatcaatgacggcgccaccctggatgaggccgtcgatccgggcaataaggaattcggaccgctggcgcatccggaacaggtgcagatgcgcgtggccaagcgtgccatgatgcttaaggacggcattcagccgtacccggtgaccctcgacgtcaccgccaccatcgaagaggtccgcgccaagtatgacggcaagcttgaagccggagacgaaaccgaagacgtggtcggcatcgccggtcgcgtactcttcctgcgtaacgccggtggcttgtgcttcgtgcagctttccgctggcgatggcaccaagatccagggcatgatttccaagaaggagattggcgccgattccttgaagcagttcaagcagctggttgacttgggtgatcacctgttcatcaagggtcgtgtgattgcctccaagaccggcgaactgtccgtgttcgccaccgaatgggccattgcagccaaggcgcttcagccgctgccggccctgcacaaggacctgaacgaggatacccgcacccgcaagccgtacatcggcatgatcgccgacgagaagatgcgcaacatggtgcgtaaccgctccaaggccgttgcttccctgcgcaagaccttcgccgatcatgacttcctcgaggtcgagactccgatgttgcagaccgtgcacggcggtgctgcggcccgtccgttcaccacgcacatgaacgcgttcgaccttgacctgtatctgcgtatcgcgccggaactgttcctcaagcgttgcctggtcggcggcatcgaccgcgtgttcgagatcaaccgtgacttccgtaacgaaggcgttgacgccacccatgctccggaatttaccatggttgaggcctatcaggcttacggcaactacgacaccatcggcgcgctcgtcaagcagctcgtgcaagacactgccatggacgtgttcggcacccacaaggtgaccctgctggacggttccgaatacgatttcggcggcgaatggaagaccatcagcatgtatgattccctttccgaagcgctcggcgaggaaatcgtgccgaatggcggcccggacaatccgggtacttccgtggaacatctcggtgccattgccgacaagctcggtgtggaacgcgacgatgtggagaaccacggcaagctcgtcgaacacctgtgggagcacttctacgaagacaagctgttcgagccgaccttcgtgcgtgacttcccggtcgaaacctccccgctggtcaagggccaccgttccaagcccggtgtggtcgagaagtgggatctgtatgtgcgcggcttcgagctggccaccggctactccgaattgaacgatccggttgtgcagcgtgaacgtttcgtggctcaggccaaggatgcgctcgcgggcgacgaagaagcctgcgatattgatgaggacttccttgaggctctcggcgtgggcatgcctccggcaggcggcatgggcatgggtatcgaccgactgctgatcgccctgaccggcgccaccatccgcgaaaccatcaccttcccgctagtgaagccgctgaattaaggcaaagccttaattcaatatcggcttcacgcgaggcggaaaagctgacggcccagtgggccgtcagcccgccggagccatccttataaaaattgccgctgaattaaggcaaagccttaattcaatatcggcttcacgtgaggctgcttgggtacaaccaggcagccccgcgtcttttaatccccaattctgtttttattccctaatttctggcgctggtcctgtgctttcgcgcacgacaagcgttggtggaaacaatagcgtgcgctgcgcgtcttcggactgatgcttggatagtaatgtggcaagtgttgctcgggtcatttccgccagtggctgccgcatggtggtcaatggcggtccgagatgccgtgcgctgttgatatcgtcgaatccggtgacggacagatcttcgggaatcgacagtcccaactgatgtgccgcgtcatatatgccgaatgcctgcgtatcgctacaggcaaatactgcagttggacgattcttttgctgcagtagatcaagcgcgtgcaagcgtgcattttccgaccagtagtcgccttctcgcacttgagtgtcgttgagaacgatgtcatgctgtgctagtgccgcacgaaatccagccaatctggcggggtagcaggtggtggacattgggccggtaattgccgcgaattggcggtgtcctaagttaataagatggctgccgatttcgaatccgcctgtccaattgtcgatgcgcacgtccatacaatctttgcatggtgttccggatgggtcgactaccgcatatcgagctccaagttcttggcaaagcgttcgatctcgcattggcacgtaggcgttgtcgaaaatcactgctttgggtctggctcgacggattgcttgccggtaggtgtcgttgaggatgccatcggaggcgtttttcgcgcagatggtcacggtcatgcttcgtttgacggcggtgtcggtggctccttgcatgatgtcgagcacccatgggttgtccatggattcgagcaccaacatgatggttgtggacagcgcgtgtttgactggcggtttgctgtattccatgtctttgagcagcgcttcaatgcgttgccgtgtttcgtcggagactccggaacgtccattgatgactttggagacggtggatggcgtggtgttcgcaagtttggcgatgtgcgacagcttcggtcgttgactggcggtacgcatattggtttgcgatgaagacagtgtcatgatagcagtatagtagagaaatttcttctaatgattgctatgcagtgtaatcattgtgttggagtgcatgataattgctgtttatctgctgtatattgacatttgcaagaaagaaatttccttatcatctcaagaatttgcatttcattttctctactctgacatcagacggcgaaaatgcaatatacgcaatgagcgcaggtgcgaatcggccgtcagggataagaagcattgtcatcgcgttgctgcgaatggcatgatggctcgtattgcacgggctgttcgggattctcgacaaaggagttgttgtggacaacgcgaacgttaagctctcccttaaggagaagctcagctatggagcgtcggattgcgcgtacaatctggtgttcaacgtggtcaccacgtacatgatgttctattacaccgacgtggccggcattagcctgctgtctgtcggtacgctgttcctggtggtgcgtgtgcttgacgcggttgcaggtccggtggtgggtgcgcttattgataaaacgcataccaagtggggcaaggtgcgtccatggttcctatggttcggtgcgccatttgccatcataggtgtcatggcgttttcggtgccgaacttcggcggcgtaatcaagatgatttatgtgtacgtaacgtacatcatgatgaatttcctcgccgtcacggtgaccacgccgtgcaccgcgctgctgccgaacctcaccaccaacgcccaggaacgtgtcaatgcaaatgctttccgtaatgtcggcggtcagatcggcgtgattgcctctggtatgcttactctgccgttggtcaacctgatcggtggtggcaatcagcagttgggctttaccgtcaccatgatcatctatggcgtgatctgcgtgggtctgttgctgctgacttttgccaatacgcgtgaacgtgtgtttacccctaaggagaaggagccgccgttcatcaagagtttcgtggccatgctgcacaatgggccatggtggattcttgtcaccctcaaccttgtcatgttcattggtgtggtaaccaaggcctcgtccatcgtgtacttcttcaagtacaacgtcggcaacgaaactctttcctctttggctaatggcatcaattcggctggcatgattgccggtatgattcttgctccgttcttcgccaagaagatgaagaaccgcaatatcgccatcatgttcttcggattcggcattattggtctgcttggtctgtacgttggtgccaagatcatgtccattccgctgatcttcgtatccatggcggtttcggcattgttccagactggtcaaagcatgggcttcgtgatgttggccgatgtggttgactatggcgaatggaagaccggtgtgcgtagccagggcttgattacttcctgcgcggccatcggtgttacctgtggtgcgggcatcgccggctggctctccagttttgtgctggaaatcaacggttttgtgcctaatcaagagcagacggcgcaagctctgaacgccatcaacatcaacttcgtgtggattccgatcgcctgctgcgctatcggcactgtgctgatgctgctgtacaaggtcgatgatcagatcggcactattcgtgaggaactcgcagtccgtaatcaggtcgttgctgagtaaacgcaccctgcgtatcgcgcttcgggcttcgaaacggtttgatcccaattcccttttccgttcgaagcccggaacattcgttttacaaaccaataaggaaatcatcatgagtgttatggaacctgctgttttcacagtggaacgtgccgacggtacttctttgacgttacgaggtacccgttatctgccggaaggtttttcggaagacggacattcgccggtggcggtgctttttcatggcttcgggggcaatcgcatcgacttttccggatttgtcgtgcaaatggcgcgagaacttgcttctcgtggtctcgtggtcgttacttacgatcgtgctggtcatggcgaaagtgatggtactttcttcgatactaccgttagtggcgatgtcgaagacgccttgcaggtagtggagcaggctcgtcatatgagcggctgcgatccggataatctgcatttcgctggactgagccttggcgcggtgatttgcacgctgttggcaccgaaggtgcctgggcagcccaagtcgatcgctctgtgttctacggccacttcgtatgttgatgagattgccggtgggcatattcagggtaagcctctgtctgccatcgaagagcaaggctatcttgactttatgggtgttgccatgggaccggccatggtggaggatgcgggtcgtaccgatccttacggcatggcttgcggatatcgcggtaaggtgcttgccatccatggcaccaaggatttcattcctgttgactatattcgtcggtacgaggatgtgtatggcgaaaatatgcagctcaaggtcatcgaggatggcgaccatggtttcggcaatgtgaagcatcgcgaaatggttatgccggctctcggtgattttgtggcagagcaggcaggtctgtaaggccggaaggctttgcgccgtatcggacttcttgtcagtgcacggcaagaataatctgcgacctgtagtgttgtgacctggtcgcagatttggggcattcgttcgcgaatgccctttttcccgtatccctttcgtaccacccagcttgcctaccgcagaatacatgggcgtgaggatgctgaatcgcagggtgcgattgaagctctccatgttttcaaaaaagaaatcccacgggtttcatgatatttcgcatgagtgacgttctggggcattctccggtattgtgtcgatttctggaaacagacgaaatatcaatgagtatggtcaggttgtgaatctggaatgcgggtaggcggttggaaggcgaatcgtgagtgtgattctagaatggcgttcatgggaatgacgatttggattcgtggcgctcgccctcaaacgctgccgctgggtcttgccccggttctggtcggcgttgccgccagttggcggtgggaggctttgggtggcctgcggtcgtgcccagcttttccgggaagattgctggaagagcatgatgctggtgatgtgctggggtattgtgcgttttctcggccgtggtttacggtcgttgcgatgttgtgcgccgtggtggcggtcggtctgcagattgctgtgaattatctcaacgattatgccgatggtgtacgcggcacggacgcccgacgaggcagtgacgccgcgggacctcggcggttggtcgcttccggagtggatcccagtcacgtgttgctggctgccgcggtcgctgctttagccgcctgtgccgccggactggtcgctgtcgtcataactggtcgctggtggctgatagcgcttggcgcaacctgtctggtggcggcctggggatataccaacggtcggcatccttacggatatcggggtctgggcgaacttgcggcattcgtattcttcgggttggttccagccctcggcacgcagtatgcgctaagcgggtcgatcaccgtgacgggggtggccggttcggtgatctgcggcctgctgtccgtcagcgtcatgatggtgaataacctgcgcgatctcgaagatgacgccgcgcacggcaagcgcacgctgatggtgcgcatcggcagtgggaagggcaaatgctggtgcatgcgtgcgctgggatgggctgctggtctgacggtggttttcgccatgccattatcggtgtatgccaaacttctggatctgctcataaagctgcctgcggaggtggatcgcgaccgttcatgcacggaatatggcatatgcggtgactggtcgtggggaaacgccgattggatgagccttgcggcgttcgtatccatcgcagggtgtgtggcgattgctactcgtgccgtcgcggccgtccggcatgaccagtggcgtcgggcgttgccattgtgctcgatgacctcgttggtcgcagccggcgcgttcgtgctcaatgcctgtcaggccggtttcatggcgtagctgcatcctgcatttacgatttcgtcattgagcaccggcgattgcctgatgatgcaaacggcatgcaacagaatgaaaattgttgcatgaacgtaaccaaataatcgtcatcgacggttgtgttgggcgtgctaggcggtagactggcaggtatgacttacaaactagtactgctccgtcatggacagagcgcatggaataaaaccaatcagttcaccggctgggtcgacgtcccgctgaccgagcagggtgtcgaggaagccaagaacggcggccgcctgctcaaggagaagaacgtccttccggatatcgttttcacctcgatgctgcgtcgtgccatcaacaccgccaacgtggctctggatgaggcagatcgtctgtggattccggtcaagcgcagctggcgtctgaacgagcgtcactacggcgctctgcagggcaagaacaagaccgagatccgtcaggagtacggtgacgagaagttcatgctgtggcgccgttcctacgccactccgccgccggagatcgatccgaacgacgagtatgcgcagaacaatgatccgcgctacaccggcgatccggttccggaagccgaatgcctggccgatgtggtcaagcgcgttgagccgtacttcaagtccgacatcgagccggagctgaaggctggcaagaccgttctgatcgccgctcacggcaactccctgcgcgccatcgtgaagatgctcgacaacctctccgaagaggagatcgccaaggtcaacattccgaccgcaatgccgctgctgtacgagctggacgagaacttcaagccgatcaagccgcgtggcgagtatctggatccggaagccgccgctgctggtgccgccgctgtcgccgcccagggccagaagtgagtttgttgcgattgatacgcaggtagtcgcgttcaatcgcacggaacgtatatgaaaaggtggaaatccacagtatgtgggtttccacctttttgcgtccggtatctttgttgggttattacgtccgtctgccggatggaatacggaacatgagatgtgcggcagacggacgtcaatcgcaatcggctcagatcacgccgtattccttaagtaacatcggaatatcggtggaatcgagcttcttcagaatctgtttcagcacggtcttttcaatggggttgagtttcatgtcggtaatcggcttgacgtcacgcagcatcaccgtggcgttgagcaggttgcgcacgtcgtagaccgaaccccacacttcgggcacgccacgatccacgtcgcacagcgtgtacaccgcttccatgccggtgcgcatcgaatactcggtggtgaagatcgtgtcgcgcggggtttcggcgaactgtccgaggaatgcgaaattcacggcaccatcaggtaccacatcagggcggtcgccggcggaacgaggcatgaagaacgcgtcgatgtatggcatcatcaccggcacggtgttcgcatggttcgtggcgagttccttgatcttgtcggtcggcacgcccatatggtagagccattcctcgcagatttcctcgcccgtgcattcctgcatcggcttcttcacatagttgccgggcttgtcggggaacagaccgtacacccatacgctcagctggtctttcgactggtcgcggaactgctgttgacggttcaacgtccagctcatcagccagttggaatcctcaacggttacgatgccgccggtcaccacatggccggtgaacgggtcacgcttgcagatcttctgaatatacggcggaatctccatgtcaagcgtggtaacggtggcactcatccacttcgaatgctccggatcgtcgcagaatacgtccgggtggccgaaactcgggtcttgcttggcgatgcgacgccacatgtcccagccgccgccgggcttgatctccggagcccatgcggctgcttcggtttgcgagcccatggtcgagttttccacgcagccaccattggtgatgaacaccaagtcgttttcgcccaaatcaatgcttcgcgcggtgccatccgcttcggtcaggtcgatgcgcgtagccattttcttggttggcgaactgtacggattgcgtacgaacacgccggattcagcctgcttcttcaaaatcgtgtcttgaccggtgccggtatgcgaacgtaccggtcccatgcctccgccaatcttgaaatcgacattctccactttcgcgttgtagtggaactgcacgccgaatccttccaaatacttgatcatcggcagaatcatcgactcatactggttgtaacgggtgaaacgcaacgcactgaagtccggcaatccgccaatatgatgaatatatcgacggatatacagcttcatttccaacgcactatgccaattttcgaaagcgaacatggtgcgccagtacatccagaaattcgaattgaaaacctcatcgtcgaaataatcggaaattttcttgccgtacagttcctcattcggcgtgaagaacaattgcatgatctccatcgaggctttgtctgacagattgaatttgccgttcgtgcctgcgtcaacgccgcgcgctttcgtggagcggcagagtgagaagttgggatcttccttgttcagccagtaatactcgtcaagtacggaaacgccttccgtttcgatggatggaatggaacggaacatgtcccacatcacttcgaaatggttgtccatttcacggccgccgcgcatcacatagccaacgccgggaatatttgcgccatcgcaggcgcctcccggaaccgcgtccttttcgaatacgtgaatgtggctgcccggcagttgcgcatctcgcaccaggtaacaggctgcggtgagtgcggccaagccggtgccgatgatgtacgcgttcttgctgtccatgccttcgggtttcttcggtcgggcgaatgcttcgtaattgccgttggaataatacatgactgcctcctttggatgtcactgcacatattgtgccgcgacattgcgtaaaagtatatgggcaaaaaatagacagattgtttaatttttcttacggcttgacgaaagtgaaataatgcgggagatagtgcttgacgattcgtgctgaaagattgcaaaaacaaaacaagaaggcggcttcagtggggaacggaagccgccttctcaaaaagaagatgaaaaagaagatcgcaagaaaaaaatcaggcgatgtcggtgtcttcgtcgcgggtcggctccttggacgggtcgaaaccggagacgatgtacaccacgcggcgagccgcggacacggcgtgatcgccaagacgctccatgaagcggccgatcagcaccacgtcgatgagctgctggttggtgccggaccaatccgcggactgagccagttcaaaggtcttcttgtgcagttcgtcgagcttgtcgtcgttgatgatgatctgttcggcggtcttggtgtcgcggtcagacagcatggccacggtctggtcggcgacgtcgttcaggaacgcctgcatttcggcgaacagcggttgggcttcggccggcagcggggaagccgggtaggtgcggcgggcggcttcggcgatgtgacgggccagatcgcccatacgttcgaaggtggtggccaaacgcatggtggaaacaaccacgcgcagatcggtggcaaccgggttctgcttggccagcagcttcacgcactggtcgacaacgctggcttcgagggcatcgatttcgatgtcgccgtcgataacggcctgggcggcttcaagattctggttcagcagcgcgtcgccggcaccgttgatcgccttgcgcacgcctttgaccatgtggtcgagatcatcggcaacagccttgagctcctcgttgaaaataacgcgcatgtgacttgcctttcaatgcttcatatatatctgggttcgatataacctctcacaagtctattagacaaacgccatattcgtaaccactgctcgtgttgttccgtcaaagttcaccaacgcgttcaccttgtgttcacgaacgagcggtggtgtcgcgagttggggagcctcaagagtgtgcaacaatgaaaccatggttgaatctttgggttcgtggtggcgttcgctgacgcaccgcaacgacgatgatgagcatgatgccgatgaggacacattggatgatgccaccaacgcgttgctttccatgctgccgttggcatccgtcgtagttgacgagcatgacgaagtgattcgcgcgcacccgtcggcgtatgcgcttggcgtggtgcgcgatgatgccatcgcggaagagaccgtgcttcgcgcagtgcatgaggtgcgttcctgtggcggcaacaaacaatttgatttgaccaccaccacccaatatgtcgcccagcaagtgccgaaggcaggcaaaccaaccacacgtgaaatcgcgcgccaggcactgatagggcagtcaaaacccaatacttccggcgcaaccgtttcccgacccaactggctgaaaatcatcgtcggcaaactcaatgagaatctcatggttgtgctcatcagcgatgtgagcgaaagcgtacgattctcgcaggtgcgcgattcgttcatcaccaacgtttccgaacaattgcttgagccgacgcaatcattggaacagctggcggacattgtggaacggggcggtgccagccaacaggacgtcgaacgcaacgccacgcagctgcgtcaatcctgttcccgtcttgagcatatgatttccgatctgctgctgctgatcaaagcgcaggagccaatcctgccgaccgccgacaatcgcatcaacgtgatggaacaggtacaagccgtggtgcaggcgcatctcgatatggctgcgcaacgcggcatcaccatcgagaccggcggtgacgaatcgctatgcatcaatggcgaagccgatcagattcaggcggcgctcgcaaaattgattgaaaacgcgattacgtattcaaaagacggttctacggtgaatgtcgtcgccaaagccaatgaggagcatacggaagcggtaatcagtgttctcgatcgaggcaaaggcatcgccatcggcgaacagaaccgtatttttgaacggttctatcgcggcagcaatcagaatgagcattccggtgacggcattggcttgggacttgcgattgtcaagcatgttgcgttgacccaccatggttccgcgtcggtgtggagcagcccggggcagggaagcacgttcgccttggtgctgccgttgggtggggaatgatgtaagacattcggcagatgttgcaaatatctcaaatggagataatgcgatgcccgtctcgctttcgataaggcaagacgggcatcatttttttgaggatttttcgggggtatattgccgattactcgccaagacggcgataatcccaacggtcgaaatgctcccaaaccagcatgagcacgccgatgaccgtacccgcttcgcagacggtttgcgcgcgttccgcgtcgatgccgaatgcgataagtacgatgcagaccaccaaagcgatggcccatagcgcggtgccaaacatgaataccttgcgtaggtcgacgcgcaccggtttcggcgaaggtttcctcacgctgggatcaataatcggagcaatcttcatatcgccacaccttaccttgcatcagagatgttccaccacgtagtcgatacagcgggtgagcgcatccacatcgctgggttccacggacgggaacacgccgatgcgaagctggtttcggccgagcttacggtatccgttggtgtccacaatgccgttttcgcgcaatgccgccaccacttgggatgcattgatgccatcgttgatatcgatggtgaccacggcgttggagcgcgcgttcctgtcgtttacgaacggggaggcgtaatcggacttctccgcccactggtacagcagggacgcagaccttgcgcagcgggccgaagcccaggcgagcccaccgttgtcgttgagccaacgaacctggttttccagcatgatcagcgttgccactgccggcgtgttgagcgtctgatccttgcgggaattctcgatggccgaagtcagggaaaggaacggaggaatccagcggcgtgcgcccggaagatccacgcttttggcgatgccgtaggcgcgttcgattgcagcgggggagagtacggcaatccatagtccgccatcggatccgaaagctttttgcggcgagaaatagtaggcgtcggtctggctgatgtcgaccggcagcgcgccggcgccactggtggcgtcgatcagcgtgagcgcaccctgctccttggtgcctgcgatgcgtttgatcggtgcggcaacgccggtggaagtctcattgtgggcccagcaataagtgtccacgtattccgtgagctcaggcaggcggtatgttcccggctctcctgcgaaaatctccggctcctcaaggaacggtgcggattgcgctgacttggcgaacttcgagctgaatgagccgtacgtgccgaatgcggccttgcgggtgatcagcgaggcgcaggcgatatcccagaacgcgctggctccgccgttgcccagcaccacttcgtagccatcgggaatctggaagaattcggacagtccttcgcggattgagccgaccacctgcttgatgggggtctgtcgatgggaggttcccagaagattacgggctcccttatcgagcgcttggatttgctccgggcggattttggtcggccctgagccgaaacgtccgtcttccggaagcacgttggaaggaatggtcacagtgttcgtcatgacaacctagggtagtcagatggtcggattgtgcgtggtgatgaccgcttttcggaaccatgacgtggcgatgatgactgcgatatcccggtgtcggtgtagcctgagcttccgtgacggttctgtaaccacgcggtcataagcctgctgtggttgaagtaatccgcaaggagtgttgatatatgaggcatgcggcgcataaagctgccaaggtttcgaatgagcgtttcagcgttgccaaggcgctgttcacctcgagccgcggttcccacaccgccaaggccgttcgtatggtccagctggcaaatggtgggggtgccgttgtaggtcttgagcctgcggttgccgaaaagctgaatgaagtggctccgatgagccgccgcgccatgcgtgaagccgctcgtgcggccggtcgtcgctccgcattcatggcttccgcatcgctggccgcgctggtcggcaccgcggccactgccatggcggtcggccagcagaatgcgtctgaaatgacttttgccgacaatgccgccactaccacgcagatgaagcgtgtctccgacgatgcggcatcccgttccgagtcccgtagcgatctagacgctctggcctccaccagcaatagcggtgattggcagcttggcgaaaccagttcctccatggacacgaatcttctgtcaaagtccattgccgacaatcccaatgtcgccgttctcatggatcaggacgccggtcttcttccttcgggcttcaatccgaaccacggcaccggtgataccggcaatgactatccatacggtcagtgcacatggtgggcgtatacccgtcgtgcacagcttggcctgcctgccggaagccattttggtgatgcgcggagttggggtgattccgctcgcgctctcggctattgggttgacaatacggcacgtcacgttggcgatattgtggtattcgctccaggccaaatgggcgcggacagctattacgggcatgtcgcgattgtcgaaggagtgaatgccgacggttcgattaagatttcggaatccaacgtcaagggtcttggcgtgatttccgatcgtacgttcactgcgcaggaagcttcgcagttgacatatatccattactgatttctctgttttcgttaatctgcgcttgtcgtcactttttggcatagcgtgattgcgtcggcgtgtcgcgtgatatgacactgttctggttatcttgctgttctgctgcgggggaacgtgtatggtagcttcagacacgatgaatattgctaaacgtttcacgagtatcttcgccgttgttgctgtatctgccttgttgggtgcggcggttcccgccgcaagcgcaggcggtgctatggctgataccacggtaaccgctacacgttctttcccgaagaccaccgcggctaagcgtgattttctcgccgagcacacatccacggatgttgaatctaacgccgattggggtggcatcgaaagcttggatgttccccagaccgagtctcaggcggaaaaggaccagaaggctcaggagcaggctgaggccgaagctcaagcacaggcggcccaagctcaggcacaggctgaatctcaggctgccagtcgttcttccgatcgtgcttccatcagcgttcctacggctcccgcgagtgccactgggcaggctctggccgactacgctctgcagttccaaggctatccttacgtggccggaggcaatactccgtccggctgggattgctctggtttcgtacagtgggtgttcgcccagttcggggtaagcctgccgcattattctggtgcccagatgagcgttggaacggcagttggaagcattgccgaagcagctcctggggatatcatcgtcaatactcagcatgccgcgatctatattggcaacggcatggtgatcaacgcgctgaatccggctcagggaacgcaggtcacttcgctggccgtgttctcaggtggctatgcgattcgtcgtgtgctctgagtgaacatacggtttgatttttttaaggcgtatcctttcggggatacgcctttttgtatggaaaagaccgagtcgttactgacaaaaccgcatgtcgcgcggtatggtggagcctagaggcgacgcatggtcgcgttgccgaggtgattcaaggaggtcgtccatgattaacgacaaggcaatcctcgttggtgttgatggatcccacgccagctataaggccacttggtgggctgcgaactatgcgaagcatgcgggactgacgctgcagatcgtatgcgcatactcgttgccgagctatgccgctgtttccttcgacgcgacatacaccgccatgggggatgacaatgcggcccatagcgacgcgcaggagattctttcgaaggccaaggccatcgccgacgagcagggtgttgaggctaccacgcttattgttacgggcgatccggcttccgtattcgtggaactgtctcgtaactacaatctcatcgtcatcggcaatcgcggcaaaggcggtctggcggaacgtctgctgggcacgaccagctccagtctgccggcgtatgcatactgcccgatcgtagtggtgccgtacactgacgatgacggcaatctgatgcacttgaacaacaccatcaccaaggtggccgtcggctccgacgaatccaagtggggtttgaaggcgctggagatcgcggcgaatttcgccgccgcatgggatgccgagctggatgttatttccgcggtgccgaacatgaagggttccgacgacgaaggtgtgatggcctcgttcaaggatgatctggaagtgcgtatcaagccgcttgaggaagcccatccggatttgaagatcaacaagcagatcgtgcctggcccggcggttggcgcgctgaccaaggccagctatgatcacgacgtcgtcgtggtcggttcccgtggtcgcggcggcttcactggcctgctgctcggctccaccagccagggcttgctgcagcacgcggtcggcccggtgtatgtggtgccccgcaagtatgtcgaggctgcggaaacccgtcttgacacggttccgagctcgccggcggaagtcaagccgaaggctcttgacgatatcaagggtgtcgaggaggtgccggtttccaaggccgagccggatgtggtcgaagccatcgaaaccaagatcgatcccgatcgtcagtaaattcaacaggtacatataaaaaggcgattgcaacactgcgaaaagcgttgcaatcgccttttttttttaaaaaaagaaaacgtcagtgcttgatggtgacgtccatgcggaccggagtcttctccacgtacgtatgcttcaccgtgcagcccttgtcgatatgacgagtgacgcgttccttaagctttgccgcatcctcatcgctcagaccggcgtcggtggcgtcgatgaccacctgttcgtcgaaaccgatgtatgcgtcattgtcggcgtcataggtgccgtccacaacgattttcgcgcccttgccctcgcccagcgtatgctcgacggcgaactggcttgacagtgcggcgcaaccggccagcgcgatcttcatcaggtcgcccggcgtgaactgtccacgacccttgccgaacttgatatgcgcgccatcctcgccgaaagcatcccaagaaccgtctttgttacgctcgacccacagtcttttgcccatggtgaactcctcatcgtcttgccgggagcgccgttcgctcctcgcctacatacctaatgtaatccattgatgcctgttcgctaggaggcattccgaaaagcgtaaacaatcaacgcgcgggtggcatatgcttgacctgccgttctgtactgttaagcttgcaaccatggctttgacacctgaacaacttgcagatatccgtacccgtattccggcacgcccggaaaccgacattcccatgccatatgaagaccttgtgcgcaagatcctgacggaaggcacgttgaagtccgatcgtacgggcactggtaccgtcagtctgttcggccagcagatgcgattcgacctgagcgagtattttccgctgctcacgacgaagacggtgtttttcaagggacttgcctatgagttgctgtggttcctgaaaggttccacgaacgtgcgttggctgcaggagcgcaatgtgcatatttgggacgaatgggccgatgagaacggcgatttgggtcccgtatatggcgcgcagtggcgtagctggccggcgcccacgcccgatgatccgaaccgtaccatcgatcagatcagcaatgtgcttgatcttgtcgagaatcacccggattctcgtcgtatggtcgtgtccgcttggaatcctgccgaagtggagaatatggcgttgccgccatgccacgcgctcttccagttctacgtggcggatggcaaactttcgtgccagctatatcagcgttcctgcgacatgttcctcggcgtaccgttcaatatcgcatcctattcgctgttgacgttgatgatcgctcagcaggcgggactgcagccgggggagttcgtgtggacgggtggcgactgccacgtgtacgacaatcacatcgaccaggtgttggagcagttgagccgcgatccatacccgtatccgcagatccgtattaacaaagccgattcgctgttcgattacgattacagtgattttgaaatcgtcggctaccagcaccatccaaccatcaaggcgccggtggcggtctgagagtcgtcgccagacgttagactactgaccctagttcgactgcaaggagtgagtgaaatggagcatgacagtagccgcagtggctatcacgaacccgagcccggacttgccgggcttgaggacgaggaggattggggcgatgatttccccaagacgttctcggtgaatctgatttgggcgcaggcctgtgacaaggaaggtcatgacggcgccatcggattcgagggtggcatgccatggcatctgcccgaggatatgaggcgtttcaaggagcttaccgtctcgcatccggtcattatggggcgtaagacgtgggagtccctgagcccgaagtatcgtccgctgccgaatcgcgacaatatcgtggtttcgcgtgatccggcttacactgcgccgggagcgaccgtggtcgacagtctggatgatgcgcttgatctggcacgacaggaagccattccggatgacggtcttgaccgcagcgaaatctggattatcggtggcggtcagctgttccgcgaggccatgccatttgcggacaaggcgtatgtgacgcagatcagcatgcatgccgatgccgatacctacgcgcccgacgtgaagtcgctggtggaatccggcgcttggaaggtgcttgaagagggtgtgtggcagaacacgcggaagggttccggagatatcgccggattccgtttcatgacgtatgcgaagaatcgcgaggagtaaccgtatgtataccgtgatgaccgtgtgtaccggtaatatctgccgttctcccatggccgaaatcattctgcgcactgaattcgagcgtcgtggccttgccgacaaggtcaacgtcgagtccagtggcgtgagcgacgaagagtatggcaatccgatcgatcgtcgtgccgtcaaggtgctccgtgagcgtggatatgagctgccggcacatcattttgcccatcgcatcacccgcgatgagatcgagcgtaccgacctgtttctgccgatgaccgcttcgcatatgcgtgcgctactgcgtcagctgccgcaggccaagcgtgagaacgtgcatatgtaccgtagtttcgatccgaatcttgccaagcctgtcgcaggctacgaaagtgagattgatttggtcgatccttggtatggcggcgcccgcgaattcgaagtggcgattgaccagattgaggaagtggccccgttcatcgttgattgggttgagcggcagctctgacgattgcatacgatttttccgtcgaaaagcccggttcgcaagagccgggctttcttgtatccgtatgatttcaatgatttcgaaagatcttaagaaatcgcaagagattgcaaaagtaatattgcgcaattgatgtaaatcagagaaaaatagaaatgaaaaataaaaaagcgaccccggccggacttgaaccggtgacctccgccgtgacagggcggcgctctaaccaactgagctacggggccgttgtttcagccttgcgactggcaacagatagatatattacggcaaagtcgctatcgtgcaaatttcggcgtgtcatcgatgaatattcgtatgaattgctgaaagaaagtatttgcttaaactgcggcagtagtagggaagaaaagcaacggccggtcgcatatgaggggaaaacttctcatatgcgaccggccgttaccgttgcggtgccgtgttgtcgctcacgacactacgaattgctggtggaatcagtcggtctgtttccaggtctcgacgtcgatgtggtgttccggattggcctgccatgcatcccaagcggacttcacgatgtcttcgacgttgtactgtgcgtgccagcccatctcttcgttgatgcgcttcggggagccgatcaggtgcggcggatcgcctgcgcgacgggccatgacggtctctttgaacggcaggccggtgaccttcttgacctcatcgacgatctgacgcacggaggtgccctcgccggtgccgacgttgaaggcgtcgtacttgcgttcatcgcggtccagatacttcagggcggcgatgtgggcgtcggccagatcggagacgtggatgtagtcgcgcacgcaggtgccatccggagtcgggtagtcgtcgccgaagatcgcaggggccttgcccttcttcagacggtcgaacagcatcgggatgaggttcaggattgccggatcctcaagctcgaccgggccgcagccggccacgttgaaatagcgcaggccgcagaagcgaatgccgtacggctcttcgcaggcgcgtgccatccactcgccgaacagcttggtctggccgtacgggttgatcggcagcatcggaacgacgtcttccggaaccacgtcgaccggcggaacgccgtaagtggctgcggaagaggagaagacgagcttcttggcgccggagtcgcgcatgccgatgagcacgttgagcatgccgttgatgttctgctggtagtaccacagcggcttttcaacggattcgccgacctgcttgcgggctgcgaagtggatgacggaatcgacgccttcggccttcatgatttcggcgaggcgttcgccggcacccggtgcggcgatatccatgccgtacaggcgggagccttcgatgcgggttggcttgccgtagctcagatcgtcaacgacgacgacctgttcgccggcctggtgaagagcgtggacgacgtgagcgccgatgtagccgcacccaccagtgacgagaactgtcatgttctgtcctttcctccaaaatgagcgttaaagcgctttggttcgaaaaacaaacgtccaacgaacgttgttcacttttgctctagtttgttaccttttgaacaatttgagtataacacatgaacaggaacgcacataatcgaccctttcctgcgtttcctctataaattagggtatgcaagaagatgtgaacacgccgactgaaaatcaagttaacggcgaaaacggacaaaacatgtcaaaaacgcaagatgaacaacgggctgatgctggccagcgtcctgccttgtatgggcgcaaggtgttgtccttcgtgcgtcgttccgccaggctcgacgcacgcttgcagcgtgcatgggatgcctatgcagatacgtatctgctgaaaatcaacgcgggcgaggggtcgcttgatgtgcgaggcgatctggtgttcgatcgggcgtatatcgcggatgtgtggggcaatgtcaatcctctgattgtggaaatcggtaccggccagggggaaaacgttgttgcggccgctgctgaacaccccgatatgaacttcctggcgcttgaggtctatgatccgggcgtggcgcataccatgctgctcgcaggcaagcaaggcctgaccaatctgcgcatcgcgcaggtcaacgctcctgagctcttcaaagccgcggcggatggatcgatcgctgaagtatggaccttcttccctgatccgtggcccaagatgcgccaccacaagcgtcgtatcgtgcagccggagcttgccggcgagattcatcgcacgttgcgggatgggggagtgtggcgtatcgccaccgacatcgaagactatgcattgcatgtgcatgaggtgatggatggtcttgaaggattccataatgacggcatgcttacggtgagtttgccggtcgagcatgttggcaagggaaatgccgacgaagcggccggtctgcgacacgccgatttcaccgaatccgagcgtttttccggacgaattctcacgaattttgagaaaaaaggacttgctgccggtcgtgtgattcatgacctcacctatcgctgcgtatagtgccggttggtctgttgttgaagtgctgaaatggcttgatttcaacgattttcagcactttggcaacgggttgatggcgattttgcgacgctgcgacacgccgagatttgcatgttctgaggattcgcgtatagttaagcgagttgtcacgcggaaacgctgaaagcgcccccttcgtctaacggttaggacaccagactttcaatctgacaacgagagttcgactctctcagggggtacttaccttggtaacaaggtggcaatggccccgtagctcagttggttagagcgccgccctgtcacggcggaggtcaccggttcaagtccggccggggtcgctcgaacagattcctgttcatggctctgtagctcagttggtagagcgaacgactgaaaatcgttaggtcagcggatcgatgccgctcggagccaccatggctttgaaacctcggaaacatccgaggtttctttgtttttgcccacacgtatgacgattgcggccgtatgtctagcgccaagccactgatgccggctgttggttgaatacgcgctcgcattgcgggtaagccccctaaaatggtcgacgcaagtcatgttgacttgcgagttactgagaaatgactaagaaaacctccgttagagggggagtctgtctgctgtttggctacactggaacaccgtaaggcagtaacaatgggggtttgtgggcagagttatgccgtaaccccgttaagggagtattcgctggggtggcggcatggaagtgcttctggtcggcaacaccgacttcattaccaagcagtggattcagcattcctttccccgagaccatgtggtgatagcggaacgagaaggcaccgtagacggcaatgaccgtctcagaatcgtcaacatgtctgacgccaacacccttgccgaaactcttaccacatacgaattcgatcgcatcgtattcttttccgaaggcctcaccccgcgaagtgagcgtgacggcgatctcggatatcttcgcagattgctgcacgccatacgtaacagatccacgcaaatgctgatggtatgcggaccggaatccgaattcacctatccggaaaacgccgacgtacgtgataccagcaaaagtctgatgtctcgagcgtcggaagaactctgcctgtattacgcgcgcacctaccgtctggaagcgaaaatcattcgctgtccatacttgtatgcacccgagcgcaatggagcaaccgcatatttcggcagactgttcgaacaggcatcggcagggtcgatctcattctgcgaacgcaaacagcaacagacatgctttctctgcgccgacgatcttgccgaactgatctaccgcatgttcgacgattggaccgccgaaagcgaaatcttccatgtgcccaacgtgttcgacttcacatacggtgatttggctgatgcgatcagcgcggcatttcccggattatcggtgacttttggcaaagacagaccccaacattacccagcagacgatcatgtgctgcgattgcgctatggctggtcgccgcgatattcgctcaaacaggatcttccccctgtgcttcagcgctggaaagaagcgcgtgctcaggaacaatccaagaagcacccggtctgggattttctacgcaaccattcaaaaccatggatcgcaatcgaaatcttcatcgcgttcatattggaagaactgcttcgcaccgcggtacaaggcaacagccagttgggaaccgtggatttgcgcctgtttttcgtggtgatcgtcggcacgatgcacggactgaacgcaggcgtgttcgcggccgcgctcgcatgtgtcggcatggcgttgtcgtatgcatcgaagggcgcttcattcgctccgctgttttacgacacgtcgaactggcttgcgtttgtggtgtatttcgttgccggcgcagtatgcgggtatgtgcagctgcgtaatcgcgaaaacctgcgattcatgcgtgacgaaaacagtttgctgcgtgaacgacttgcgttcctgcgtgacctgtaccacgatgtgctcgatgatcgtcgtatgctgcgcgggcagattatcggcaggcgtgacagtttcggcaaaatgtatgcgatgacacgtgaattggacgaagtgcagccgcaaaagctgtatcacacgaccattcgcattatgcaagacacattgggcggcgatagtttcggtgtttaccgcattgacagcggcggtcgattcgcgcgtttgatggctgcgagtccgcaaaccgaatccctgttcagcaagtcggcgctgcttgagaattatgccaacattattacagctttggatcatggtggattgtgggtgaaccgcaatctcgaaccggaccttccgatgtatgcggcaggcgtgcatgccgatggcaagctggccgtggtgattgtgcttgccaaagcgcagcccgaccaaatgaatctgtacttccagaacctgttcaccatcatgtgcggcttggtggaatccgcgatggtgcgtgcgttcgactatgagaatgtggcgcgtcaggcgatgctggtgccgggcaccgaattcctgaacactcgggcgtttctacccaaagtgcttgccgccaacgaactcaagcacgaccatatgggcgatcacctgctgctgcgtgtggatgatgcttggcaagacaatggcagccgtctcatgggggccattcgtcagacggacgaggcgggtgtactgcaagacggcaacgtgtatgtgttgatgaaccaggccggcaagcatgagctgcctatcatcaacaagcgtttggcccaagctggattgcatgtgacacgcgtttccgggcaagaggaagacgcgctgctggatgaggcttcggaacaagtggccgccgaatcgcacgaaggcggcacggcatgaacacaacggtagtgacgatgctgcttatcgtcatacatgtgctggtatgcgtgctgatgtgcgtattgtctcgttttggcgtgcttcgtgtggaagggcgtctgcttccttttatgctgttggtgccgctgtgggggccgttatgcgtgctcttgctgcatgtgcgtacgctgattcgtgcgggcgagcatacggctccagatctcgaacagatgcgcgtggacgatgaggaacgtcgaagcattctcgttgaggaacgagccgatttcgccaataccgtgccgctggaagaggcgttgatcgtcaacgattcgagtcagcgtcgcagtctggtgatgtccattctcaacgacaatcccagccattatatcgatgtgctgtcgcaggcccgactgaatgaggatgtggaggtcgtgcattacgcggctaccgccatggcacagatcagtgccaaggaagatcttgcattgcagcgctgccgcaacgattatctgcagcatcgaaattccgaaacgatgttggaacgctattgcgatgcgctggaacgatatatcaattccggtattgcgcaaggatacgcattgcagttgcagaagcagcgatatgccgaagtattgcaggaacgacttcgccaacatggcgattattacgttgcgtgccgtcttgcgcaaatgcaaatcgatcttggactctttgatgatgccgcgcacaccattgacggcgctatggaacagtggccggatcaaggcgatgtatggctgatgcgtctacgactcgatgccgcacgcaatgatggcgatgcgttgcgccacactgttcagcagatcgaaagcaagcatatttatctcggtggccaaggaagacgtgtgctgcggttctggaccggaaccaaggaggctgaacgcgcatgatcagaggattcctgtcagacgtgttggccaagtggaaacgattccgctggcaaggtttggtcaaagtgtgggccgtgttcatggccatcgcattggtgttgctggtggaaagcttgggcgtgcattacggtgtcacgcggttcgacatcacgtatttggatcgaaacaaagccattcctgcagccaatgccatcgctggcgaaaaagctacgaatctgttggtggtcgacagttcgcaggagggcatcagcgatgccgaagccatgctcgaccagattctgcttgatatgaaagtccccaccactacggttgacgtggctgacgaaaacgctgaatttccagcgttgactcactacagcaccatagtggtggccatgcctaatctcgaccgtctgggcgagcatgtgctgcaaatcatgcaatgggccaaaaaaggcggaggagtcatgtttgccatgactcccgaaaaaaccggctatttggatgtgatcggcccgcagatcggcattgaatcgtccgcatacgaatatgtgctgactaagggcattacaccctccaaggatttcatgttgggcggcggccagacatacacgttcagcgatccgtttgaatcgtcgctgagtgtcgcattgcatgatcgcgcacaggtcaaggccgtcagcagtaatgggcgcacaccgttgatttggagcacgttcgtgaattcaggttcggcggtggtgtgcaatatcggtatttacggcaaggtgcttcgaggattttacgcttcggcgttcagcctgctcggttctgccacggcctatccggtgatcaacagcgcggcgttctacttggatgattttccctctccggtaccgtcaggcaatggcaaatacatcaaacgtgactacaacatgagtattgctgaattctattctcaagtatggtggccggatttggtgcgtcttgcggaacggtacggtattcgtttcaccggtgtgatgattgagaattacggcgatgacaccaaggatgatccggtacggcagacggacggcgcacaattcgagtattacggaggattgctgctgcggcaaaacggcgaaatcggatatcacgggtacaaccatcagccgttggtgttgccgaatacggattacggtaaggaatacgcgtatgtgcagtggccgaatcgcaaagccatcgtcgattcgttgaacgaactgatcgcattccagaaagacgtattgcctgccgcaacatcgtcggtatacgtgccgccgtcgaatatcctctcccaagaaggacggaagatcataggcgaggatgtgtcgcagattcgcgccatcgccagtacgtatatgccttccgacagttccttgacgtacgtgcaggagttcggtgttgcggccgatggcgtggtggaggctccacgtatcgtgtccggcggcatggtgggtgacatgtacatgcgtcttgccgcggtttccgaactgaacatgcactatgtgagcacgcacttcatgcatcccgacgatttgcttgatgaagatcgtggagcgaaagaaggatggaagaagtactaccagggattggaaaactatcttgactggctggaatcgtcggcaccgtccattcgtatgcggacaggcacggaatgtgccgcagccatccaacgtttttcgggattgaccgtttcgatggaaacgtccgacgatagttgggatctgaaacttggcaacctcaccgatcaagggtggctcatgttccgtgccaacaatggcacgcctggcagggttcgtggcggaagcctcaccaagctgaccggcaacttgtatctgctcaaagccacgaacgccacggttcatatcgaacgcaagactgggggagaggcatgagaatctgcctggttttggaaggatgctacccgtatgtgcatggtggcgtgtccacgtggatgcacagttatatcgaagcgatgaaagagcacgagttcgtattgtgggtgatcggcgccaaagccgaagaccgcggcaaattcgtatatgacctgcccgacaatgtggtggaagtgcatgaggtgttcctcgacgacgccttgcgtctgagcggtgaacgcgcgcaagtgtcgttcaccgaagaggaattgcggtcattgcgcgaactggtgaatcttggcagcccggattgggatgtgctgttcaacctgttccacaccagaggcgtgcatccgctgtcgttcctgcaaagccgtgaattcatcgacttgtttacgcaaatctgcatggaagaatatccgtatgtggcctatgccgacgctttccataccgtgcgctccatgttgctgccggtgttgtacttgatgggctgcgaagtgccggaagcgcagatctaccatgcgatttccactggatatggcggattgttggcttgtttgggggggggtatcaaccatgcgccggtattgcttacggaacatggcatttatacgcgtgaacgcgaagaggaaatcatttccgccgaatgggtgtcgccagcgttccggccgcgttggatccgcttcttctacatgctttcggaacagatctaccatcgtgcgtggcgcatcaccagcttgttcggtcgtgcccgtcttatccaaattggcatgggtgcgcccgccgatgcctgccaagtgattcccaatggcattcaatacgaacgtttctgcgatattcccctgaagcccgacgacggttgggttgatatcggcgcggtggtgcgcatggcgcccatcaaagatgtgaaaaccctgattcacgcgttccatgagctttcctctcgcgttgacaatgtgcgcttgcatattctcggcggtgttgacgatcaggagtatgccgacgaatgctatgagcttgtggaacagttgggtgtgcgcaatcttgagttcaccggccgtgtgaacgtggtcgaatacatgcgcaagcttgatttcaccgtgttgaccagcatttccgaaggccagccgctgtcggtgctggaatcgttcgcagccgcacgcccctgcgtgaccactgacgtcggctgctgccgtgagcttttggaaggcgaggaaggcgacgatttcggcacggcaggcttctacgtgcccccgatgtaccgcgagggcctgagccgagccatggaacgcatgtgttccagtcgcacgctgcgtgagaccatggggcagattggccgtaaccgtgtgaacgcctattaccggcatgagcgcatgcttgacgattatcgcaagctgtatagcgataccgcggatcagttcggattgaatcagttcggattggagcgctgatatggccggtattggatttgaactgaagaaactgttccaccgtagaggcttgatggcgatgctgcgagcctacggctatgccggcgtgatttgcgctggtccgatgctgttgggtgtactcctgcagttcggcgtgctgatcgtgagcagctggtggcaggtgggccgccccgaccgcgatctgctcgtatgcatgatcacctacacgctgcttgcctcgttggtgttgacgagttttctgtcgatgccggtcacccgttttctggcggatatgttgtttgatcacgatgagaagatgattctgccgtcgttctggggttctactggcatcatgctggtggtgggcgcggtgttgtacacggttttcctgctgttttccggtgccacgttgatgcagggcgcgttgtgtttgtggctgtttcttgaaatgatcgtcaactggaatgcgatgagctatttgacggccatcaaggattacaaaagcattctgtattctttcgtggctgcggtgttggtggcgttcgttacgtcatgcgtgttgcttgcgttggcctgccctcctgtggagtcgctgttgttcgcagtggtgcttggctatggtgtgatgctggtgtgggatgtgctcttgttgcatcgttattttccgcaaagtcgtaagcatccgtggctgtttttgcagtgggtcgatcagtttctgccgttggcgttgaccggattgctgaccaccatcggcctgttcgcccatttggtgatcacatggtgcggtccgctcggcatcaaggtgaagggcctgttttatggcgcgccatattacgatgtgcccgccatgctggcgtttttgacgattctgatcaccacggtgaattttgtggtgtcggtggaggtcaatttctacccaacatatcggtcgtattacagtctgttgaatgatggaggcacggtcaaagacattaccgttgccgaaaacgaaatgttggctgtgctcaatcgagaattgcattacacggcgttgaagcaattgttggtgaccgctgccgtgatttcattggaaaaaacagtgctgaacgcgcttcctttaggattcagcgatgtgatgcacggatatttccgtgtgctctgcgtggggtatgccctttatgcggtcggcaacaccgtgatgctgattctgctgtattttaccgattattccggtgcattgacggcgtcggcattgtttgcgggttcgacggttgtgttcacagtaatcggacagttcttcactacgtcgctgttcggtttcggttttctgatgggggcatcgctgttcgccatatatgcgacattccggctcgcctcatacaccgacaatctgccataccgagtgctggggcagcagccgattgtggcgcaaacgaaacgtggacgtttcaccgaactgggcatactgcttgaacatggcgaacagcgggtcgaccaatcattgcatcgctcagggcatgcacggtcttctgacaaggcgaatattgcagaaacggatgtcataatcgggaggaatcgtaaatcatgacatggtggaaccgacgcaacacaaaagccattaccatgcttgtcaagcaaatagcggcattgacggcaatgctgacggtgctttcctgcgccggatgtgcgacttcgtcacccaacgataatgaacaatcgcaatcatcggattcgtcacagacgcatgagcaagtcaagaaaagcgctgaacaaagcatcgacggcgcacacttgcgcgacaacgaatcgttatacaaggtgtatgacgacagcggtgtcgaaaccatgtatttgacggtatcgcgcggtaattcgtcggaaggcaccgaccatagctggagcgaaatcaaccagtattccgttgatgactatgcggccatgggcgttgaccgctacaaggtcaatggtttgctgcaggtcggcgacgaacaaggaccggtttccggggagcttggttttggtgaaagcgcgccgaacgccaccgtgcagatacgtggccagtcatcgagtaaaaacgagcagaagaactacaagatcgagttgaaaagcggcaaaggcaagtggcgtgggcagcgtaccatcgcattgaacaagcatatgggcgaaggtctgcgtttccgtaacaaaatggcgtacgatctcatcaaaggcatcgaccagatgatgggactgcgcacgcaattcgtgcacttgtacgtgaaagacgagaccagcggatcggattccttcgacgattacggtctgtacacgcaagtcgaacagctcaacaaaaccgcattgcaggtgcacggactcgataaaaacggccagctgtacaaagtcaattatttcgaattctatcgagacgaagacgtgatcaaactcgccgatgatcctgactacgatcaagcgaaattcgaagaaaaactggaaatcaaaggcgacaacgaccataccaaactgatcgccatgctgaacgatctcaatgattattcagtgccgatgggcgaaatcctcggcaaatatttcgataccgaaaatctcgcatattggatggcattccaattgctgaccggcaatatcgatacgcaaagccgcaatatgtacctgtatagtcccacgaattcggatacgttttacctgctcgactgggataacgatggtatgctcatgcgcaaggaatacgagatcaggcaacgttccgagggccaaagctgggagaacggtgtcagcaactattggggcaacatactgttccgacgttgtctgcaaaccaagtcgttccgaaccgcgctcggcaaggccgtgaaagacgaatacaagtatatgagcgccgatcgcatcaattccatggtgcggcggtaccgttccatcgttgaaccatacgtacggaagatgcccgactccatgcatgagcctctgacgtcaagccaatacgacacggtggcaaaccaattgcatagcgaaatcgaacagaactaccagacgtaccgaaccgggttcaataagcccatgccgttctatatcggcaagccgactcctaccaacggcaagctcaaactcagctgggatgtctcctatgatttcaacgatgaggatctgcgctatagcgttaccgtggccaaggattacgaaggcaaagacgtggtgttcacacagagcgacctcgtattgccggaagccgtgatggatatgcctggtgaaggccagtacttcatcaaggtgagcgtgcgcaatgcatcaggcgagacgcaggacgcgtttgactattacgtcaccgacggcaacaagatctacggcaccaagtgtttctatgtgaaagccgacggcagcattgtggaggatgccaatgtgcagtgatggtggcaatcgcggaacgtcgctgctgcaacgtatcaaacatcgcgtcggcgaggaattatccgttccaccgcgcacagccaaggaacggttccgtcatgagctcaaatatctgatctcatacgcgcaaaaagccgacttgaacgtgcgtatggcgccgctgcttggcctcgacaagcatgtgaaaaacggcggctatatgattcgcagcctgtatttcgacgattattggaacaccgcatatcaggaaaaagtcgacggtgtgctgctgcgtaggaaataccgtattcgcatctacgattacagcgatcgtgtgatcaaactggaacgcaaacgcaaaagcgacagttggatctacaaggaggatgcaccgctcacgcacgagcagttcgaccgtattcttgccggcgattacgaatttctgcgtgacagcgagtatcagttgtgccgcgagttttatgtggaatgcatgtgcaatgtgatgcgccctcgcgtgatcgtcgattatgagcgcgaaccgtggattcttgacgccggaaccgtacgcatcaccttcgatatgaacgtgcgtgcggcggtcggcggattcgatattttcgactccacactgccggtactgcccgtgcttgagccgggcaagctggtgatggaggtcaaattcaccgagttcctgccgcaagtggtgcgtgatctgctgcccggcaaggcgcaggagttgacatcggcttcgaaatacgtgctctgctacgacaaagcctcgtatttgcggggattcgactactggcaggaaggctggagcgtgccaagcctgtaaagccaagcctgtaatcggctggcatgttgactggcattccagcaaaaacaaacgttacgaatcaaggaagcaggagagaaagaaaccatatgagtgtcaatgacatgatcaaaaagtcggtgctgaaatccttcggccaatacaatgtgcccaaaatggcgctggcgttgctggtggcgttgatcgtcggcatcgtcatttactgcgtgtaccgccgtttctacacgggtgtggtgtattcgcgcagttttgccgttacgttggtgggcatgtgcgtgctcacctgcatggtcacgctggccatcagtacgaatattgtgatttcgcttggtatggtcggtgcattatcgattgtgcgctaccgtaccgcggtcaaggatccgatggatctgttgtatttgttctgggcgatcacgtctggtattgcggcgggcgccggcatgtatgtgctggtgattgttgccggattggtgatgatcggcatgctggctctgttctactcgcgtcaagacaaggggcgcgtgtacattgcggtgatccactatgtgggcgatgtagtgggagatgagatcacgcgcgcgttcggacgcaccgaattcttcgtaaagtccaaaaccatgcgtggcgaacgcacggaaatggcggttgaagtattctgtgatgataaggacatgacgttcacggaacgcgttcgcgccattgagggtgtcgaagacgtgacgctgatacagtacaacggtgagtatcatgggtaatcaattcgatgttgccgcaggcgcgcggctggaatccacgggcagggcgcccagcaacgacgaaatcgtacccagattctctcttgacgacatcaaccaggcgtttgacaacaacgaattctgcttctacctgcaacccaaatgcaatgctgaaaccggcgcaatcgtgggtgcggaggcgttggtgcgttggaatcatccggaatatggcttggtgtctcccggcgaattcattcctctgcttgaacgtgagtcaatggtcacgcggttcgatttgttcatctggcgttccgtgtgtgaaatgctgtcgcgttgggatggggaggggcgcaatctggtgccggtgtccgtcaacgtgtcgatgacggatatcgaggcgatcgatgtggcgcgagtgcttggcgacctgctcgatcggttcagcatcgatgctcgcctgctgcaggtggagatcacagaaagtgcgatcgcacataacatggatgtggtcgaagagaccattcgggacctgcatgcgcgaggcattgccgtgctgatggacgattttgggtcggcgtattcgtcactcaacatgttgaaggacatcaacgtcgatgccatcaaactcgacatgaaattcgttgacctgaatgctgacaatgcggcgaaaggtttgaaaatcatcgaatccgtgatcgacatggcctaccagctgagactgtcgatcattgcggagggtgcgcagaccgccgaacaggtgagcaagctgcgtgagctgggatgcatgtacatccaaggatattatttctaccgtccgctcactgtgggaaagatggaggatttgctggaacaccgcccggatgatcagcatttctggaatatctccaaagacctgatgcatcgcggctaccgcatgtcgacgaacggccgcagcatgctcgaatcgtcgtcattgtcggcgcatatttttgaaatccttaacaagggcgttgcggaactgtcccgactgaatctcatcacgggagaatatcgcaccatcaaacgcgatccgaaacttccggacgtgtatgcggatgattttcatgattactgccatgcattggtttcaaaacggatcattcatccagatgatgccggagaattcctgaaacacacgcgattgtctgatttgcgcgaccaactattcagtaagaaaaaatcggaattcacgtattttagaagcgaggtcgaggcgaaaaccagcgtgatcgcattcggtatgctggtaccccctgattgcagtgaggccaatccgtgggccgtggtgctgatcggattcgacctgtcgctcgacctaatcgccaagaacatgaaggaaatctatcggcaggactccttgacgggattgctcaaccgcaatgcatacgacagcgatgtggagcagctgcggagcgccgacatcggggcggtggtgtgcgtgtatgcggatatgatcggcctgcacgaggtgaacaaccatctcgggcataagcagggcaaccgcatgttgtgtgagttcgcggacgcggcgcgcgcgttcttcggcgatgaccggttgtatcgcatcggcggcgacgaattcgtgataatcagttccgcgcatacggaagcgcagacacgcaagcagctgaactacatgcgtgagcgcttgcatacgcaaggctgcgagatatcagtgggcgtagcgtcgagcgagtcgacttccgatctgccgaaaatcatcgaacaggccgaaaacgagatgcgccgcgaaaagaaggaatactacgtgcgaggcggcagcaaacgccagctgcgcgggctcaacaaaaaacttgaggacattctggtgcgtaatcaggatatggaatcgttgctgcggcatttgaacggacgctattcaatcgcatgcatggtgaatctgcgtactgactcacagcgtgcgatcatggtgcccgactatttccagaagatgcttgacgcgcatgacggttcgttcaaaagcgcgctgcatgactattgcgaacgattggtggcgccgttctgcaaagacagtttctccctgcttatggattacgacttcattcatgcccgcgtcgagtcggtcggcgtgttgcagtacgggtacacgcgaaacgacggagagaagttcctgcttacgattttcgccgatcgacgttccaaagacgagaccatgtgggtgttctccaaggatgatctgccgcaggtcgagctggaattattcgagtcataaggccgtattgtctggttttatgcgtttttgtgtgatgcgttcgcatattttgtgagaacgctcacagaaaaggttgtgtcgatttccagccgaatcgcaaaatggggtctatgatgagaatcgttggtcatggcaacggttgctatgacacggcgaacaagcacagtcgcttaaaggagacatctatggtctatcgcatgattttcaaccagactgcatacttcggtcgcggcgccatcaaggagatcccgggcgttgccaagtcccatggcttcaccaaggcgttcatcgtcaccgatccggtactgctggaaaccggcaccgtcaagaaggtcaccgatgtgcttgatgaggcaggcatgccgtacgaggtcttcgacaacgtcaagccgaacccgccggtcgaatgcattcaggatggcgttgccaagttcgccgcatccggtgctgatttcctgatcggtctgggcggcggctccccgcaagacacctgcaagggcatcggcatcatcaccgccaacccggagtttgccgatgtgctctccctggaaggcgttgccgacaccaagaacccgtccgtgccgatcttcggcgtgccgaccaccgcaggcaccgcttcggaaaccaccatcaactatgtggtcaccgataccgccaacaagcgtaagttcgtggccgtcgacccgcacgacattccgatcgtcgccttcgtcgatcctgatctgaccgactccatgccgcgcggcctcaaggtcgccaccggtcttgacgccctgacccacgccattgaaggctacatcactccgggcgcctggagcctgtccgactgcctgagcatgcagaccatccgcatgattgccaagaaccttgccaagagcgctgacggcgacgttcctgcaggcgagcagatggcctacgcctcctacatcaccggcatggcctactccaacgtcggcctcggtctggtgcatggcatggcccacccgctgggcggccgcctcggcgttgcccacggcgttgccaacggcattctgctggcgccggtcatggaatacaacaaggacttcaccggcgagaagtatcgcgacatcgccgacgccttcggtgtcgaagatgcctacaccggcgatctcgagacggttcgcgaagaagccgtccaggccgtgcacaagctcaccgtcgacctgaagaacccgaccaccatctccgaagtcggcgcaaccgaagccgatctggaagcactggcccacgacgccttcaacgacgtgtgcaccccgggcaacccgcgtcaggccaccgaagaagacatcctcgccatctacaagagcctgatgtaatgcgaaaactctcacgaatcggcaatcgcatgcagcgaatctgcagtgaaacccgattgtgagagaacatcgctgaaagcattaaaaatcgtggtgcgaaacttcacaaagcattcgcaccacgatttttatatctgcacataaattacggattaatcgaaataatgtaaacaataatccgtgattatcaatcgcaagtattggaattactcgtgcttttcgctccactcctcatcggtgggagtgtcatcgtaccattcgcggccttcctgctcggccaattccatctgctcgttgatccacgccgcctccgcaggattgatatcggcggtgtcaagcaccttctgccataccggatacagcagatgcatcaccggatatagcgcggtgagcagaatctccggcttatgcttgcgcgaatgctgtggatgcgcgtcgaacgtgttcttgaaacgacgcatgtaattgttgaacgacgtgagcgacgtgtccatacggcgggcgctgatgccggcgatcatacgcgggcagtacacggttttcagatccttgcccagcagatgcagcgaaatatcgatatcctcatgcatcacatcggccttgtctcggcacacttcgtcagaaatttcgcgccaagctgaagcgcggaccgccatattcgagccaaacagcaacggctggccgccatcggccttgtaaatacgcttgcgtgtggaattatccccacgcaaaccaaaatggcggctcggcagatcgtaatacatcaccggaccagtggcacccatggcctccgggtcctcagtgaaaatgccggacaccacttcgacccaatccgggcgaatcatgcaatcggcgtcgaaacggcccagaatgtcgccggtggcgtggttcaaaccataatcgcgcgtcggaatcagcccctgctcctcatcctgatgcagcagacggacgggtgcttccgggtggtctttgatgaactgctccaccatggccaccgtcgaatcggtggaacgattgtcgacaacgatcacttcatggggcatcacggtctgcctagtggcattcaacaggcaatcgttgatacgctcctcttcattccaagcggggatgacaattgaaacgttcagcataactaccacaatagctcagcctgtacacgacgcctatcgctacaatagggagccatgagcgacagcgaacagcgaatgaacaatacgcagagcgaaaacggtgcgaacaccagcgaacagcgatgggacctcggcaccctgtttccagccaaaggagatccccgaaaaccaccggaatggctgggacgtgcgctgctatacatcgccatagccattgtggggtttactttctgctggcgcagctggggcaaaatcgaatacctggtgatcgacatcatcgtctcgctgttcatcgcgctcgcggtggagccggtggtggtgccgctggtcaagcatggctggaaacgttcgttcgcgtcgctgttctcgctgctgatgctggccgtgatgctcggcgtgctgttcacactgttcggcaacctgttcgtgcagcagatgatcgccttggtgaacggtctgcccgacctgtatgagcagatgtgccagttcgccagtcaatacgcgaatttccagcttcctgagatcaataatctcggcaatgagattctgaagaacattcaaacgtcgtgggtcactgatttcgcgggtaccgcgctgaatacggtgtcgggattgttttcgttcctgattaacctcatgacgataatcatgaccacgtattacatttcagcggctggtccgaaactgcgtcgtgccgcatgccagtggatggctccggcggctcagcggcgattcctgttcgtatggacggtgagccagagccagatctcgtcgttcctgttctcccgcgccattctcgcgttgctgaacgcgttcttcacaggaatctgtctgatgctgctgcacgtgccctattggctaccgttggcgctgttctgcggtgtggtttcgcagttcattcctatgttgggtacgtatatcggcggcgcgttgccagtgctgttcgcatggggtagctgcggattgtggcaggccgtggcggtgctggtgtttatctgcgtgtatcagcagatcgagaatctgattttcgcgccgaagatctcccagcgcaccatggatgtgaacgatgccgtggcgttcctcgcggtgctggcgttcacctcgctgttcggcgcgttgggcgcgttcctcgcattgccggtggtcgcgtccgtgcagacgatcttccgcacctatacaaagcggtacgagctggtcgattccccgctgatggacgatccggtgcctgaaaagaagtcgaagctggtggaaggtgccgaagtactcagcgagcatctgcacaatatgcctcgcgcggtgcagggatccagtgcgcatgtgcctattcccgacgaagtgcggcagttgcaggagcaggcgtacaatatcacccgttccgaggaatcgctggaatcggacgaaaccgtcgccatcccgaagcacgtgttggacaaaacggaacgcaagccattgcagggtcttgagagtgaaaacacatctcaggaatccaacgaaaatccggaatccggcaatgaacggaagaacggcgagtcgcgggaagctgaaggaagtacgaaaaacgcggatgacaatccaagaagtaggtggcgttaatggtactgctgagcgtacttgacattctgctggtcatcgtcggtggcgcaggggtggtctatcaggcggtgtgcattctcatctccctgttcaccaagccgatcaaatttcccgacgcgccgatggacaagcgttacgcggtgctgatttccgcacgaaacgaggcgaacgtcatcggcaacctcattacctgcatccaaacgcagacctacccgaccgaactggtcgacatttggcttgtcgccgacaattgcaccgacaataccgccgaagtggcgcgcaatatgggctgccatgtgatcgaacgcttcaacaaggagcttgtgggcaaaggctacgcgctgacgtatctgctcgatcagatgaacgattccggtgcatccgacccgtacgatgcgttcttcgtgttcgacgccgacaacaagctcgacaagcattacgtcgaagagatgaacaaggcgttccagtcgggattcaagattctcaccagctaccgcaattccgtgaatttgtctgacaattgggtctcttccggttctgcattgtggttcatccgtgaatctcgattcctgtcggcctcgcgcatgtggctcggcaacagctgtcatgtagggggtactggcttcatgttctcgcaggagatcatgcgtcgcaataatggttggaaattccaccttttgaccgaggatttggaattcaccatggattccttgctgcacggcgaccgcatcggctactgcggtaccgcgattctgtatgacgagcagcctgtcaccttcgcgcagagctggcgtcagcgtttgcgttggagcaagggcttcctgcaggtgttccgttattacgggccggctttggtcaaacgcgccatcagggaacgcgatttttccgccgttgatttcacgctgctgttgtgtccgttcacggtgatcggtattgcgcgcgttctgctgggactgttgttcgcgacctgcggattcgtgacatggcagagccagttgagctcgttgaccggttggacgtccggcattgtgacgtcggtgatcggcatgatggcgttggccgcgttgacgattattgtggaacgcgatcagattggcgccaccaacaaggagctgttcgcgtatgtgctgagcttcccgatctacatgttcagttatgtgccgatctcgttccaggcgatgttcgccaagtccgaatggaagccgatcgagcataagggatgacgttcgttcgctggcttgcgcgttcctgccttttcgttttcatttcgatttcctcttatgactggagtgttgttgttccatggatgattcggctgaataccggcatgtgaaacgccgtcgatacatcacggtggcgctttccgtgtcgctcaccacagtgttgtgcgtcggctatgtcgtggccgacattttcgacaagttgccgggtgttctcacattgcaggaagtcgagcatgccacagccaaaacgccgggcaatgccattgcggccgcgacgatggtcggagggcttgacgcttcgaaaaccgtggatgccgttgcggcaaaggctctgatcagccagtttgagacggctgcctccgattttggcggtgaatacgccatcgccatcgccgacgcggctggcaatgtggtggccgagcagaatctcgacacgccgtatacgccggcgtccaccatgaaaacgctgacggcgtatgcggctgcggccacgctcgacatggggtcgacgttggagacgcagacctatttggagcagcgcgaagatggcacttcgcgattggtgctcaaaggcaacggcgacatgctgctcggcgtcggcgaatctgattcggcgcacatcaatgggcgtgccgggctgggaacgcttgcggcaaacacggcccaagcgttgcggcagcggggcatcacttccgtgacgctcgtctacgatgattccctgttcggcaacgaccgttggcccaacggcatcgccgaactcgatccggaccacgtgtactacgcgccgaccgcatccatggccgtggatggcgggcgaaactggaacggtgctaatcctacggatcccgatacgttcagcacatatcccgttttgagcacgcagccggctcgcgaggccgcgctggtgttcgcgcaacgcctgactgagcggggcattgcggtgaacggttccgtggaacagggagccgttcccgacgggaccagccccattgcgacggtgagctccgcatcgctgaacgagatcatggcgttcatgcttcggcattccgacaattcgctggccgaggaattcggcagactgctggctttgcaccttaacgccggcaattcaccggccggagcggtgcagtcggttgaacaggtactggctcagcgggggatttccaccgaaggcctcaccatggttaactgctcgggactggctgaggattccaaactcaccgcgcataccctgcttgacgtgcagcagcgtaatctgacgagcgggtccggttccgccgccgctgaggggctgtcgattgtaggatttgtgggcactgctgcgaatcgtttgaacgatgctgacgaagctggtcttatccgtgccaaaaccggcagtttgggagatgtgacttccatgaccggcaatgtgtcgcgccataatggcggtgcgttgagttttgccgtgatcgtcaacgatcctgatgattccgaagccgcgaaatccgctatcgacacatttgtggcagcactaccgaagttgtgacgccatggtgtattcgtcacgtttgcgcaagggaatcggcgagctgcgcgccgcgttggaatcggccggtttgggattgcaggatgcccgtttcgcccgtcatggcgagcacgcgcccgatgtggacgctccgctgattatggtgtcctgttccggtgggcgcgattcgatggcgttggctgcggttgctgcgaaaacgtgcgcttcattgggattgcgatgcggggcgattatcatcgaccaccagttgcagcaaggctctgccggtgttgcgcgggcaaccgccgatcgttgcgttgcgttgggtcttgacccagttcgtgttcgtgcgattgacgtacccgactcccgcggcatcggtgttgaggcagcggcgcgtgaagcacgctatcatgcgattgtcgacgcatgctccgacgcttcggccgtgcttctggctcatacgaaaaacgatcaggcggaaaccgtgatcatcggtttgttgcgttccgcgggcctcgatgcggtttgcggtatgaacggttccttcatacgagacggggtgcgttttctacgcccatggctgaatgtgacccgcgaagaaaccaccggcatctgcgaggatctgcggcttgcctggtgggacgatcccacaaatgggccggatgtgggagattcgggtggaaatgagcctcttcccgcgaactatccgctgcgatcccgaatccggcacgatctcatgccatatcttgcatcattcgcgggaagcgacgtcgtgtcgaaacttgcgcttggagcgaggcttgccgaagacgatcgcgcatatcttgacgatgtggcgcaacgcgtgtgcgagcaaggcgtaaccgtgaacaacggcgagataatcatcgacgtgcgtgcgttgcaatcgcaagacattgccatcagaagacgggtgattgtgcgctcgcttgcggaagcaggcatttcgtgcatggcacggcaggttgaagggatcgacaggctgatctgcgactggcacggccagaaaggtgtgaatcttcccagcggatattcagcatatcgccagaaacacgtcattcgcgtgtgccaagatggtgggcatgcgaatcgctgacgtacaagaagatattgatcacgagctgatcagtaaagaagagattgccgacatcatcaaccatgctgcagaccaggccagtgaagactaccgtggcaagaacccgctgctggtttgcgtgctcaagggtgcggtgaacacgcttgcggcgttctcgcaggccatgagcatccacgcggagatggatttcatgagcttgtcgagctacggttccggcactcaatcgagcggcaagatcaccgtgcggcaggatctgtccaccgatgttcgcggtcgtcacgtgcttattgtggaagacatcatcgattcgggcgtcacgttggcgtggctcgtcgatgagctcaaaagccgtggtgccgcttccgtggagatttttgcgctgttggaaaagccggcgcgccgtaaggtggatgttcctgtgaaatataagggacgtgagattcccgatgaattcgtggtcggtttcggcttggattatgacgagcgataccgcaatcttgattcgatcgcggtgctgaagccggaagtgtatgaaggaggtcaggcatgagttttcctggtccgggccagtcgccgaataacaacggcggcggcaataacccgttcaccaatccgtttggacgcaataataacgccggcaatggcaacgattccaacggcaagggtgacaagtccaacggcaacggatccaatggcggtccgcgtccgttctggcagtccccatggctgtgggttgtggttgtggcattgcttgccgtgaccatgttccagattttcgccggaaccggttcccagaccatcgacaccaaggacggtctgcagattctcaacggcaacaatgttgaatacgcacagatcgtagacaacacccagcaggtcaagctcaagcttaagagcgactactccgctacagaccctgataccgggcgtatgaagaactacggcaaaaacgtgcagttctactacacgtacgcgcagtccgcaaccgtggtcaaggccgtacagaaggctgatccggtcaagggctggacggcgaccatgcagcagagcagcatttggacgtatctgctgacctcgctgctgccgttcctcattatctttggtctgttctggttcatgatgagccgtatgggcggtgctggcggcatgttcggtatgggcggcaagaagaacagcggcaagctgctcgaaggccagaccccgaccaccaagttcgccgacgtggccggcgaagaggctgccgtgcaggaagtcgaggaaatcaaggacttcctgaaggatccgtctcgttacaaggctttgggtgcccgcattccgcgtggcgtattgctctacggccctccaggtaccggtaagacgttgctggcacgagccatcgcaggcgaagccggtgtgcctttctactccatggcaggctccgacttcgtggaaatgttcgtgggtcttggcgcctcccgtgtgcgcgatctgttcgatgaggccaagaagaacgctccggccatcatcttcatcgatgagatcgatgccgtcggtcgtaagcgtggcggttccggtatgagcggcggccacgacgaacgtgagcagacgctgaaccagctgctcgttgagatggacggcttcaataacgacaccaatctgatcatcatcgccgcgaccaaccgccccgacgtgcttgatccggcactgcttcgcccgggccgtttcgaccgtcaggtagccgtcgaagcgcctgatttggaaggccgcgaggctattttgaaggtgcatgccaagggcaagccgttcgtgcctgatgtcgatctgcgtatgatcgccgtgcgtacgccgggctttaccggcgctgatctggccaatgtgttgaacgaagccgcattgttgtgcgcccgcgccggtgcgcagctgatcgacaaccgcgccatcgacgaggccatcgaccgcgtgcaggcgggcccgaagcgccgttccaagggcatggcgctcgacgaactgcgcaacaccgcataccacgagggtggtcacgcgctggtggcggctgccatgaacgataccgatccggtcaccaaggtcaccattctgccgcgtggccgcgcacttggctacaccgcggtgatgccgactgaagatcgctattccatgtctcgcaaccagctgctcgaccagatggcgtacgccatgggtggtcgcaccgcggaggaagtcgtgttccacgatccgaccaccggcgcttccaacgacatcgaaaaggcgacgaacatcgcacgtcagatggtgctcgactacggcttctccgacaagctgggtgccatcaagtggtccgatgacgaacagagcgaccttggatcgctgaaccacaagtattccgcacgcaccgccgaaatcatcgacgaggaagtgctcaaactggtggaaaccgcgcataccgaagcgtggaacgtcatcaacgagaatcgtgagattcttgacgagctcgtacgtcagctgctcgtcaaggaaacactcaacgaaaaggaacttgcggaaatcttcgctaatgtcaagaaggcgccgaagcgtgaagtgtggctgagcgacagcaagcgcccggattccgacattccgccggttccgattcccgaatccctgaagaaaagcgcaggattgaccaactgatgagcgataccgaagcattcgataccctcttcgacgacaaggcccgtgccgcccatgcggccgggcctgtcggctatgacgaggaaggcgtgcgccaggcagtacgcctgtttctgaaatccattggcgaagacccggaccgtgaaggcctgctcgacacccccgaccgtattgggcgtgcctgcaaggagctgttcgcaggccttggacacggccccgaggaagtgctcaaaaccaagttcaaagtcgataccgacgaaatggtgctggtacgcgatattgaactcttctcggtatgcgaacaccacctgctgccgttccatggcgtggcccacgtcggctatattccgtcgaacggccaagtggcgggcttaagcaagcttgcacgactggtggaactgtatgcccgacgtccgcaagtgcaggagcgcctcacccaacaggtggccgacgcgttgatggaaggtatcgaagcacgtggcgtgatcgtagtcaccgaatgcgatcacatgtgcatggccatgcgtggcgtaaagaaggcgcaatcgcgtacggttacatcggcggtgcgcggctgcatgcgagacgcgacgacgcgagccgaagccatgagcctgatcctgtcgcagcatgcgtgatcggcgcgactgcagcaagtcgaatcgtaaataccaataaccggatataggaggggaaaccggatgaccattgatatgaaatcgattcatgatagtgaccgtacgctggtgatgggcgtgctcaacattacggaggattcgttctccgatggtgggctgtggctcgatcctgcgaatgcgaaagcgcacggcgaagcgatgatgaaagatggggctgacatcatcgatatcggtgccgaatccactcgccccggagccaaacgtgtcagtgaggaagacgagcaaaaccgcgtgctaggtgctgtggatgcgctgattccggaaggcgcggtgctgtccatcgacactacgcgcgcatcggtggctcgcatggcgttggagcatggcgcgcagatcatcaacgacgtgtccggcggtcagctggaccgcgaagtgccccatgtggtggccgaacacgcggaaagcctttacattgtgcagcattggcgcggttggcttgccggctccgcaggcgacgtgcctgacgctaatacgtccgtgtacgccaatggcgtggtgaacgacgtgtatgacgaactcatgaagcaggtcgacgacgtgcttcaggcaggcgtctcgccgtcacagatcatcatcgatccgggtcttggattctccaaaccgagcgtcgaacataacttcccgctgatggtggcgttggagcggttcaacgccaccgggtatccggtgctgatcggagcctcgcgcaaacgattcgttggcgcggcgcttgccgatgccggtatcgacgagccaagcatgggcagcaaagacaatgcgaccgccgccatcagcgccctgtgcgccgaacatggcgtgtgggccgtgcgcgtgcatgacgtggcaaaaagccgcgatgcggtggccatcggcaacgcgtggcgtgctttcgccaacgtctgatacgcggtgctcgcatacgtcgtgcgttcctgacagcgtaggagcggcaacgcatttccaccattaaaccttgagatatgcaaagaaaggctggcatggatcagattcgattgactggcgttcgcgcggtcggcaaacacggtgtgcttgatttcgaacatgagcgtgcacagacgttcgtcgtcgacgccacgctgtttctggatcttgcgccagccgggcattccgatgacctgcgggacaccgtcgattacggtgccatcgccaaaggaatagtcgccattatcgaaggcgatcatgtcgatctcatcgaaaaactggccgatcgcattgccagcatgattcttgaatatcctgctgtgtcgcaaacgcaagtgaccgtgcataagccgagtgcgccaatcgtcgtaccattcgacgacgtgagcgtaaccgtggaacgttctcgtgaaacaacttcggctgcatcgcaagtgcatcatgccatcattgccatgggtggcaatcagggcgatgtagtggccaccttgcgtgacgcggtgcgttcgatcgacggactggcgtccactcaggttacgggcatttcgccgctgtaccgtaccgatgcgtggggcatgcccgatggtacccccgacttttacaatgcggttgtttccgtgaccaccaaattgtcggcaatggaactgctgcgaggattgcagcgcatcgaagccgaccatggccgcgtgcgtaccgaccattggacctcgcgcacgctcgatctggacatcatcgatttcgatggtcaggaaagccaagatcccgacctgacgctgcctcacccccgtgcatggcagcgggcgttcgtgctcggtccatggctggcgctcgaacccgatgccgaactgccgggcgatcatgccggttccgtggctcaactcctccatgaatcgaccgatcgcgaccatatcgacgaaatcgcagatgattggatggtggaaagcccgaccggctacggtaccgacgaccttgcctgcgatgccaataatgcgggcgatgcggatgatatgggcgaagcgtatgatgcgatcgattccagcgatttgccggaaggaaccgccgcagccaaagtggccgcactcgcttctgcacagctagaacccgcatcgaaacgtgcggtgatctcactggacagcccagcaaccgatgccgaacagcagttccgcatggccatcgtcacattggacggcattcccggcaaccaagtcgagggcatctcacccctctaccatgtgagccaactcgacggactccccgacaaaatggccgcggtaatccagatttccacgcgcatgggcgcccatgatctgatcgaagcattaagcaatgtggaagcctccgtcggcgaagacttcgatctcgacctgatcgacatggaaggcgtgacatgcgatgagcctgactgcaaggtgccgtggcccaccgcacgcaaccatgccgcagtgcttgcgccatggctcgacatggatcccgatgcgcgactgggcaaggatccggtatcattcctgctggccatggcccccgataccgcgcaagtgggactgctgaccgacaattggatcatcggaggtacgctatgaaagcgcgcagaaccccttggtggtgctatgttctcgctgccgcattaggattgctggccggtatgggattggcgaaatatggcgagatttcaggtttgccattggtcggcgctccatggatcgtgcccgtggtgttggcgattctgggattcgtcgtgctgtatatggcattgcagatccacaaatacaccaccacggatcccgaaaaacgcgcgcagctgaaacctttggacccgcagaaggcgttcgccacactggtgtcatgcaaagcgttgggcgtggcaggagcggcgttggccggctggtatggtggacagctcatcatgagcctgccgcatggtgaggcgacgttctacagtcaggccatcctcgaatgcgcgatcgcggcaatcgtatgcatcgctgacatgatcatcggcattgtgggggagtggttgtgtcaaatcccaccaatcgacggtccggaaagcccgaaaatgaaaacggccacgcaacgaaaccgttacgcggccgcggcaaccaaatcggcaacccaaacgaaagcctgattgtccttacttcttcaaatcctcctcaggaacacggatcatcgcctcctgagtcatgcaggcaacaagctcgccatcctgcgtgtataccttcgcctgccccaagccacggccgtgagccgcggtaggcgtatcctgcacatacaaatgccactgattgatgtcgatatcgcgataccaccacatcgaatgatcgatcgaagcgaacgaaatgccaggcgtggcaatacttaacccggcacgacgcaacaccggctccagcatcacctgatcgcaacccatagccaacatcgcacgatgcatgacctgcggaacgtcaaccgtgccgtcggccttcatccacaccatctgcttgccggaatcgttactggcgctcttcttatcggcacccagcatgatcgtgcgcgtcacatgacgaatgtcgaacggcgacttttccgcatagtatttggcatacgaagacttttcggcaaacggctccatcagctgcttcgcactggtcaacgtttccggctccggcacgccttccggcatgggatcggcgaactcaatgccatcctgaccctgctcctggaagctggcgatggccgtcagaatcgaaccctgagcctgcgtgacattcacgcgacgagcggaaaacgagcggccatcacgcagattctccacatcaaacagcaaatcctgacgaatatcgccggcggaaatgaaatagccatgaatcgaattcggcagacgagatggcggaaccgttttggatgcggccatcatggcctgcgcgatcacctgaccgccgtacacgcggccagtggggaaatacaggctttcgccattcacatatgtgtggctgcggtacgtggaaggcgtgcccagctgaagcaccttcgccaaccgttgtaacggagttattgctgtctgcgctgtctgtgtcataacgggcctcgattctttgagtcgcatacgataaacgcttcgttctggaaacgagtctacgcaagggcggtaaatttcgccggattgttttgtaacgaatgcgtgagaagcgtgaacggcaggtaatcgtcaaacgattcacatacggcaaagcgccgcacttcgtaacgaagcacggcgctttgctgaaatttgcgagtaacgttcgcaattatggtcttgcttcgcaaggctcattgttgccttcgttcggctgtcgcctcactcaggccaagcctacagacagtccacaggactgtctgcttaacggctagcctgtggccctgcaattatggtcttgcttcgcaaggctcattgttgccttcgttcggctgtcgcctcactcaggctaagcctacagacagtccacaggactgtctgcttaacggcttagcgcgttagcttgcgatggagacggtgggggcgagccgcgtcttcgccgagacgagcgacacggttctcctgataggcctggaagttgccttcgaaccagtaccacttggctggattctcgtcatcgccttcccatgcgagaatatgcgtggccacgcggtcgaggaaccaacggtcgtgagagatcaccacagcgcagcccgggaagccaagcagtgcgttttcaagcgattcaagagtttcgacatcaagatcgttggtcggttcgtcgagcagcagcaggttgccgccctgcttcagggtcaacgcaagattcagacgattgcgttcaccaccggacagcacgccggtgagcttctgctggtcggaacccttgaaaccgaaggacgccacatacgcgcgggtcggtacttcaacgccagcaacctcaatgaagtcaagaccgtcagacacggcctcccacaggttcttattcgggtcaagaccggcgcgattctgatccacatagctgatctgcacggtttcgccgatcttcaacgagccagacgtcaacggttcaaggccaacgatggtcttgaacagggtggacttacccacaccgttcgggccgatcacgccgacaataccgttacgcggcagcgtgaagctcagatcgtcgatcaacacacggtcgccgaacgccttgtgaatatgctcggcttccagcacagtagagcccaagcgcgggccggccggaatctgaatctcggagaagtcaagcttcttgttgttgcgtgcctcctgctccatctggtcgtaacgctccagacgagccttgttcttggcctgacgggccttcggcgaagagcgcacccaatcaagttcgctcttcaggcgcttggcgagcttggcatccttggcgccctggatctccatacgcttggccttggtctccaaatacgtggtgtagttgcccttatacgggtacagctggccacggtcgacctcgcagatccactcggccacgttatccatgaagtaacgatcgtgggtaacggcgatgacggcacccttgtactggtgcaggaactgctccaaccacagaatcgactcggcgtcaagatggttggtaggctcgtcgagcagcagcagatcaggagcctccagcagcagcttgcacaatgccacacgacggcgttcaccaccggagcataccgttaccggagtatccggatccgggcactgcaaagcatccatagcctgctcaagctgagaatcaagatcccaaccgtttgcagcatcgatatcgttctgcagcttgcccatctcatccatcaaagcatcgaaatcggcatccggattggccatctcttcgccaatctgattgaaacgagccaccttttcagcgatctcgccgaacgccatcttgatgttctcgccaacagtcttggtgtcatccagcggtggttcctgctgcagaatgccgacggtataacccggagtcaaagaagcctcgccattagacacggtgtcgagtccggccatgatcttcagcagcgtggacttacccatgccgttcgggccaacaacgccaatcttcgcgcctggcaggaagctcaaagtcacgtcatcgagaatcacacggtcgccgtaagccttgcgggccttgatcatctggtaaatgaattcagccaatgttgtgttccatccttaagaaacgttggaattccagcgtgttgcatgagcggtcaacggaaactcaatcaaggattccggaacgcaacccacgcacaataccgtgcataattatcccataccccatctacacgacggtatgggcgaaagtcgtgcgctcaggcagtaagcggaagcagcagatgctcatgcaaagcaggacgaacgatattgtcgaaatcaccagattccgggcattgaatcgcaacaaccaaaccctgcttcggcaaaaccgtagtaatctgaccgtacgcaccatccgcacgatatgccccctcataaggcgacatccagaactgatagccataaccgcacgtccaaatattgctatacggagtgtcgatctgcttaccggaagcctgcttgacccacgattcgctgacaatgcgcgtgccatgccaagtgccatcattcaaatagacctggccaagtttcaacatattcgcaagcgacatgtagatcccgccgcctgcaatcggatgaccttgcggatcacattcccaaacaggccaaccctgatccaacttggaaaaaatcgtgccatacaaatactcgccaagacgcatgccggcagcctgctccaacatgcggcccgccaaatcagaatccgcagacgaatagcagaacgtgctgccgggctccacctcaaccctgcgagagaacatgtaccgtaaataatcaggcgcaccaacaccactgcgccggtcagggttcatcaaatacgcatgattgaaaccgcttgacatagtcagcaagtgcctcagcgtgatctgacccaactccagttgcgcatcggaaggaacatactcggggaacgagtcgaccaatcgcgaatcgagcgacagcaagccatcttcaatcgcaatgccgatagccgtcgaaacacaacttttcgtatgggaataaatattgcgatcctggtcgggaacgaaatgacgttccgcgataatgtcgtcgccatccgcaatcgcaacggcttcgacgggcagggactcgctttcaatgagtttgacgaaatcgttgaacatatcgatgacacccatgagatctcctttgacactgccttacggtgcattacggaaactgtagcgtaaggcggttacgtacgattgttacatcaaacgatttttcctaagcctgtcgctagatggagtgcccgaaaaagccgctaggtgccatgcctgaaaaagccgttaaatgataatgccttcgcaatgatcgatctcgtgctggatgatctgcgcggtgaaaccagtgaatgtggtatggcgctcgcggaacttgcgatccgcatacgagacctcaatgcgctggaagcggaccgtgcggcgctcgcctttgagagacaggcagccttcggaggcgtcgtaggcgccgtctttcgcagtgatcgtcgggttgaacattacgaagatgcgaccgccgaaatcctcgtccacgaatgcaatgatgctcttcgagacgccgatcatgtttgcggccatgccgacgcagccattgcgatgtgcgtcgagcgtgtccttgagatcctgtgcgacggcaagatcctcgggcgtattgagcgcctccgtcgacggctggctcaaaaacggaatggacgtcatgatttcgcgctgcatgtgatgtttcctctcgctggttcctttgctggtctgccaacattgtatggcgttattgtgcgacgccgtacggcgatgggacggatgaccggttcgcgcctattcatttacggaatgtctcgtggagattttgaaatgtgggaccgcaatcgacgcaatatgcttggaaccgtggatgacatgcctcaatatcggaaatacatgacgcaggcgctggaactggcccataagggagccggttgggtgaatccgaatccgttggtcggcacggtggtggtccgcgacggcgagattctcgcagccggataccacgaccgctaccgcggaccgcatgcggaacgcatggccttcgactatgccgacgagcatggtgtcgacatgcatggagccacggtcatcgacactctcgaaccttgctgccatgtcggatcgcagccggcatgcaccgatctaattctttcgcacggcataacgcgcgtcgtggtcggttcgatcgatccgaatcccatcgtggtcggcaaaggacttcgcattcttgaggaaaacggtgtggaagtggtatatgacgtgatgcgggcggaatgcgacgccatcaatcgccatttcttccactacatcaccacaggaatgggggtgcggacgaaatgttgataaatcaacgttttttagaccctttttcctatttgacaaatgatttaactatagctattatgtgcttcgtaaatagaagacataaatttcgaaaggaggatgattcgttaagtgcagtggttccgcaggacggaaccccgattttctgtttgtgggcaacaacgatgtgccgtttatttctcgcatcgacattcgtcggtgcgggagttcaccgatgaaagggaatgatcaatgaagatgaaaagattcgtggccgcggccatttgcagtctcgtgcctgagctttgccgcatgtggttctgacaccgccagcaaggacgagaatgtgattcacatcatgtcctcgggcgattcctccgcgaatatggagcgggcgctggtcgacgaatacaacaagaccgccgatgtcaaggctgttcttgatctggtgacaagcgcggattatcagaacaagctgcagacggtcatgtcgaacccgaagtccgattcggctcccgacattttcttcaattgggcggatgctttgatgatccagtacgctcgcgccgatgtgagcgccccgcttgatgagtatatggagaaggatccggaactcaaggacaacttcctgccgtccattcttgacgccgccaaggtcgatggcaagtattacggcatcccggtgcgcggagtccagcccattgtgttgttctacaacaagaaggtgctctctgacaacggcatcgaagccccgaccaccttcgacgagttctgcgatgcatgcgagaagctgaagtccgcaggcctgacgccgatcgcgctgggcggcggcgaccagtggccgacgctgaactggtattcggtcatctatcagcaggtgatgggcaatgacgacgtccagaagatgatggacggcggcgtggacgagtggagctcgcccaagagcaagaaggcgctggagattatccgcgacatggtcgaaaagggatacttcggcactacgtacgattcggtcaagcacaccgatggcgccgccccggctctgctggagcaggggaaggccggcttcgagctgatgggctcgttcggctattcgggccacaaggccgcggcccctgaattcaccaatgatgatctcggctatatggtcttcccgcccatcgatggggtgaagggcgacgccaaggatctcgtcggcaacccgtgcaactacttcagcatgaacaagtacaccaagcatcctgaagcctgcgtcgagttcctcaagatgctgtattccgataagtgcgtggaggatcagctgaaggccggcaacctgcccgcaacgaccaacgccagcgagatggtggagaaggtcgtggacaatgcctccgacggggctttcctcgagtgggagtctcaggcgctgaccgatgctcctcacttcatgatcacttggactccgaaccatgtgtcctcgtcgtctcagccgatgctcgacggcatgcagcagtatttcaatggctccatcgacatgggcaccttcatcgacgagatgaaggccctgccgaccgagtgatttcacgataggacagaccatggcaaagcgtaactcatctgagatgcagacggggaacgccgagggccaggttcgtcgcccaaagaagggcgcctcctttgtcggaggcgcccggccttcgggcctctgggccgtgcctgcggcggtgttcttctttatcttcggcatcctgccgctgtttattgtggtggggttgtcattcttcaaatggaatggcttgggcacgccccagttcgctggagggcagtactgggcccagttcattcatgatcccaaagtcatgaaaagcgtcggcgtcacgcttacgctgacgattctgggcatcgtgacgcaaacgccgctctcactgttgcttggcgcctgggcggcgggccggcagcggtatcgtgcggtgtataccgccatctacttcattccatatctgttgtccggcacggccattgccgttgcctggcgcgccatgctcgatccgaacttcggcatgccgtcgaagatgcgttggctgttcggggacggcaatatcttcggtaacgcctcctcggccatcgcggtgctggtgttcgtcagcctgtggcagttcactcccttccatgcactgctgtatcaggggggctgtccgtgccattccgaagactttgtatgaggccgcttccatcgatggcgccggtaggattcgtcagttcttctgtatcaccatcccccaagtcaggaacacgctgattacctcgctgctgttccaggtcgtgggcggcttgaccgcatttgacgcgattctggtgttgaccaagggcggtcccggcactgatacgcagaataccgcgtattacatgtattcgacggcgttcaaggcgtacaactatggctattcgagtgtcatcgccgtggttctgatcgtgatagcgaccatcctgtccctggtgatggtgaaggtgtccggatatgacaagatgcgtagcgaattggagggtatctgatggccacgaaacatgaaacgggcgcggtgaaaattccgaagcgccgttcgctcgaacgtccaaactgggctgccggtgttttgtcaaccctatggctgctggtggtcgtcgtaccgctgtacatcatggtcaaggcgtcgattgaggacaagcctcattattccgaagaggggccattgtcgttgccgacgatgttcaccttggacaactacaccaatgcgttggatcagggattcctgcaggcattcatcaacacggcgatcgtcaccgtttcggttgtggccatcgtgctgatcgtggtgccgccgttggccttcgccatcgtccgcagccgaagcaaattcgtgaatggcgtgttccagatcatgctgctgggcattgcgatccccgtgcaggccatcatcgttccgctgttctttatgattcgctccgttggcttgtacgacaacctgatcagcgtgattgtggcgtctgccgcattctcgattccgatgtgcaccatcgttctgacggcgtcgatgcgtcagatcaccaatgagttgtatgaggccatgtcggtcgacggcgcgtcggtggtgaggattttcttccagctgacccttcccatgtcgaaatcgggactggcgaccgtgatcatctactccgcgatgggcgcatggaataacttcatgttcccgcttatcttgacgcagtccgattccaaccgcgtgctgacgctgaacctgtaccagtatcagagccagttcggtatcgacatccccggtatgatggccgcggtcatcctgtccgtgctgccgatcttggtggtgtacttcatcggacgtcgctcgctcgtcgacggcatgatgggcatgggcggcaagtgagtatggtgccggggacgccataatgaggggtgtccccggcatcgtctccgtccaaatcaacgtcttcgatccgcacatggaggtgcggacgaatggtgaaagggtaaattgtaatgcagtaccatgtttctcccgaaggttctgataccgcccagggtgggccggataatccgttccggacgatagggcatgccgcgcaggtcgcgatgcccggcgatatcgtcatcgttcatgacggcgtgtatcgggaatgggtcgatccgagacgcggcgggacctgcgaggccgatagaatcgtctaccgcgccgccgacggggaaaagcccgtgatcaaggggtccgagatcatctgcgggtggagccgatacaaggatgacgtctggcgcgtgacgttggacgacgccatgttcggcgattacaatccgtacaggcagccgctgttcggcgattggctcgcgatgccgtcgcgtggcgaggaccccgacaaacatccgggcatggtgttcctcaacggcagggcgttgtatgaggtgacctcgctcgaggatacttttgcgccgcggtaccgtgaccatgtcaaggattatgtcacggatgtcgcatgtgcgatcgacgatcccgagatgacccaatgcgtatggtacgcccgggtcgaggacgaccgtacggtgctgtacgcgaatttccatggcgccgatcccaatgaggaatgcgtggaaatcgcggtgcgtcggtcctgtttcttccccagacgccatcacgtgaactacatcacggtcagcgggttcgaactgtgtcaggccgccacgcaatgggcgccgcccacctcgcatcaggttggcgccatcggaccgaactgggccaccggatggattatcgagcgcaacctcgtccatgacgtcaaatgctcgggcatcagcctgggcaccagcgaggaaacaggcgacaacgaatggtatcggaccgagcgcaagaccggtcaccagtaccagctcgaagcggtgttcaaggggctgcgtatcggatggaagaagggattcgtcggctcgcatatcgtgcgcgacaacgtgattcatgattgcgggcagaacgcgatcgtcggccatatgggcggagcgttcagcaccatcgaacataaccatatctaccgcattggtgcccggcgcgagttcttcggctgggaggtggccggcatcaagcttcacgcggcgctcgacgcccgcatcctggacaactgcgtgcatgactgttcattggggatgtggcttgactggcaggcccaaggggtgcgtatcagccgcaacgtgttctacgacaatgtctgcgatctggagatcgaggtcacgcatggtccgtgtctgatcgacaacaatgcgttctgttcggcgatgacatacgacaattatgctcaggggacggcgttcgtcaacaatctgatcggcggcaccatctcaaacaacagcgtgttggatcgtttcactccgtatcattacccgcattccacggaggtggccggcaacgcattcgtctatggtggcgacgaccgatacgcgtccaacatcttcctcgacggcgccgggaccctcgggtccacgggactatccgcataccgcggatacccgtccacgatggcggagtatctgcaaagcgtccacgacatcttcgcgtccggggtcacgaatgggcacgatccgcagcccgtgcagatgctgtacagctgggacaacgcctacgtcggcgaggccgaaggccccgaaggggagcaggggaccacgcatgtggcgtcgcccgtcaacgtccgttgcgagttcaagggggatgacctgtacctgctgttcgattgcccgacggagcttgcggacaagaaggcggccgtcgtgggcacggccgatctgggcgtgccgcgcatcgtggatgaacggtatgaggagacggatggatccgatatcgtgatcgacaccgacatcgttgggcgccagcgcgcggaactgagttccgtggggccattcgccgagcttcatccgggatccaaccgtcagctggtctggtgtggcgcggtccggacgacggacgacgcctgcccctcctgcggcgtcaaggaatggtgagaccatgaagatcaccaatccggtgctcaccggcttccatgcggatccttcgatgatccgcgtcaaagacacctattacatcgcgaactccacattcgaatggttccccggcatccgcctgcacgagtccaaagacatggtgcattggaacacgttgccgtaccccttgggcgccgaacagcttgacatgcgcggcgatccggcgtccggcggcgtatgggcgcccgacttgtcctatgcggacggaaggttctggatcgtctattccgatgttcatatcgtcaacggcgcgttcaaggacgtcgtcaactacctgacgaccgccgaggacatccgcgggccgtggtcgaagccgcttcgtctgaacggcgtcggattcgacgccagcctgttccacgacgacgacggccgcaaatatctggtgcagcagacgtgggaccatcgtgaatacaagcatcagttccacggcatcacgctgaccgagttcgacacggcgacgatgcggctgaagccggagacggcccgcacgatctggatgggcgacgatgtcaagctcgtcgaggggccgcatctgtataagatcaacggctggtactatctgttctgcgccgagggcggaacggtatggactcatcaggaatccgtggcccgctcccgcacgctcgacgagctgtcgttcgaggcctcgcccacgaacccgttcatcacgaacttcgacatcccaggcagctacctgcagaagcagggccacggcgcgctggtggacaccccgtccggcgaatggtactacgcgtcgctgtgcggccgcccgtggcatcacgagacagagtcgttcaccgacccgcgcggctggtgcacgctgggtcgtgagacctcaatccagaaggtcgagtgggctgaggatggttggccgtacatcgtcggcggtcatggcggcgaacgttatgtggaggcgccgaaggacgcgatcgagacagtcgcgcccgcaagccgcgatcagcacgacgagttcgacgccgacgtgctcggtctcgactggaacacgttgcgtgtgccgttcgacgagaagatgggctcggtcggcggcggcagcctgaagctgatcggccagggctcgctgtgcaacacgttcgacctgtcgctggtggcccgccgctggcaggcgttcgatttcgacgccgagacctgcgtggcgttcgatccgaagacctaccaggcgatggccggtctgacgaactactacaacgaccagcattggtcgtgggcgtttgtcacgtacgacgaggaccgcaagtgccgcgtgatcgaggtggcgcagaacgaccgcaacaattacacctcgttcttgcgcgagaacgccgtagtggtgcccgagggcgtcgatcgcgtatggctgcgtgccaaggtgcgcacccagtggtacgcctacgaatactcgttcgacggtgagacctggaccgaattgccggtcaggctcgacgcgaggatcctctccgacgactacgtgaaccagacgtacggcggcttcttcaccggtgccttcgtgggtctggccgcggtcgactattccggctacggcgaagtggccacctttgaccacttcgactaccgggaaatttctgggatggaagactgatagatggtcgtttcgcgggatgtcttcccgcgaaacgaccatatcaataatcagtattgttttggcgcatgatggcaacgttttgcgaagatatgagaacgatatgagcagtgaagtatgcaatgaggtaggaatggctctggaatgttccgcccgacgagccgacggcgcgggacggtatgtgcgtcttgatgaatgcggtcttgccgtcgaagtcgactggcacggaggaaacgggtcccccgccgatccgtggcgttgcacggtaacggtgcgcaatgacggctccgttgcgttcgaaggggtcgttcgcatcgatatcccgattcgggctgacggtgaaccgcggttcttcctgccagggttcatgtatgggcgtaatcgtggagaggcgccgctgcgaaccgcgacgaaatttccccggcttcgtgaacggagcgaactgccagcctcatcatggtggatgattcgaggagacaggctgtccaatccatgtgcattggccgtgacccgttcccgtgtcgtcggtgtggtgtccagcccctatctggttgaccgcggtgatgggatgttggtcggacatgaggcatgtgatgaactgcctttcgtccagtatgcgggattcagctgcatgttgccgacgcctggaatcgtgccctgcgacgaccacgcctcggtgggcgtgactatcggctatgagaacgcgccctggttgttcgtcagctcgacggatatccgcgaacgtcctgactcggcggaagggccgattacactggcgcctggaggcgcggcgattatgcgcttggacatcgtcgacgctcccgcccgggatgaacgggctatcataccggtgctggaaaccgtataccgtcgttttcatgaaccgccgcgtcaggtcggcgctcccgctcgggctatacgcgacattgcagtcgccgttgatagagacgcgtggctggaggacgaacacatgtacgcggggtttgtcttcgaccatcatagcccgggagatgagatcatcgaaggtaagccgtatatgtaccgccggttgggatcgagtagttggaccaacggcatggcctccgcggtaccgatgttggcgtcggcttggcggttgggggacgatgctatgcgtcgtcacgccctcgacggcatcgagcatatcatccaacattgcatcaacccgacgaacggattgccctacacggcggtggaacatgagcggtggagcaaccgcggttggtggttcgacggactgtccaatcccggacacagcgggtaccttgtcgggcagacgatgtactcggcgttgcgggcgtggcagatcgaacggcggttcggcggaatcgatcactcggactggctgaagatcatcgggaacgtcattccccgattggcggcagggcgcaatgcggttggcgaatacccattcgtgttcgatgagatggacggctcaggagccgagtacgaatcgttcggcggtgtgtggtgtctggccgcatccgcgtattgggctttgctgaccggcgaccactcggatctggatgggatgctcctatccgaacgtcattatcatgaccggtacgtggcgcatatggaatgctatggtgcgccgctggatacatcgaaagccgtggattccgaaggtatattgggatatatcaaggcggtcggatgcctatacgccattaccggagacgctatgtatcttgaccggatgcgagaggcgttcgcctatgaatgcagtttccgtttttgctggaattcgcccgttggcgtaccgcctctgaacgaagtcggctggtcgagttgcggaggcagcgtcacttcgaccagtaacgcccatatccatccgatgtcaagtgtggccatcgaggatatggtttattacctccgatatcggaacgacacatatatcgcgtcgcgtttgtgcgatgcggtcggctggagctgccagacatataacctcaaggatggtgagtacggatatgggcgggtcggctggatgtcggaacggttttgtcactgccaggggtttttggacgagaggtacccggatggaagcctgtgcagcacgtggcgttgtctgatgccttgggcggcgggagcgatcttggacggtctgacgggtctgtactgggacgtcatgccgcatgatgagttgccaaccgtcaccatggtatcgcgggcgatgggttgcgtccatgatgagaaaggatgaaacaatgggtgcgggagccatgggtcatatggagaccagcatgttcgaacagtgcgggtacggccgcgaggccatccaggcccggctggaacgcaactggaccgagatgttcgaaggtccggacaagatctactgggagaacgacgagggccttggctacgtgatggacaccggcaaccacgacgtgcgcaccgaaggcatgagctatgcgatgatgatcgccgtgcagtacgaccgcaaggacgtgttcgacaagctgtggggctgggtcatgaagtacatgttcatgaccgagggcttgcacaagggctacttcgcctggtccgtggacctcagcggcgtgccgaacgccgacggcccggcccccgacggcgaggagtacttcgcgatggcgctgttcctggcctccgggcgctggggcgatggcgagggcgtgtacgagtactcccgccacgcccgctcgatcctgcatacctgcgtgcaccggggcgaggatggcgagggctacccgatgtggaatccggagaaccatctgatcaagttcatcccggaaaccgaatggaccgacccgtcctaccatttgccgcacttctatgaggtgttcgcacagcgtgccgacgaggccgaccgcccgttctggcgcgaggccgctgccgccagccgtcggtatctggtcaccgcctgccatccggaaaccggtatgaaccccgaatactcaaactatgatggcacgccgcatgtcgacgagcgcgaccactggcacttctattccgacgcctaccgcaccgccggcaacatcgggctggactgcctgtggaacggcgtcgtgcccgagctgtgcgatgcgaatgcgcgtctgcagcgtttcttcctcgaacacgaccgcacctgcgtctacgcggtcgacggcacgccggtggacgagaccgtgctgcacccggtcggcttcatcgccgccaccgccgagggctcgctcgccgcgatgcactcgcaggagccggacgcgctcgataatgcgatccgctgggtgcgcctgctgtgggatacgccgatccgcaccggcatgcgccgctactacgacaacttcctctacgcgttcgcgttcctcgcgctcgcgggcgaataccgcgtgtggtgaatatggctgaaacaaggagttggacacaatgaaatcgacattgcatatcaatccgttgttcggtgaaggatgcgtgctgcaatctggcatgccggtgaggatctggggtggtggccgccccggttccacgatcgaggtctcggtcgcggaacggcgtgccgatgccatcgtcgacgccgatggcgcgtggacggtcacgctcgaaccgttggacgctggtggtccctatcgcatgacggtcagtgaaacgtcggaagcggcgacgcgggaatcattgagccatgacgtttatgcgggcgaggtgttcatttgcgccggacagtcgaatatggaatatcagatggaatttctgcactggcgttatccgtccgaattcacgcgtgaagccgactcgctgctgcgacattgcaaagtgccggtcagattcgatttccacgggccgcgtcatgaattcgatgaaccggtacaatgggttggcgctgcatcggatacccttgatgagttcactggaatcggctacttttttggacgtatgattcgggaatcgttcggtgtgccggtcggtctgcttaatatcacgctcggcggctcaccgatcgaatcatggatggatgaggagacactcgctgcatggccgaggatgctcactgatctggcaccataccggaatgatgatgaagcccgtgtgcgcaatgagtctagcattgaggcccgcacccggtggcatgaagatctgcgtgtgcgagaagtcaaccgatggaatgaggatgcggaaaccggaaccgtgaacctgcccgcattcctgtcggatgccgatcctcgtctagctgggttccgcggtgtgatccgcttgcggcgtacggttatgttgccgacgtatgcggttggacggcctgctgtgctgcacttgggggcgatggttgattcggacatcacctatgtgaatggtgttgaagtggggcggtccgagcaccagtatttctcccgtgactacgttgtcccggagaatgtgctgaaggccggccccaacgatgtagaagtacggctggtgtgcgaacgcggcacgggccggttcactcccggtaagcgcatgcatctggatgtgggcgatgactcgttcgatctgagcggagcttggcggtacatgatcggtgccgaaatcgatgaggattgtccgacggaagattccctgcagtggaagccattaggcctgtacaacggcatgaccgcgacctgcgccgggtacggcgcccgtgcggtgctctggtatcagggtgaatccaatactggtgatgtggccgatgagtatgggcatatgcttacggcgatgatcggctgctggcgacatgcttgggatcaagaacgattgccgttcctgattgtgcagttgccggtattttcaatcgacaatgtcgaggatggtggatgggccttggtgcggcagcatgaatggcaggtgtcgaagaccgttgatgatgtgacaacagtggttgcgctcgacgccggtgaatggaacgacctgcatccgtggaacaagcgtgtggtcgccgagcggttgttccatgcggcctgcggtcttgtctatggtaaaaatgacgcaccgaaatcacctgagccgaagtccgcggtgttgacagacggtgagctcgtcatcgactttgcaggtggtccgttatacaccttggacggggacgaaccgcgcgaattcgagcttgtttgggaggacggctccgtgcatgccgtctccgggcgcgttgaaggcgacaaggtcgtcattcgtgtgccctggcgtaagccgacatccatccgatatgcgtggagtaatgcgcccggtcgtggtctactgtgttcggggaagggtatgcctgtgccaccgttcgccatgccgattgagtagagaagacgcgccgaaaccggatgttcgccgttcgaccaagtcgggacgtggccgaacgacgaacttgctatcggatgtcttgagcaattccaagaggtagcggagcgtatagaagtctgttgggcagaatgatcggttcgacgatttcgccgttcgccgaatccattgcgtaaccgagccgttcatgaaaggaatgaacatatgagaaacttcatcttccacaatcccgtcaagatctatttcggagaaggtcaggtctcgcatgtggccgaggaggccaggtctcgccccggtgccgcgtgctgctggtctacggcggcggctcgatcaagcgcaacggtgcctatgacgatgtgacggccgcgctgcgcgaggccggcaacgaggtcatcgaactctccggcgtgaccccgaacccgcgactcgacaaggtcttcgaaggcgtgaacctggttcgggagcacggggtgaacctgatcctggctgtcggcggcggctcggtcatcgactgcgccaagttcatctcgctgggttccggcctgggcgaggacgaggacctctggtacgactacgtcgaaaccggcaagcccgcccccgaaaaccttgtgccgctcggcgtggtgctgaccaccgccgtcaccggctccgagatgggcggcgtggctgtgctcaccaactgggcccgcaaccgcaagctcggctacacatccttcccgctgacgccgaagttctcggtactcgacccgacctatctgctcaccctgccggctgaacagaccacctacggattcgtggacatgttctgccacacctgcgaacaatatttctcgttacccagcgacgacaatctctccgacgagatggccgaggccatccaacggcatatcctgcgctcctggcgcgcctgccgtcgccatccgcgcagttatgaggcccgtagcaacgcgatgtgggattccacgttcgcgctcaaccgcgtcatctcgcgtggcaaggaggaggattgggtcacgcacggcatcgagcatgcgctctccgcctacttcgacatctcgcacggcgccggcctggccgtggtccatccgcactggatgaagtacgtctacacctcacgccccgaagccaccgcacgcttcgcccgctgggcggtgaacgtgtggggcgtggactcgaccggcaaatccgagcgcgaggtggccgaggagggcatcgagcactacgtcgactttctgcgtctggtcggtgccccgctcaccctgtccgaggtcggcattccagccgatccggccacgctggacaagctcgccgaccatgccggcgacgtcggcggctcctaccgccgcatcacccgcgacgatgcgcgcgccatcctcgccttgtgcgtgacaccggtcgtgttctgaggatgtatcaaggtgtatcgagggatggaggcgccgaagacttgatatccacacctgccgtatacacgtctatgaccacacattttgccctccacctgtacatcgatacgcagccgccacggtgtacggggagggcaagccgtacatggatgtgcgatgaaaggcggcatctccgcttcggtggcggggcaggctttcatcgccaccgaagccgttgccggtcacatgattcggcatatgccaatgtcgagcggccttattaccccgctctcggcggggtgcggaagtccttgaagcgttggattgcgcttccataccattccgcggcggaatcggacttggcataacggtttggtttcgccgttttgctatggtatctcggctgtggcatggtacggggcaccgttatcaggtgctatggtgttccgtatcgggatcgggtggtacggaacaccaatcgccgagtgttgcagaacctgtaccgcaaaggggcggccttccggttgtgatttcgatcgtgaacagccttgtcgccccgatgggaggcgtcaccgttggtggccgcatattatcggggcgtcaaccgcgtgcgaacagcgtcaacttggcgaagaggtcctcgagaatgaatcgactgtcaatgctgtcgtagatgcgtatcgttgggcgagacggtatgaaagcagtggagctgtccggcttgaccaatggtgccggcgcgtaatggaattcgccgcaatcatgcttcatcgccaagccgacggcgggcgaatctcccaatgaccagctttctcccgaagtccagaacgcgaaatcactgtcattgtatttcacgagattgtcgaacaggaactcgccgatagcgcccgcatcggcaagcttacattgtagttcggcaatgctcacattcatcgtacggtagacctgataaggcaccagccagagattcgcaccactggtcagcaccagattggcgccttccacgtcgttgccggagttgaattcgcgaatggcttcctcatcgttgccgggaagctgcgtgccgatccagatgatggtcatccggctgacgatttccgggtgcagcttgatggcggcggccacgttggtgatggcgccgaggcacagtacgaacagcggatgggtatcagcgctcagagcttcgtcgagaatcgcacgcgaagcgggggagaggtcctcatcagaggcgaggtgcagccccgccagcggcgtgcgggcgccttcgagtaccggtacatcggagttcagcagttgaacaaccgtggacgcggtgcggaagctgcgttccatactgcccgcttcgttgaaatgctcggcgcaaatcgccttgaccatgaacttcggtgtcagcaacgcctgagcgatagcgaacgggtcgtcggcctcgcaatcggcgtcggtgtcgatgatgacacgaatctgcttatcatcacggactgtgaaatgaaaagtcatcaatgttcctttcctgatggtgatatgcgatgaggctgctggccctcgtcgttccgacaacctcatcgtgtgacttcatcaaccgcgccagcgcacgtactgctcgtacacctgcggggttggttcgccggtcagtgtggtctcgactttgaccggccacgtcggcggttcggtctcgccggacagcacccaggcggcctgacgggccgcgccgatcgccacgtactcgtcggtttctggcagttcgacgtccatgccgaggatcgcgggggccagcgcgcgcacggccgcgaacttggttccgccgccgatcagcaggatgcgcttgacgtccacgcccagacccttgaccagttcaaggcagtcgcgctgcgagcacagcagaccctccacgaacgcgcgggcgatgttctctcgcctggtgttcgccaacgtcatgccgtacagcgccgccgtggcgtccggacggttcggggtgcgctcgccgtcgaagtgcggcaccagcgtgatgccgccggcacccggttccgcggccgcggccagttcggccagttcgtcgtagtccacgccgagtgcggcgcgtccggcatcggagatgcgcgaaccgttgatcgtgcaggccagcggcagccaatgtccggtgcagtcggcgaatccggtcaccgaagcggtcatgtcgtaggcgggcacgggggagatggccgcggccacgcccgaggtgcccagcgagatgctcacgtcgcccacacccatgctcaggcccagcgacgccatggcgttgtcgccgccgccggggccgatcgggcagccgccctccacgtccttgccggcgatggccggatcggccacgtcgccggtctcggtcgggccgagcacgcgcggcagcacgatgccggcgatatcctcttcgccgcgtcccagcgccatcgcgagcaggtcacggcggtattcgttggcggtcgcatcgaagtacgcggtgccggaggcgtcggaacggtcggtgaacagcgcatccaggttcgccttcatctcctcggcggtcgcgtcctcgcccagagggccgtggccggcgatgcgccagctcagccagtcgtgcggcaggcagatcgcggcgatgcgtgcggcgttctccggttcattcgcggcgacccacgccaccttggtgatcgtcaacgaggcgaccagcgaggagccgacggccttgacccagcgctggcggccgcgcatcgccggatcgtcggacaggtcgtcctcgctgccgtcggcggccttctcggcctcgcccagacaggcgatgagcacgtcggcgttcgtggcggaacgggtgtcgttccacagcagtgcgtcacggatcacgcggccatggtcgtcgagcagtaccatgccgtgttgctggccgccgaccgccagcgcggccacgtcgtcgagcccgccggcctgttccgcggcctcctggaacgcctgccaccaggcatcggggttcacgctggtgccgtcggggtgcttggcctgcccgaaacggaccatctcgccggtctcggcgtcggtgacgcgcaccttggtcgactgggtggacgtgtccacgccggccaccagaactctgctcattgtgcctccttgcaacatgccgccaaaaacgtcgggctgatggcgtttggccgaatacggtcgccattatacgcaaatagtttgacgaatgaactatactggtgtgtgtaccattttcacaatgttgtgggaggcacgccggaggcgatgaagcaccagaacacatagaggagagctacgtcatgactacgctgcgcagaatcaatcaggacgatctacgcaaccacaatctttcggtggtcatcagcacactgctgcgcgccgccgaaccgatgagccgcgccgaactggccaaacagacgggactgaccaaggcgaccatgtccctgctggtttccatgcttgtcgacaacggcgtcgtgcgcgaggggacgccgagcgtacaatcctcctatgggcgccccagcacgccgctgctcatcgtcggaggccgatactgcggcatcggtctgcaggtgaatacggacggctacggcaccatcgtgctcgacttggacggcacggtggtcgcggaacgctgggtcgatgcggatatgtccgacgtggacgccgacgacatcttctccgaactgaacgccctgtcacttgagcaggaacggctgctggctgaccgcggatacaccgtgacgggtaccggactggcattgcccggtctggtcacggatgacacgaggctcctcatggcccgcaacctgggatgggaacagttggatctcaagcggttcgacgtggtgcggcggctggatgcgactgcgggcaacgaggcgaatatggcggcgctcgcgcagattcccggatacgctatgcaccgtgaggacgacggcatcgtggaacccaacgcctcattcatctacctgtccacggacgtcggcatcggcggcgcggtggtccgtggcggacatgtggagatcggcgaccatggattcggcggggaactcggccacgtgtcggtggagctgcgggggccggtgtgccggtgtgggcggcgggggtgcctggagacctatgccggccgcagggcgatggtggagtccgcaggcatcgccagcgggtcggcggccgcgcggcgcgagtcgatcaacgagctgatcgaacggtggcgtgacggggacgtcaaggccgcggcggtggtggacaaggccatcgaggccatggtctccgccatcgcgtcggcgatcaacatctgcgacgtcgatacggtgatgctgggcggcgtatggtcgcagttcgggccggagatcgcctcgcatatgcagggcatgatgcggcgccaggtgcttggataccccgaggtgcgcgccaaggtgctgatggccgacgtgacgtccaaaccggcgttgatcggttcggccgccatcggtctgcgccgcttcatcgacaatccgatgcggttcgtctcgaccgactgacggtccgcacacggatgcacgcgtgttccaacctaggcctataacgtcgggggcgcggcaagaggagctgcctggtacagtggcacgtggcgattccgcccgggctgcgcaggtcaaggatcgtccgcgggtctccccgtgttcatgccgtgcgcagtcaacagggaacaggagcatcccatagccgaacatcctcaacaaccgaatcatcataccatgcccgccgtagggaaaacgtcggacatggccgacatgtcggcacggagggatgcctccggtcccgccggattgtcgtccccatcctccggcggccgggccgcggaccgtcgttggcgctggaggatggggacgacatcgccgtgggcgccgcgttgggcgtggcctgcggactggtgttctggctgttcaacttcgcctacgcatgactgtccccgatcatcggcggcatcctgcccggactggccagcatcctgtacccgctgtggtatttctccggcacgttggccgtcatcatcctgcgtaagcccggagccgcggtctatgtgaacctggtgggcagcgcggccgagatgctgctgggcaaccagttctcgttcgggttcgcgtccgcggcgctgcagggcgtgttcgccgaactgccgttcgcactcacccggtaccgcgtgttcaacctgccgatctccatgacgtccggcgccttggtggccttggaatacggcgtgtacctgatgctgttccggtatcagggcgtatcgttcctcagcccccgcggcgtcatccatatgatcagtgaattggtcggcggcgtgctgatcgccggcgtgatgagctggtatctgtacagggccatcgccgccaccggggcgttggatcgtttcgcttccggacgggcgcggcgcgacgatgccgaccgtcgcgggtgaccgctgtctccggtcggcggttgtcaggatgccgcccgttgacgagcatccgggcaaacgcccagcggtttgctagactatagggccggccacgaaccggcgtggggctgtagctcagtcggttagagcatcggactcataatccgccggtcacttgtccgatcagcaccaccagcaccgtcagcccggtgccgagttgcggcgacagccaggaggtcatcagcaccacaacggcgccgagcaggcccccgatccacatccacggcggattatgcccgcggatcgccttaccgagatcgaggccatggtcacggaacacgaccacggcgcacagcagcacaaatcccaggatgaacgagacgaccgacgccttgatcggcgatccgagcgccgtacccagtcgtcccagcatggcggcttgcaccgccaacgacatgccgcagagtatgcccagtccacgccatagccagatgcttggcgagcgggttcggttcgtggagcggccgtccgcagggggtcgcaacgtgtccgcggacagcattgcggggggtgcgcgccgctccgtgccgcgagccgaacgggttcggaccgccgaacagcgtcttggcgtcggcggcggcgaccgccagcagcacgccgaggactgccagcaccagtccggctgcgcgtgccatggtcatcggatggcgagggttgcccagccagccgaactggtcgatgagcagtcccatcgtgatttgccccagcaccggcatgagcacggtctgcagactgccgagcctgggcagcagcaggatgttcccggtcatgaagatcacgccgaagagcccggcgaaccacatccaccaggggccgtggagcgccgactcaggtaccagcgggtacggtccgagcagcagtgccgcaatcgttgtggctgccaatcccacggtgaatgacaccagcgacgcgcggaacggtgtgcccaacgttccgcgcagtcgcgcgttgacgacggtctgcaacggcgtgacgattctggtgagcactcccagcgcggcaagcagcatatgatcccctttcgtctcggcgacattgtactcacgacgccgatttcgggggtccagctgtgcgctgggacgcggcggttcggattgggagggaaggcatgcatggcttcgcgggtgatgcgggaagatgcaggaagatgcgggaaaagcggggggatacgagcaaatattaagcaattgatgtccgggtgtccggtttgtcgagacgtctgcttttcataggttcccggcctggccccgcctggggggcagtgccgcaaaacgcaggcaccaagatacggaagaagaggagtcgtaccatatgaacaacatgccgcagcgtttggtgttcttcgccctgggcgtcgtcatcaactcgttcggtgtggcactgatcacgttgggaaatctgggcacctcggccatctccagcgtgccgtacgtgtgcagcctgcagttccccatgttcagcttcggcgtgaccacattcatctggaacatcctgctgattctgcttcaggtcgtgctgctgcgccgcgacttcaagccctcccagttcctgcagatcatggtcaacgtgctgttcagcgccatgatcgacgtaagcatggccatcctcggtgttctgtaccctaccatgctgtgggagcagttcctgtgcatcggcttaggctgcgtggcgttggccttcggcatcgtcatcgagctggcgccgaacgtggtggtggtgcccggcgaaggcgtggtccgtgccatcgccaaggtcagcggcgtgcgcgtgggcacggtgaaggccgtattcgacatcacgctgatcatcatcgccgcggtgctgtcattgatcttcttccacgggttgcgcggcgtcggcatcggcacggtgatttccgcggtgttggtcgggccaatcatcaacatcgtcaatcgcgtcttcaccttccagcaccgcatccaggcgctggccttgtcccgcgacgggcgttgacgcctgactgttcggtcgccacagggccgggaatggtgacgcggaaccgatcgagcgaattgtcgatgcgcaccggttcgcgcgcctcgttccttagcgcggcgccgatgcgcaggtatccggtgccgtcgtcgcgcagcacggtgccgccgtccggatacggggtggaccgcagcagcgagaacaggaatgcgttgcgcgtggacgttgacgcctcatggatgagccgctgtttggagaccgcgccgaacaggccgcccgggttcgagacctcgattcggtcggtgaacacgtccacatgcacgggcgtgccgagcgcgtccggggagtagtcgcggtgggtcaacgcgttggcgatggcctcgcgcagcaccagttgcggatacatcggcggctgtggcggctgtgatggttgcgcgccggaatcggcgccgcctgggccggacgtccatgccatcagcgaggcgaccgcgtcatcgatcatgatcgggatcgggccggtgatggtttcggaggcgacgagccgtgcgtcgccggtgaacacgtcgtcgcgtgaggtaccggggtagacggcgatggtgacgttgagccggggaaagaacttctgcggataccggccgacggccaacagtcccgcaagcgtggggcgcggcacggatgcgatccgggtctcctcgtctgtgtcggtgtccgcgccgatatccgtgtcgtcttccctgaacgcggttcccgccgggtcgcaatccgcggcatgtttcgcggcatgtttcacggtgtcgtccgcggggtggccggctggcatgcgtctcaggatgcgcaggtccagcatcatgtccatgtcggaacgctccgcaaagacatgcggatggcggtcgcgctcgcattcgagcagcgcgtggacgagcgtgggattcaagtcgtcgagcgtggcctccggcacgaccgcgatgtcgtgctccggctggcgttgctcatcaagcagacgatcgacctcgtaggcggtcatcttgcggtcgccgtcgccggtgcggatgtaggagccgccgtgcgggccgaccgaggagacgaagcagggcttctcccgcggcagcatctcgtcgatgacggcgaacaccaaattcgcgccctcgaacgggcaggtcacgatcacgggccggaccacgggcgtgagcttctcgcaggcctggctcaacgcctcctgcatggcgcgggcgtcgaagccctcgaccggcgtgaaccccgccttctcgctcagccccaggatgatgtacccgccgttgccgttggagaacgcggacagcgtctcggtgatggtcgagctgattctgcgtttgcactccttgacctcgcattgctgcgtgtcgttgccgatgacgcgcagcagttcgatgagctcggtcatcttggccgtgtagtcgtcgttgtccatcgcgcctccgggagtgtgccgttgccatctggtgacgtctgtactccgtctgtactccatccggctccatctgtacgccgtccgccgcgggctcctgccactatcctatgccggcggcggcatatgcgtggcgatgacttgcgcgggatcggtgccgtccgcgagtcggatatggtggggcccgcgacgggatcgatccccgtcgcaggccccaccgttaccgtatggtcgcgtggttcgcgggaatcagagcaccgcgtccatcgcctgcttgagatccgtgatgatgtcgtcggcgttttcgatgccgcagctcaggcgcaccaggtcaatgccaacgcctgcttcgacgagctgctcctcggtgagctgacggtgcgtggtgcctgccgggtatagggtgcagctgcgcgcgtcggccacatgtgtggcgatggacaccatcttcaggtggtcgaggaacgcggacaccttttcgcggccgcccggcacgccgaaggaaataacgccgcaagtgccgttcggcatgtacttttcagctagcgcatggtacttgtcttcctcaaggcctgggaagctcacccagctgatgcgcgggtcggcgctcagccactgcgccaccttgagcgcgttcgcgcaatggcgctccatacgcacgcccagcgactccaaatgcatgcccatgatccacgagttgatcggcgccggcgttgagccgaaatcgcgcatgagctgtgcggtggctttggtgatgtaggcggccttgccgaagtccttggcataggtcacgccatggtaggaatcgtccggtgtggtgagtccggggaatttctccgcatgggccatccagtcgaagttgccggaatccacgatcgcgccgcccacgcaggagccgtgaccgtccatatatttggtggtggcgtgcgtgacgatgtccacgccatactggaatggacgacagttgactggtgtggggaacgtgttatcgacgatcagcggcacgccgtggcggtgcgctgcgttcgcgaacttttcgaaatcaagcacgatgagcgccggattggagatggattcgccgaagaccgccttggtgttcggctggaatgccgcttcgagctcttcttcggtgcagtccgggcttacgaacgtgcattcgatgcccattttgcgcatggtcacgttgatgaggttgaacgtgccgccgtagatcgcggaggatgcgacgatgtggtcgccgttgttgcagatgttgaacagtgcgaagaagttcgccgcctggccggatgaggtcagcattgcggccgcgccgccttccatttcacagattttcgctgcgatggtgtcgttggttggattctgcagtcgagtgtagaagtatccggattcggatagatcgaacagtcggctcatctgttcgcttgacttgtatttgaaggttgtcgcctgaatgatcgggggagtgcgggattcgccgttgccgggctggtagcctccctgcacgcagatggtgtcgacgttttcgctcatggattccttctttcgattgcgcgcttcgttgcgtagcgctgcgatgcaacaaacatgttcactttatcactgagttgataattggctatttttcaatggaaacgccgaatagttcactgaattgacaaacttaggaagttgattttattatgtacatcaagacaggcgggaatccgcttgacgggaaaagcaaggtcttacgaaagtaaaaaccaatagcaaaggagcaacccatgggtctgtgggatattgaaaagattccgtatgtcggtcgtgaaaaggggccgcaggagggtctggctttccattactacgatgccgacaaggttgttgccggcaagaagatgaaggattggctgcgtttcggcgtcgcttggtggcacacgttcgatcaggagctggtcgatccgttcggcaccggcaccgcccagcgtccgtggtacggcaagtactccaatgctgaggatgaggccctggccaaggtcgactacgccttcgagttcttccagaagctcggcgtcgagtacttctgcttccatgatcgtgatatcgctccggaaggcgataccctgcgcgagaccgacaagaacctggacaaggtcgtcgacaagatcgaagagaacatgaagtccaccggcatcaagctgctgtggaacacctcctccctgttcaccaacccgcgcttcgtttccggtgcttccacctccccgttcgccgacatctacgcttacgccggtggccagctgaagcattccctggagattgccaagcgcctgggagccgagaactacgtgttctggggtggacgtgaaggctacgagaacctgtggaacacgcagatgaagcgcgaacaggcgcacatggccaagttcttccacatgtgccacgagtatgctcaggagatcggcctggacgctcagttcctgatcgagccgaaggccaaggagccgacgatgcaccagtatgacttcgatgcatccacagccatcgccttccttaagacctacgacatcgacttcatgaagctgaacctcgaaggcaaccacgccaacctggccggccacacctaccagcacgagatccgcaccgcccgcgaggccggcgtgctcggctccctcgatgccaaccagggcgacaagctcatcggctgggatatggatgagttcccgaccgacctgtacgagacctccaccgtcatgtgggaagtcctcgccgaaggccagatcggccctcacggcggcctgaacttcgacgccaagccgcgccgcacctccttcaccgccgaggacctgttccgctcccacatcgccggcatggattccttcgcggccggcctgctggtcgcggccaagatgcacgaggacaaggtcatcgagaacctgcaggccgagcgctacagctccttcgattccggtatcggcgcgaccgtcgagaacggcaccgcctctctggcttccctcgaagagtatgctctggatatcccgcagtccaagctcatcgaagccaccaagtccgatcacctcgagtccgtcaaggccacgatcaacaactacatgatcgacgccctggccgaggcgtgagccgaatagggagtttccgttagggctcctgattcatcgctggatcaagcagtgaggctcggctgtgacagagccggatgtggtgtgccgaagcgtcggcgttccggcacaccactcatctttccttccttcttcctagaatttccttcgcaggcaagtcgtctgccggttatgttgccggtgtacggcttgtttgcgtttttgggccaaacgaaagtttcgattgttcgcaatgatgcgatgctcacgaacgtttctgaataaggtgtatttatgaccgcaactattaccattaccaatcccattcttagtggaatgaatcctgatccgagttggatttgggatgatgagttccagcgaattgtgttggtgacttctacttttgagcttgtcccaggtcttcccatttacgtttccgaggatatgacgtgctggaagcatgtgtcgaatgtgatagatgctgacttggcaaggcgcctacttattcctttcgtggatgattcgggcggtgtctatgcgccgacgctgcgcaggattcatggcaaatatgtgattgcatgcaccattgcccgtcttgatgatcgccgtgctatggaaggtggttgcacagaaagcgagctgatgcggttccacgccgcggggggcaattttatccttgaagcggattctatcgaagggccatggcgtggcccgttctggattgagggcgctgaaggcatcgatccagacatattcgaggacggggatggcaacgtgtactggacccagacccgtcctgcggtcaatccgcaatgggaaggccagactgaggtctggacccaacgcattaatccggagacttggacttttgtcgatgacggtcttcctgcgggatcgggcaagacggtaatatggcgcggatacggtatggaatcggtgtgggctgaggcgccgcatctctatcgtgtgggtgattatgtgtatctgatgaccgctgaggggggcaccagtttcgaacatagcgaaatggccatgcgcatctatgcgccgcatggactgcttcgggcgttcgaagcttacgaacgggaagcatccgaattgggtgagtgccttccgcaggttcgtgacggggaacgctgttatcttggcaccgcaatccgtgccttccatgcggataagaagaatccgattctcacccaccgacatctgggtttgtcggaaccgctgcaatgcgtgggacatgcggacctgttgcttcatccgaaactgggatggtggctggtgtgtctcggcgtgagggagacacggggaaagcgtgacggcgaattattgagctacttgggaagggagagctttgtcgctccggtatcctgggaacataatccggccgattggaagctggacggcaacggtgcaccatatacgcatgagggtgaccccggatggccggtgacttgcgctggtcttggccgcttggccgacgagatcacggttactactgaagacgatggcatcgccatcgagcctagggtgaaatcctcgctcgccggtgacgtggaacctgcgctggtggatgtggctgatggctcgacgaacgatgtggtggtgcgcgatgagcgtgatgtcagctaccgcagaatagcgaaactgccgacgctcatgccgattcccatgtccggttctttagtgatccggcagaattccacacattacgcggtgttttcgatgcatggcacggatgtgcgctacgagatggtgaatggagacgattcgcaagctgggtctgttgtcgtacaggctgacggagtgcgtccggcggtacttttcgacgacaaccgcttgtcggtcatcgtgactggcatgcatggtttggttgattctgcgacgttcgtgcgtcaggggcaggtcctgctgagtgtcgatgctcgtttcctcagcaccgaatgggccggtggattcgtcggttgcatggccggcttcatggcatagtttctacggaatttcaggatggttcactgctggtgttccgacgggccgtcttagaacgagttgaaaacgggtcgaaaggctaggagcgctgtgttctccctccggttgtgcctgtgaggtttgccccgctgattaaccttcgagttgctgtgtgctgttgcgtaccactagcgatgtcggcatgatgatgtgcggttggatcacgtcggtggacagcgcttcgaccagcatgcgtacggcggcccttgccatgtcttggagcggctgtcgtacggtggtcagcgccgggccaaggaatgcggcagtctgcacatcgtcgaatccgaccacggataaatcctcgggaatacgtaatcccagctgccttgccgcctcgtagacgcccatggcctgcagatcgctgccggcgaagattgcggtcggacgattcggtcgtttcaacagggagatggactgtgcgtaaccgccggaagtggtgaaatcgccttcggtgataagttcgggatcggcttcgattccatgttccgcgagcgctgatgtatatccgtccagacgtgctttggaacacatcatctcctccggtccggtgatgatgcctatgcgggtatgtccgagtgcgagcagatgcctggtggcgattacgcctccggtccagttgtccgcttgcaccgacagcgtgtctggatctggattaccgaatggatcgaacaagacgaagggaatacctctggaatgcagtttgttccgctcgatacgtgtcagactggagaagacaagaatggcgccatccgtctgccgacggagcatgttgtcaatccaggatgagtccgggtgctggcgattgccgccttcggtggtgatgacgttcaaatcatgcaacttggcttcgcgaatggcgccacggagtacttcaagggcccaaacattatcgaaatcttggaacacgatttcgataattcgttggctttttgcacctgtcgctttacgggaatacccataccgtttcaacaccgcgttgatggtttgccgcgtctcttcggaaacgtcggctctgccgttgagcgccttggatacggtggaaagggaataaccggtctctttagctatgtcagagagtcgtaccgtagctttctttgtcgtattgcgcatgagtcactccttcttcttttcatcatatccgaaaatgcgaacgaaagtttcggtttacgtttttcgaaactttcgatatgttggcaatggttaaaaacgttgtaaaatcaacgaaaaatagttagttttctgattttacaaaaaacttgactttgtgtgatttgtttcggtagtctgtaggtacaacgaaaacgaaatggagactttcgaagggagtcaaaggctgattctctgtctgctaggggagctgcagcagcattcgttgcggtcatgcttcccgattcgacccattcgagagaagtcgttcctgtcgttgccatcattttgtcgatgatgatttggtcaataaggagaagacaatgaagttcaaaaccattgcagctgccactcttgcggtggcgaccatgttgggcatgggtgcctgtggctccagcgctggcgccaaagacgataagaccattacgttctggcataacgcaacagctggtgacggcaagcagtattgggaggatctggccaaagcgtttgagaagaagactggtgtcaaggttcagattcaggccatccagaacgaggatttcgaaggcaagctgactaccgctatgcaggatcccgcctccggcccggatgtgtacatgacccttggtggtgccaagaccaaggacatggttgatgccggccaggtaatggatattactgataagattagcgataccgtcaaaaagcaaatgtcttcctcattggattccatgtcttatgatggcaaggtctatggtgttccggtcgctgcccagcctggtggcatctggtattccaaggatttgttcaagcaggctggcatcgatgccgagccgaccactttcagcgagctgaagaccgatgtgcagaagcttcgcagcgctggcatcgatccgatcgcactcggcggcaaggatgcttggccggtcggtcactggtactactggttgtccatgcgcgaatgctctccgaaggcctacgccaagggcgttaatgacaaggacttctccgactcttgctgggtcaaagccggagatgatctgaaggatttgttggatgcgaatgcttttaacgaaggattcctcaccacgacggcccagcagggcgccagctcgtccgcaggtctgctggccaatcataaggctgcgatggagctcatgggcacatgggagcctggagttctcaaggacctgactccggacaagaagccaatggctgaccttggcttcttcgccttcccgaccgtggacggaggaaaaggcgaggaaggtgctttgatgggcgctgtgaccggtttcgctgtcaatcccgaggctccggacgctgctgttgatttcgtcaatttcatggctgagaaatcaaatcaggagaaatacgccactgcgttcagcaccattccggcttccgccgaagcttacgatgcggttaccgatgaaaatcttaaggctatcctcgaagctatgaaaaagtctgatggcatgcagctgtggatggataccgctctcggcggaaatattggcaacgctcttaattccggagtggtgaatctgctttccggacaggggacttcggctgacatcgtcaaggcgatgaaggacgcagcgtccaagggctgatagtgaacatggctggttgacggccaaaggagggtggatagacagatcttcatctgccctccttcctattcgagaaacgtatctggtagtggagaaaaccatgtcaagtacaagcaaagacgcggtgacgctgcgcgctaagcggtccaagaaaccgtccgatggcaaaatgcgtcgtaatgttgagattttcgtactgtccgcacctgcgattcttctgttcgtctgctttgtgattctgcctatcgtcttgggtgcttattacggcttctatcagtggaagggctacggacttccctccaagacaggtaaattcgttggtctccagaactacatcacagcgcttaaggatcccgcgttccaggcggcgattctgcataccttcgaggtcgtgatcggctcgttggtcatccaggctccgctcgccatcctgttcgcattgctgctgaaccagaagttcaaggggcgtggtctcatccgcaccctcatcttcgtgccgtatgtcgtttccgaggtcatcgtcggcacaggatggagcctgttgctacagaagaagggcgccatcaatgagattctggccaacttcggcatcaatggtcccgattggctggccgacccgaaaatcgctatttggacgctgctgttgctgatcagctggaaatacgtcggtttcgccgtaattctgatgctcgccggcatgcaatccattcccgatgaactgtatgaagcagccaaagtggatggggcgagtttttggcagatgcagaaaagcatcacgttgccgttgcttgctccgacgttgcggatctgggtgttcctttccatgattggctctctgcagcttttcgatctggtctatatcgtgtggggcaagtatgtgtcgaccaccgctggtgtgtccaccatggccacctacatggtgcgtgaaggtcgtggagccggcaactatggctatggttccgccgttgctctgatcatcttcgtgatctctttgatcatcgcactcgtctatcagaagttcgtgctgaaccgtgacttggacggtgctgttactgagcagaaagaagccgagaagcgtgccaggaagcgcgcaaaggaagtgcagcatcgtgaggttgctgccctggcaagtgaggtgaagtgatgactgccgcaacaatcgcaggacattccaacaaaagcgagtacagcaagaagaatggttaccgtaagtcatccaagacgccatggggcaacccaatcgtctacttcttctccctggtgcttgtggccatctgtatcactccggtgttgtacattatcttcggcggtttccgtaccaattcgcagatcaccaaccatccgtccgggatgccgaacccatggatccccgacaactacaagacggtcgtcgaaagtgatattttctggacggaactgaagaattctaccatcgtgggtatcgccaccatggtaggcgtcgtggtgcttagcatcatggtgagctttgtcatcgcccgatacaaattccgctatgcgccgcttatgtacgcgttgttctctgctggtctcatgttcccgatgaccgttggcattacacctttgtatctgctgattcgcaatctgggtctggccaactccctgtggggtctgatccttccgcaaattgccttcggacttcctcagaccatcatcatcttggtgccgttcctacagtcgattcctaatgagcttgaggaggcctgtcttctcgatggatgctcccgccttggcttcttctggcgcatggtcattccgctgtccatgcctggcgtggccaccactggaatccttaccttcgtgggaagctggaatgcctacatgctgccgctgttcgtgctcagtgatgccagcaagtacacattgccacttggcgtacagatgttcagctccgaacactccgttgacaccgcacaggtgttggccttcacctctctggctatgattccggccctgatctgtttcaccatcttccagaagaagatcgtcggcggcctgacaggtgcggtcaagggctgacggaatgtgacaacccacgcccggaagatgttcctttccgtcttccgggcttcatctcttatgcaagaggtacattatgaagatttccaacccggtgctcaccggttttcatgccgatccttcaatgattcgcgtcggtgacacttattacattgccaattccacgttcgaatggttcccaggcgttcgcctgcatgagtccaaggacctggtgcattggaacattcttccaagcccgttgagccggtccagccagcttgatatgagaggaaacccctcttcgggaggcatctgggctcctgacctaagctatgcggatggcagattctggttgatctacactgatgtcaaggtggtcaatggtgcattcaaggattgcactaattatttggtcaccgccgaggacatccatgggccatggagcgagccgattcgcatcaacggggtcggttttgacgccagcctgttccatgacgacgacggccgcaaatacttggtgcagcagacatgggatttccgtgaataccaccaccagttcgacggtatcacattgacggaattcgacgtcgacaccatgaagctcaagccagaaacggcccgcaccatctgggatggcactgcggtgaagatcaccgaaggtccccacctatacaagaaggatggttggtactacctgtttgccgcagaaggcggcacggtgtatgaacatcaggaatctgtggcgcgttcccatacccttgacgagtactccttcgaagttatgccgaatggcccgttcatcggtaacttcgacactcctgacacctatttgcagaagcagggccacggagcgttggtggacaccccgtccggcgagtggtattacgcctccctatgcggtcgtccgtggcgtcatgataccgaaccggctcatggcacccgcggatggtgcacactcggacgcgagacctccatccagaaagtcgaatgggatgaggacggttggccgcgcgtggccggaggtcacggcggacagcgttacgttgatgctccgaaagatgccatcgagactttggccccaacgacgcgtgacgaacatgatgagttcgattccggcgagctcggtccgaattggaacacgctacgcgtcccgttcaccgacgccatgggcacggtgggcggtggcaaactggcattgcgtggtcagggctcgctgtgcaacctgtttgacttgtctcttgtggctcgtcgctggcaggcatttgatttcgacgccgaaaccaaggtgcgtttcgatccgaagaattacatgcagatggcaggcctgaccaactattacgatgacctatgctggtcatgggcgtttatcacttgggatgagaaacgtcacgcaagggtcatcgaagtggctcagaacgatttcaaccaatatacgtcgttcctcaaggataacgccatcgtagtgcccgaagaggctgaggcggtatggctgcgcaccaaggtccgcacggaatactattcctacgaatattcctttgacggagaacatttcaccgagattccagtcaggctcgatgcgaagatcctgtccgacgattacgtgaaccaacgttacggcggcttcttcaccggcgcgttcgtgggacttgcctgcgtcgatctgtccggctacgacgcgcaggccgaattcgactacttcgactatcgggagctttccgataaccagtagacagtgccggctggcgacagagcgtccgccgtcagccggcatactcgacgggattgaattctatgggcaatgaggagcggacgagcatggttttgcaattgccgaaactgcttgacgacggttgcgtgctgcaggccggtgcgaccatacatatctggggcgccggcgaccctggacgcggcgtgctggtacgcctcgatggcaaggaccggactacgcgggtgggggacgacggctcatggagtgtgccgtacggtccgatcaaagcaggcggaccgtacgatttgacggtgcgttatgaggacggaaccgaatgcatctcgcgccaatgctatgcgggagaagtgttcctgtgttcgggacagtcgaacatggaactgcccatggcttgggtgcgtgcggactatccgctggagtggaatcgtgagcctgacccattgctgcggcaatacaaagcgattcccgattgtgacttcaacggtccccgcagcgatcatgaccatgcgttctggcaggggtgcgatgcggaaacccttggagatttctccgcgctcgcctatttcttcggacgcaggatccgtcagtggctgaatgtgcccgtcggcctgttgaacgtttcattgggtggatcgccgattgaatcctggatggatgccgacgcattgcgggcgttccccgaagcgctcgctgaccttgagccgtatcttggcgatggcgtggcgtcgaagaaaagccgcgattccgttgccgaacgggaccggtggtaccaagcgcttggatacgaggctgtggccgatgcccaccatgaatggctgccattgatcgcgtggaactgtccggaatccaagaacatcgagccgcgcgacgtggcatggcatgacatacgcctgccgggatggtacaaggatcgcggacttgccggtttccgcggcgagattaccatgagaaaaaccgtgttcctgcctccgtcggatgcgggcaagcccgctctattgcgtctgggcaccatgaatgacgccgaccatacgtgggtcaatggtgtgttggtcggtgggcgtagcaatgtgtatgagccgcgggactatccggtcgggtccggtgtgctgcgcgccggcgcgaacgaaatccgcatgcgtctggtcgttgaacggcccggcggtcgtgtgacgcccggcaaacggatgacactgaccatcggagacgatgtcttcgacctgtccggcatttggcagtatgccgtgaccgccgaagctgaccgcgattgcccattcgaggatttcgtcagatggaagccgaccggcctgtacaatgccatgctcgccccgtgttttccatatgcggtgcgggccgtgctgtggtatcagggcgaatcgaataccggcgatcgcgccatgcgatatggtgacgagctgaaggccatgattcaattgtggcgcgtcaaatggcatcagccggatatgccgtttctgatcgtccagcttccaaaattcgacatcgacgccattgaggatggaggctggccactcatccgcgaacaggagtggaacgtcgcgaacgaacttgaaaacgttgcgacggtggtgacgcttgacgccggcgagagcaacgatctgcatccgtatgacaagaagctcgtcgcggatcgcgtgttcaatgccgcgatggatttggtatacggtcgccaggctcagcctcaaccggccgtggaaaccatcgaggtctgcggagatctgttgcggatgcactgtgtgtggcggagtcgctcggacgagcggatccgatcggagggccgccggctgatgacgttggacggtgacgctccccaggaaatcgaatttctatggcgcgactgcgccacatccgcgcgggccgaggcatggctagacggctgtgatatcgtggcgcgcatgacggcgcgcaggccagatgaggtgcggtacgcgtggagcaacaatccggaatccggactcatatgcgacggcgacggcatgctgattccgccgttccgcctgacattgcccacggacgatgataaggggattcatgcgtagacaggtcgcgcttcgacaaggactcgtcgatggattctccgatacggactctgtaattaccgtgtttcgtggcatcccctatgccaagccttcccgttggcgcattacgatttgtctcgtgtcatgattcggtattggacgaatttcgcggcgacgggcgatccgaacggttccggattgcccgaatgtccggcgtgcggacccaatggccaacgatacatgctgctcggcggatgccacgatacatcggatagtatgtcgtatgccaggtcaagtagatgaatatagtatagtgtgagcgttcactatagcgtggtggaaatcgtgacgaaggagacgggcatgacgaaggagacggagacgcagatcgcgtccgacgaggatctgactaggctgttcgccggcaagccgacgcaataccgcaaatcgaagtcgctgccgaagtttactggcgaggccatgcgtacctgcgccacgatcaaccgcatcttcttcgatgatcctgacgaggcctaccgcctgttccacgagctcgttcccgacgcgggggaaggcgtacaattcacgccgccgttcaatgtggattatggcatcggcctgaccattggccgcggcacgttcttgaacaaggatttcatggtgtgcggcggcggatatgtaacgcttggcgaggattgcctgatcggcccgcgttgtaccattgccacgccgaatcatgccttggatgcggcaacgcgactggctggctgggaacatgcttcgccggtgacgattggtgacaacgtgtggtttggtgcgaacgttacggtcacgcctggcgtcacgattggctcgaattccattatcggcgcgggttctgtggttacacgagacattcccgccaattcgatcgcagtcggcaatccggcgcatgtaatccgcgagattcccgaacgcgatcccgccttcgccgatgttgagggtatcgtctgacgttgggttacggtgttccctcagagcgaattcgcgtgttgccctactgctagacgtgttgttgcacgatttcagttttgacctcacgatttgatcggaatatcgcacgattttgtttgagacgaaaatgggtgccgttgcggttggttgtgacggcacccattttgcgttgttttagtgcgatttatgctgattgatcagccgcgggcctttgcgtaggcttcgtatacggcttcagtcggttcgccggtttccacgccgtcgatggtgagctgccatgcgggcggttccgtttcgccggacagcacccaggcggcctgacgggcggcgccgatggcaacatactcgtcggtggtcgggcgggtcacgtccatgccgaacacgctcggcgcgagcgtgcggattgccttggacttcgcgccgccgccgataagcagaatgcgggaaatctcagcgccaagcgaacggataagctctaggcagtcgcgctgggagcacagcaagccctcgacgaacgcgcgggccatattctcgcgtgtggtgttggccagcgtcatgccggaaagggttgcggtcgcgtccggacggttcggcgtgcgttcgccgtcgaaatacggcaccagcgtaataccgccggcgcccggttcggaagcgaatgccagggatgcgagttcgtcgtagtcgacgccgagggctgcacggccggcgtcaagaatgcgcgatccgttgatggtgcaggccagtggcaggtagtggccggtgcagtcggcgaagccggaaacggcaccggtcaaatcgtaggtcggattttcggaaatggctgctgccacgccggaagtgcccaatgaaacggaaacgtcacccacgctcatgccaagtccgagggacgccatggcgttgtcgccgccgcccggtgcgatgatgcaaccaccctcaacgttcttgccggcgatttccgggcttgccttgactgcggcggcatcgtgcggtccaagcacggtcggcagcatgattgcgttggcgtgctcgcgtgccgcttcggtaccttccgctggctcaagcaccatggcgatcagatcgcggcggtattcgttggaagcggcatcgtaatagatggtgccggaagcgtcggaacggtcggtgaacagcgcttccaagtgtgcgtcctcgccttctgcgactggaccgtagcctgcgatacgccagctcagccaatcgtgcggcaggcagatcgcggcgatcttcttagcgttttccggttcgttttcagccacccacgccaccttggttagcgtgaaggaagcaacgggggaggagccaacggccttgacccaacgctgcttaccacgcgcgatcacatcttccggttcgccctcttcggcgggagcctcgcccatcttctcgatgagggccgcggcctgcggcgccgagcttacgtcgttccacagcatggcgtcgcgaatcacgttgccttgctggtcgagaatcaccatgccgtgctgctgaccgccgacggcaagtgcctcaacgtcgtcaagtccaccagcctgctgggatgcctcaaggaacgcgtcccaccagtatttcgggtcgatagacgtgccattggggtgtttggcctggccaaagcgcaccatttcaccggtttcggcgtcggtcacgcgcactttgcaggactgggtcgaggtgtcgacgccggccacgagagttcgagtcattgtgtctccttgcagtgagctggcgcaacgaagtgcaaggaattcgcacggtccgccacctcatttagttagatgaatgaactataatgtctagtgtaccatcataaagtgatttgactatagagacggtgcgcttttcggcaaagacgcgtcaaagaggagggaaccatggcttcactgcggagtatcaatcaagacgatttgcgaaaccataatctttccgtggtgctcgactcgctgttgcgtgccaccgaaccaatgagtcgcgccgatcttgccaagaaaaccggattgaccaaagcggccatgtcggtattggtgtcgttgatgctcgacaatgagattctggtggaaggcgcgccttccggccaatcgctgtatgggcgccccagcattccgcttgaaatcaaaggtggatgcctgtgcggcatgggattgcaggccaacaccgacggttatggcgtggtggtgctcgatcttgacggttccgttgtgggggagcagtgggtcgacgccgacatggccaacgccgacgagcgggcgattttcgcccgtctcgacgaactggctttgcagcaggaagaagcgcttgccaagaaaggttatgtgcttgccggtaccggtttggcattgccgggtctcgtcaccgatgatatgcgattgcttggcgcgcgcaatctcggttgggaacgtttggatctcaagcagttcgatgtggtcaagcgacttgatcctgttgcctgcaacgaggccaatgccgccgcgttggcacaggttcccggctatgccacgcagcgtaaggattctgggcggatcaagccgacggattcgtttctttacatgtcgaccgacgtgggtatcggcggtgcagtgatccgcgaagggcgtgtggtgagcggtgatcacggtttcggtggcgaattgggccatgtttccgtcgacatgcgcggtcccgtctgccgttgcggccgtcgcggctgccttgaagtgtatgcgggcaggcgttccatggtgagcgcggccggaatcgccagcagcgatgccgccgcgacccgcagcgccatcgacgaattgatcgaccgctggcaccagcgcgatgcgcagaccgtggccgttgtggaaaaagcattggaggccatggcttccgtaatcgcatcgaccatcaatgtctgtgacgtcgacgtggtgatgctcggtggcttgtgggcgcgtttcgaacctgaactgattcgcagaatcgaacgcatggtacgcccgcaagtgctggcgtatccggaagtcgaggcaagcgtgcttgtggcggatatcgtcgatcgtccggccttgatgggcgctgcggaaatcggtttgcgacgctttatcgacaatccgctgcgtttcatgaagcaaaactagtccacccatttgctaaacttgccaagttggcatgttcgcatgttgcaacgtggggcgttagctcagtcggttagagcatcggactcataatccgccggtccacggttcaagcccgtgacgccccactctttcacaaagtcaaggcttctgatatactctgcaaggttatccggttcacgctctgccataggggctcagcgacccgggtcccccgaatctctaggagacaaactatgaagcagggtatccatcctgattaccacgcagtgcaggtcacctgctcttgcggcaacaccttcgtcacccgttccacctacagcggcgatcacatgaccgtcgacgtgtgctccagctgccacccgttctacaccggcaagcagaagatcctcgacaccggtggtcgcgtggcacgcttcgagaagcgttacggcaagaaggccaagtgagtcttattgcttaggcaatgaaaaacgccagtccgattatgggctggcgtttttcattatgcgacggatgcgcatgcgctggcgtgcatgcgatcgggatattcgtaagatgcgtgggatgcctgcgaaataccgcgcttcggcagcgtttccaaggcaccttatatgatggacaggttgagtggagttcagcgaagcgttcacgctgaagcgcagatttataagcagatagaaaaggcgtacattggcagacgagcagttccccgcggcagttaccgcacttgaggaatatcataatatcgaacagcagatggccgagccggaagtcgcgtcggatccggataagatgcgtaagctgggacgtcgtcacgccgagttgggcgtcatcgtttccgcatacaccgcatacaagcaggtgaaagacgatctggaggcagccaaggaaatggcttccgaagatccggatttcgcggaagaagcgaaacgtttggagagcgagcttccggcagttgaggagaaactgcgcaccgcgttgattccgcgcgatcccgatgatgcgcgcgatacgatcatggaaatcaaggcgggcaccggcggcgaggaagccgcgttgttcgccggcgatctgctacgcatgtacatgcgatatgcggaaaagcgcggttggaccgtcaccctgcaaagcgaaaacaccaccgaactgggcggcgtcaaagacgtgcagctcgccatccgcgccaagggcactcccgctccggaagacggcgtatgggcatccctcaaatacgagggtggcgtgcatcgcgtgcagcgtatccccgtcaccgaatcgcagggtcgtattcagacgtccgcagcgggcgtcattgtattcccggaagccgatgaagatgacgatgagatcgaaatcgatcagaaagatctgaaaatcgacatcttcatgagctctggcccgggcggccagtccgtgaacaccacatattccgcagttcgtatgacccacattccgactggcatcgtggtgagcatgcaggatgagaagagccagatccagaatcgtgcggccgcactgcgcgtgttgaagagccgcctgctcgccatgaagcacgaggaggaagccgcacaggccgcagacatgcgtcactcccaggtgcgttcgctggatcgttccgaacgaatccgcacctacaatttcccggagaaccgtatcgtcgatcatcgcacgaactacaaggcgtacaaccttgacgccgtgcttgacggcgatctgcaggctgtgatcgacagcgacattcaggctgacgaagccgatcgcttggcccatcagaagtaaaggcggccgatggctaccgtattcgaactcgtgcgatccgcttcggccatgttgcgtgcgtccggtgttgacactccggagcacgatgccaaattattggccgccgaagtattcggcgtcgacctgcagaccgtcgacaaggccatgctgatgggaagcgaaacatccgaactggcgaagcaaggcgcgaagcagagcggtgaagacgctgcgttgaagcgattccacaccatggtggatcgcaggtccaagcgtgaaccgctgcaacatatcaccggccacgcgcccttccgctacctcgatctgaaggttggtccgggcgtgttcattccgcgtcaggaaaccgaactcgtggtgcaggaaggtgtcgactggatcaccaagcacggcatgtattcggcgaaagtggtcgatctgtgcgcgggaagcggcgcaatcggcctgtcattcgtgacggaagtgcccggcagcgaggtgtgggcggtcgaaaaaagcgagcaaaccgcgcaatggacccgcgtcaatctcaacgaaaccgcaaaaaagtaccccagcatcgccagcaactatcatctggaaatcgctgatgccacgcaaacgccgacgctgaaccagctggacggcacgatcgatatcgtgctcaccaatcctccgtatgtgcctcttgcggatattccgcagcaaccggaagtacgcgactacgatcccgatcttgcgctatacggcggttccgcagatggcacgcttattccggaacgcattatcgcccgtgccgcaaaactgctgaaaaacggcggtttgctggtaatggaacacgatattacgcaaggtgaacgattgtctgcattcgcgctgtcatatggattcagcaatgtgatggtgcataacgattacacaggtcgcccgcgatacatgaccgcgaaaaagcagtgatgcaacgcgtctcagaataagagatttttccaggggaacgtggtttttctgttgcaatagagttccagttggaagtccgaccattgcattagaccagttcagcggtaagcataccggttgcggaagcatccacaagatgaggcgtccggctgcgctgacaggaagagaaggaacggcagtgaaaatcaagaatgccgaaaaactggccgcactctgtcttgcggcggttatgggagtgagtgttacagcctgttcgggcggcaacatgtacgccaccagtaatgagagcgccaccatcgcggataacgatgtgatcaccatcggctcggtcaccaccaattccggtgcagccgcagcctatggcgaagccgaagtgaacgggttcaaactggcggtcaaggaaatcaacgccgatgggggaatcttcggcaaacagatcaaactggaatccatggacgacaagggtgatgtgatcgaggcatccaacgcctttaaccgtctggccggcgacaagaacgtgatcgccgtgctcggaccgaccatttcgtcaacctccggtgccgtcgcgccgctcgccgaccagaaccagatgccgaccatcgctccggccgcaaccgccgattccgtggaaacgggcggatacctgttccgcacctgcttcaaggactcctaccagggcgagatcgccgccaagtatgcggccgaaacattgaaggtcaagaaagtggccgtgctgtatggcacgggcgatccgtattcgtctggtgtgggcaaggcttttgttgcggcggcgaagaagaacggacttgacgtggtggcggaagagaattcctctagcgccgacgataccgaatactcgtcgcagctgcagaaaatcgaagcttctggtgcggaattcctatatgcgccgtactactattccacggttggcccgtacattgtgccacaggcgcgagcggtcggctatgagggctacatcatgggccccgacggctacgacggcctcaaaaccacgggaaacaaagcgaactacaacaaggtgctctacaccacgcattattcgccggatgacaagtccaacacgaaggtgcagcagttcatcacctcatacaagaaggccaataacggcgaatcgccgaacaccttcaccgcgctcggttacgattccgtctacatgttcaagcgggccatcgaacaagccggtgaaaacgccactcgtgccgatattcgcaacgccatcgcaggtatgagcttctccggcgtgaccggcgcattcacgctcgacaagcatggttctccgaagaaatcggtgattgtgctggaaatgagcgacggcgaaccgacatacaaagacaccatccagccggcggaatagcgaaaaaacgcgaggaatcaagaaaaacaagacttcaactgacgaaacaacaagaaaggagggatgatgagcgattcggtcattatgttcatcggtcagatcttcaacggtctgaaaatcggcagcgtgtattcgcttgtggccctcggctacaccatggtgtacggcatcatccgactgatcaatttcgcgcacggcgacttcatcatggtcggctcctacgcgctgatgcttaccattccgttcattatcgcctgcggtctgcccgcatggttcgccgtgattccggcggtgcttgtgtgcgtggcggtgggtattatcgtggaaagggccgcgtacaagccggtgcgtgaaaaaggcaataatatgacggcgctgatcactgcgatcgccatgagcctgctgcttgaaaacggctcccaggcgctgttcggcgctgattatcagaccgtgccaaccatcgttgaaattccaacgctggtgcttggcaaactcaaaatcgacggagcgaccatcataacggtgctgcttggcatcgccatcatggtcgcgttgcagctgttcgtctccctcaccaagcagggcaaggccatgcgtgcggtgtccgaagacaaggaagcgtcgattctgatgggcatcaacgtgaactccaccatcacgttgaccttcgccatcggctccggcctggctgcggtggcggcgcttatgtactgcatttcctacccgcaggtctctccgatgatgggtgccatgctgggcttgaaagcgttcgtcgccgcggtgcttggcggcatcggttccattccgggcgctatggtcggtggcttgctgatcggcgtggccgagagtcttaccaaggcgtatatcggtacgattacggccggtgtgatcacgtcggcgttctccgacgccattgtgttcggcattctcatcatcgtgctgctggtcaagccgtccggtctgatgggcgagccggaaagcgagaaggtgtgattatgaagaaatcaatgctttccacgaagcaatcgtatgcattgtgtgccattggcgtgcttgtgctgttcggcattcttgttgcggtatgtgaaacgggcgctatttccctgtatgtcaagggtattctcatgacttgctgcattgcggtgatcatgaccacgtcgttgaatctgacgatcggtgtgctcggacagcttacgctcggctgctgcggtttcgaggcgatcggcgcatattccgccgcgttgatgagcaagttgctggttgccaacggcgttcagatggatgatacggtgcgtttcctgctggtcacgttcgtcggcggtgtggtggcatgtgtgttcggtgtgcttgtcggcattccggcattgcgtttgcacggcgattatcttgcgattatcacgcttggtttcggtgagatcattcgtgtgatcatccagaatctgaaagtggccggcggcaagggacttgcggacggccagcaggggcaggcactgatcggcatcgaccgtctcgccaatctgtatgtggtgttctgtatcaccgtcgtgaccgtggtgctgttgttcatgttcgcgcgttcccgttatggtcgtgcggtcaaggcgattcgtgatgatgagatcgcggctggcgcttccggcatcaacatcacctatatgaaagtgctcgtttttgcgatttccgcgttcttcgcgggtattgcgggtggtattttcgcgcaatatatcggtgcgctcacgccaagcatggccggttggctgcagtcgatcaattacgtgatcatggtggtgttcggcggtatgggttcgctgacgggttccattgtcgccgcggttggtctgacgattttgccggaattgctgcgtgcgttctccgcataccgcatgctcgtgtattcggtggtgctggtgatcatcatggtgttccgtccgcagggattgttcggcaattgggagttctcgctgccgaaattcgtcaacaagtggttctatccggtacgcgtgaagatgcacggcaaatcgggtgcgtctcaatcggcatctaagaaaaccaaggaaaccggcgagactaccgcatctagcgaaatcaacacatccagcgaagacaaggaggtgcaggcatgagcgagccgattctgaaggccgagcatctcggcatcaccttcggaggcctcaaagccgtatccgacttcaacatgaccatcaatgcgggcgaacttgtcggtttgatcgggccgaacggcgcaggcaagaccactgtgttcaacctgctgaccggcgtttaccagcccacggaaggtgagttcttcctcgacggcaaacgcatgaacggcaagaaaacgtatcaggtcgtgcgtgcgggaatcgcaagaaccttccaaaacattcgactgttcgatcaaatgacggtcgaagagaacgtgcttgtggcgttcaacgaatccttcacctaccggctgggcggtgcgatcttccgcacgccgaccttctggaagcaggaacgcgacatgcatgccaaagccatagacctgctgcgtattttcggactggaaggattggccgaaaccgaagccgcgaatctgccgtatggagcgcaacgtaagctggaaatcgcacgagcgttggcgaccggcatgaaactgctgttgcttgacgagcctgcggcaggcatgaatcctacggaaaccgaggatctgctgaactgcatcaacacgatccgcgaccgtttcggcatcgccattctgctgatcgaacatgatatgagcctggtgatgaacgtgtgccagcgtattcaagtgcttgattacgggcgtaccatcgcctccggaacgccagaggaaatcgccaacaatccgcaggtcatctccgcatatcttggtgcggacgatgctgaaaacaatgccgtcgaaacgtctgaaacgaccgaaaggaaagacgcctgatgctgcagatcaagaatctttccgtctcctacggtgccatcgaggcggtcaaaaacatcagtctgacggtgaacgacggcgagatcgtgtcgctgatcggtgcgaacggtgctggcaaaaccacgacattgcataccatcacaggtcttactccggcggtttccggcgaggtgctgttcaacggcgtggacctgctgaaaacgccgaacaataagatcgtgaccctcggcatggcgcatattcccgaaggacgccacgtgttcacgcgcatgagcgtgcaggaaaaccttgaaatgggcgcgttcagtctcaaagaccggtctcacatggcggacgatcttgccatggtgttcgacatgttcccacgcctgaaggaacgccgcaaccagaaggcgggcacgctttccggcggcgaacagcagatgctggcgatgggccgcgccctgatgagccacccgaacacgattcttatggacgagccgtcgatgggtctgtctccgaaactcgtcaaagagatcttcgccattattcgcaagctgcatgatcagggcattaccgtactgctggtcgaacagaacgcgaatatggccctgtcgatcgccgatcgtgcgtatgtgctcgaaaccgggcgcatcaccatggaaggcgacgccaaggagctgatggacaacgagcaggtgcgcaaggcgtatctgggcgcataaggtcagtttcaacgcagttgaagaatcctgccttacaatggtggggtcagcaagccgaaaagggaggtgtcatgagcgagattcgcactatttcagacgaatcccttgcccaggctgtcgaaatcgtacgtgacggcggattgattgtgattcctacggacacggtctacggcgttgcgtgcgatccgcgcaacattgaggcgatccgcaaggtgttcgcggcgaagcaacgcccgaaatacaagtcgttgcaagtgctattgccgtctattgaaagcatggagaagctgcatttggatctgccggtgccgctgaaccgcctgtccgccatgttcatgccgggcgcgttctctccgatcgccgtggccgatgacgattgcacgctcgccacggtacgtaccgatcccgccaccggcaaggtcacgcagggcgtgcgcattccgaattccacggccgccttgcgtgtgctgcgcgctaccggaccgttggccgccaccagtgccaaccgttccggcgatgaaagcgcgcaaaccgttgacgaggccgtgcaggcgcttggcgatgcggttgatttgtatttggacgggggagcgactcccggtcatgtggcttccacggttgtggcggctgaccctcatgggcgtgatggcattgcgattcttcgagagggagtgattcacgagccggttatccgaaaggccttgacgttgaatggcggtgctttgggcgtatgagaatctatctgttcattgctgcgattgctggcggcgtcacctatttgatcacgccgttgattcgccatatcgccattgagatcggcgccgtcggcgaagtgcgtgcgcgagacgtgcataccattccgacaccgcgactgggtggtttgggcatgctgatcggtttcaccgtgtcgatgctgttcgcatcccgcattccgttcattcaaggattgttcgcgcaatcgcaacaggcgtgggtgattctcgccggcgccattatgatcagtctgcttggcatggccgacgacttgtgggatcttgattggatgctcaagcttgccggtcagctgttgatttccgtgttcgtggcatggggcggtctgcagatcatttcgcttccgcttggctcgttggtgacggcgtcgccgagcctgtcgatggccatcaccgcgtttttgatcgtcgcgtccatcaatgcggtcaatttcgtggatgggttggacggtctgtcgtcgggcattgtggcgatcggcggcatcgcattcgccatttattcatacatcatcgcccgcaactcgccttcgtacgcttcgatggcgacattgatcgacattgccatggtcggcatgtgcgtgggctttttgatgcacaactggcatccggcgaagctgttcatgggagactccggttccatgctgctcggctatttgatcacgtgcgcgtcgattgtgatgacgggccgccttgacccggccagtattcatgccagcatttacttgccggtgttcatgccgattctgctgccgattctggtattgttcctgccgattctcgacatgtgtcttgcgattgtgcgccgcttgcgcaagggacagtctccgatgcatccggaccgcatgcacttgcatcatcgcatgctgcgcatcggccattccgtgcagggggctgtgctgattctgtggggttgggcggcactgatcgcattcggctcgattatgacgctgtttttcaaggcccaatacgtgcttgttggattcctgattgcggccgtggtgctgaccgtcgccaccatgtatccgtatgtgaagcataggattcccgagatgctggaggaggacgctgcggatggcggcagacatgcgtcggtgcggtcgtcgaagcgtcggaaaaactgattaaacgctttgccttgcggtattagttaactttcataacacccttgtttgccgcttgttctgccgtgtcgcggtaagtcagcccgcgttcatatagtgggtctatggctacaattcctgatatgaatgcagattccacgtacgctccacttcctccgattttcgcacagcttggcctcgcctatgacgatgtgctgctgctgccgaacgagacggatgtcattccgtccgaagtggacaccaccacccatctgacccgcaacatcacgatgaaggtcccggcgatctccgccgcaatggacaccgtcaccgagtccgacatggccattgccatggctcgtaatggcggcatcggcgtgctgcaccgcaatctttccatcgacgaccaagccgctcaggttgacatcgtcaagcgctccgaatccggtatgatcaacgatccgttgaccgtcagcccggatgtgacgctggctgatctcgacaagctgtgcggccgtttccatatctccggcctgccggtcgttgacaacgacaacaagctcgtcggcatcatcaccaaccgcgacatgcgtttcatcgcctccgaggattacgaccggctcaaggtttccgaggtcatgacccgcgagaacctcatcaccggcccgtccaacatctccaaggaagacgcccacgacctgctggccaagcacaaggtcgagaagctgccgctggttgacgatgaaggccacctcaccggcttgatcaccgtgaaggacttcgtgaagaccgagcagtatccggacgccaccaaggacgaacagggtcgtctgcgcgttgccgccggcatcggcttcctgggtgacgcctacaaccgtgcttccgctctgatggaagccggcgtggacgtgctcgtggtcgacaccgccaacggtgaggccaagctggctctcgacatgattcgccgtctgaagtccgattccgcgttcaagggcgttgacatcatcggcggtaacgtggctacccgtcagggcgctcaggccatgatcgacgccggtgttgacgcagtcaaggtcggcgtgggcccaggctccatctgcaccacccgcgtggtggccggtgtcggtgtgccgcagctcaccgcagtgtacgaggccgctcaggcctgccgtgccgctggcgtgccgtgcatcgccgacggtggcattcactactccggcgacatcgccaaggctctggttgccggtgcctccaccgtcatgctcggcggcaccctcgcaggctgcgaggaagctccgggtgagaaggtgctgctgcacggcaagcagtacaagctgtaccgtggcatgggctccctcggcgccatggctccgcgcggcaagaagtcctactccaaggatcgctacttccaggccgacgtcacctctaacgacaaggtcgttccggaaggcgttgaaggcgaagtgccgtaccgcggaccgctgaacgcagtgctgtaccagatgatcggtggcctgcaccagtccatgttctacatcggcgctcacaacatcgccgaaatgccggaacgtggccgtttcatccgtatcaccgacgctggcttgcgcgaatcccatccgcacgacatcgtcatgaccgccgaagctccgaactactccggccgccagtgattgctgaattccagtaatcaaaatcggtaaaagcctcttacttctcggaaaagaccgaaagtaagaggctttactcatatctgcaacgtgaatatttataaccgaacgtcgccctatcgccaagtagcggtgtttgatgtacgaagcaaatcgctaaaacaagtgtgacttcccggtgcgtaggccttccaatctccctacctcgcggtatcttcgaatgttcagctgaagcgtgccaagcggtacgcgcacacgcaaaggaaacgaggcaagatggttgacgcacatgacggtgaaacatacacggcgaaggattcacgcctgatctggatcgattgcgaaatgaccggcttggatattttccacgatgaactgtgcgagatctccgtggtaccgacggattttgacctcaacgtgcttgacgagggtattgatttcgtgatcaagccgtctaatgcggccgttgccaatatgaacgatttcgtgcgtgccatgcacacccgttccggactcatcaacgaatgggagaacggcctgagcgtcgaagaggctgaacggaaagtcaccgaatacgtggcccgcttcaccccggacggcgtcaagccgctgctcgcaggcaactccatcggatcagacaaaaaattcctcgaccgttatatgccgaatctcatggaacacctgcactaccgtgtaatcgacgtgagcacgttcaaagagcttgcccgccgctggtatcctgccgtatacaacaaccggccgccgaagaatggtggacatcgcgcgctcgccgacatcatcgaatccttggacgaactgcgctactaccgtaaggcgttcatggcagcggcgcccggtcctgacgcaaccgaagccaaggcgatcgccgatcagatcgtggcaaccagcattttgaacaacaactgattccgcatatcgcacaatcgttggaaaatctgatattccaacgaaaacatggaaaggactccagtgagcgcagccgattggaccagcatcgaaatcccgcaagacattcgcttggtggttgccgatatggacggcaccctgcttgatgagcatagcgagattccgcaaggtttctggccgatgcttgcccggttgcgctcacgaggcgttgaattcgtgccggcatccggacgccagtacgctaccttgcgtgccatgttcgccgataaggcggcgcaggtgcttgacggcggcgaactttcgtatatcgcggaaaacggcaatgtcgtggccattgacggtaatatcgccgaagtgcacggcgtcgataccgatgtgacccgctggaccatcgacacggtgaacgcttctgccgcggctggcgaatacgatatgggattggtgctttgtggcctgcgcacggcatacgtgcagcgcacggacaagccgttccttgatgaagtcggcaaatattatgcggcactggagattgtggacgatctgcatagcgtgcttgaagatgtgatcgcatcaaacggcgaaagcgacaccatactcaaactggcgattctcgatttcgacgatgccgaagcgatggccgcggaaaagctgacgccactgaagaacgattatcaggtggtggtttccggcaaactgtgggtcgacatcatgaatgctacaaccaataagaaacagggcgtcgaagcgttgcagcgcgtgcttggcgtcactgcggcccaaacggcggtatttggcgattatctcaacgatttgcagatgctttcggcagggcagtggtcgttcgccatgggcaatgcgcaccccgcgttgaaacaagccgcgcattttgtggctccatccaatgccgatcacggggtgcttcaggttgtcgacaaactgattgcgtaaggaagccgtttcttcgaaattgatggtcgattgaacaggaaaggcggtgcggcatgcggcaggctgaggcattggcgattctgcaaagtggcgcgagcgtcttcctgacgggtgcgccgggtgctggcaagacctacgtgctcaatgagttcgtgcgtcaggcccgtgccgaaggtgcggcggtgtcggtgacggcgtccaccggtatcgcggccacgcatatcaacgggcagaccattcattcatggagcggtgtcggacttgccaacgcgctcaccgacaatctgatcaaaaccatacgtacccgacgcaaacgtaagctgcagggcgctgacattctcgtcatcgacgaggtttccatgttgcatgcgtggctgttcgacatggtcgatcaggtgtgccgcatcattcgacgtgaccaacgcccgttcggagggcttcaagtggtgctgtccggcgatttcttccagcttccgccagtgagtgtgagtgggcgcaaccacgatttggtcacaccaagcccggaattcgtggcttcccgcgaacagtatgcgaaagcgggactcaatccagatggtttcgtcaccgaatcattggtatggcgggaattgaatcccgcaatctgttacctgaccgaacagcatcgtcaggatgacggcagtctgctcaccgtattgaccgatattcgcaacggttgcgtgaacgacgacgatcgcaatgtgctcctcaccagactgggcacaatccccgaacctggtcaacaggccgtcaatctgtttcccgtcaacaagcaggcggacacgctcaacgacatgcgcctgttcgaaatcaacgaggagccgcacgaatatttcgccgaagccgcaggaccagtcaatctggtggaacgtttgaagaagaacatgcttgcccccgaacgtttgcagctcaaaaccggggctgcggtgatggccgtacgcaacgacaccgaccaccaattcgtgaacggatcattgggtaccgtgcgcggatttgccgccgaaaacaagggcggatggccgatcgttgaatttgaaaacggcaatatcgttaccatgaagccgaattgctgggaaatgatggacggcgacacagtgctcgccagcgtcaaccaagtgccgttgcgctgcgcgtgggcgatcaccatccacaaatcgcaaggtatgacgctcgagcgtgcggtgatggatttgcggcgcactttcgcgcctggcatggggtatgtggcgctgtctcgcgtggaaggcctgcaaggcctgtatttgaacggtgtgaacgaacgcatgttcttggtttcgcccgatgcggtgcgattggatggtgagttgcgtctcgcctcggcgcaggcatccgatatgttggctcatgatggcatcgccgcgttccggcagaacattgccgttcccgacggtgacgagttcgcgcaggacgcgctgttctagtatggcgattgccttgtttgacatgtatgatgatttttgggattcgacggatatgactgttgtgttccgtccgtgcgttgccatacgtcggtgaacgggtggttggattgggcttacgtccccttgcctgagtagttttgggcatatgactaaagcacttcgtatgtccaccatgttcctgcgcactctgcgtgaggatcccgccgatgccgatgtcgtatcggataagcttctgcagcgcgcctgctacctgcgcaaggccgctccgggtatttggacctggctgccgctgggcctgaatgttctgaacaagatcgaaaacatcatccgtgaggaaatggcttcgatcgacgcccaggaagttcacttctccggtctgctgccgcgtgaaccgtatgaggccacccatcgttgggaagagtatggcgacaacatcttccgtttgaaggatcgccatgaggccgactacctgctggcgccgacccatgaggaaatgttcaccctgctggtcaaggacctgtactcctcctacaaggatctgccggttaccctctaccagattcagaccaagtatcgtgacgaattccgtccgcgtgcaggcctgattcgtggccgtgaattcatcatgaaggatgcctactccttcacgcttgacaaggaaggccttgtcaaggcgtatatggacgagcgtggcgcctacgagcgtattttcaaccgtctcgatttgaagtatgtgccggtgcacgccatggcaggtccgatgggtggtttcgaatccgaagagttccttgccccgatggaaatcggtgaagataccttcgcacagtcgccgagcggcaaggcttggaatgttgaggcgctgaccactccggaaccggaatccatcgacttcagcaacactccggccgctgaaaagcgcccgacgccgaatgctgaaaccatcgatcagatggttgaatttgccaacgccaaccatccgcgttccgatggccgcgcgtgggaggcctccgacattctgaagaacgtggtgatcgccgtgatgcatccgcaggatgacgagcatgacgagccgtggcgcgaactggtggttgtcggcgtgcctggcgatcgtaccgttgacatgaagcgtcttgaagcgcagttcactccggctgaaatcgaagaggccaccgacgaggatctgaagaagcatccggaactcgtcaagggctatattggcccgatggcgtttggcccgcaggctcgcggcggtgaaaaggctgaaaacgccaacgaaaccggcgaagcgttgcgttacctcattgacgcgcatatcgcccgcggttctgcatggttcaccggtgccgatgaagccggagtcgactactacgatctcgtgtacggtcgtgacttcgaagccgacggcgtggtggaagccgtgcaggttcgccacggagacatgagcccggacggttccggcccgctgagcttcgaacgcggtgtggaaatcggccaggtgttccagctcggtttgaagtattccaacgcgctcggcctgaaggtgctcgaccagaacggcaagaccgtgccggtgtggatgggctcctacggcattggcgtgtctcgtgtgatggcttgtatcgctgaaacccaccatgacgagaagggcttggcatggccggccatcatcgctcccgcccaggtgcatgtggtggccaccggcaaggatgcggctgcattcgaagccgccgagcaactgatcgccgatctggaagccaagggcatcgaagtgatcttcgatgaccgtaagaaggtttccccgggcgtcaagttcaaggatgccgagcttatcggcgtgccgctgatcgccgtcgcaggccgcgacactgtcaacaatggcaccatcgaagtgcgtgaccgcaatggcgagaacgccgaagccgtgcctgtcgccgacgcagcccgggtgattgccgatcgtgtcgccgcgctgctgaagtaataatcgtattttttctgattatttcaccatataaacggaagattatggatatgccataatcttccgtttttttatctggaaacaggtaggaggaagcatgattgtgaggaaaacatttatggggaaaacaaacgaaaaaccatgcatatatcggcagtgcattgcggtggataagtgagatttatccaccgactatccacgactcgcccgaaacggcgtcctttatccacatttgccggttgcgcttgtaccagtatggtcgaatcggggatagtggttctaccgcggaaacgcaaggaagcggaaaggcgtgcagaacccctctctcgcaacccatttctccgactgcgcgttgctttcgcaccttcatcggtgctttccgcggcccctttattaccaatgcgacagaaagggccgatcatggcacaacagcaagctctcatcaccatcaccggatatgtgggcgccaatcccacgcaattcaacaaggatggcatgccccatgccagttcgttcagaatggcgagcaccagacggtatttcgacaatcgcacacagcaatggaaggatcttcccaccacatggatcacggtgaaagcgtaccggaacctatccgagaacatctgccaatctctgaagaaaggcgagccggttatcgtgatgggcgcgctcgccacggaaacgtgggccgatcagaacggcaaaccgcagtcacgcatagtgctggaagccagcgccgcagggcacgaccttaaccggggagtcaccacgttgcgtaagttcgtcaagccgaacgaccagcaccagccggaaacgaaaggaacggaaccgcgtgtgggagccgatccgttcgtcaggcagggcagtgtggcgccggtcgaaatcgtggttcccgaagatgacgaagccgccgaattctcgggagataccggggaattcgacggcgacatatattaggcggcaccgatgccttgcatgcttggctccgattgccagccgatgatgtggtttgttaccagatgcgcacgcgctgatcgggatcgagccacatgccgtcctccggcttcacgtcgaacgccttgtagaacagatccacgttgcgtgcgatgccgttcgtgcggcattcggcgggggagtgcgggtcgatctgcagatactgctccgccagctcgtcacgattcttggtgcgccagatggacgcgtagctgaggaagaaacgctgcaaaccggtgaaaccatcgatttccggcgcctcagccagcgaagcttcaatggactccatggaaccgttcttctcacggcctgccacctcgtcaagagcgaacgcatatgctttgagcgcaatgttcacgccactcaggtcgccgatgttctcgccgatggtcaaagcgccgttcacatgcggagcctgagctggatcgtcggcgtatttttcggcaagctgcgtcggcacgaacgcgttgtactggtcgatgagtttctgcgtgagctgctcgaaattggccttgtcttcttcggtccaccagtcgttgagcttgccgtcgccgtcgtactgggcaccctgatcgtcgaagccgtggccgatctcatggccgatcaccgctccgataccgccatagttcgcggcgtcttcggcgttcgggtcgaagaacggcggctgcagaatggcggccgggaacacgatcacgttcatggtcggctcataataggcgttcaccgtctgcggattcatcagccattcgtccttgtcgacgctcttgccgactttggccagctgatagccggtctcatacaagttggcggcacgcatgttctcggcaaaaccggcattctcgcgcacatcaagcgcggaatagtcacgccaatggttcgtatagccgatcttcggcacgaacttggagagcttctccaacgccttctgcttggtttcttcgccaagccagacggagttggaaatggacacgcggtaggcgtcgatcagattgccgaccagctgttccatacgctgcttcgacgactcggggaagtgcctcttcacatattcgcggccgacatcctcgccgcagatgccgttgaccagcgaaacgccgcgcttccaacgcacgcgctgctgcttctgaccagacaacgtcttgccatagaactcgaaattcgtctcatcgaattcgtgcggcagctccaaggtggagccgatgatcacatgcacgcgtgcccacagcttgagatcgtcaagatccgcggccttccagaatgcgttaagaccggtgaggaagctgggctcatgcaccaccacatggttgaaaatgcctcggaaatcaagcggctgcacctgagcggcggaagtctggtcgtatgcggtctgccaagcgtcgatccacgtgtcgagatcgtaatcggcgagcattccgctcaattccgcataatcggtgggattataggtcttcaccgaatcacgggttgccacattgtcccaatggttcgcggcgatacgtgtctccacgtcgaggaaacgctgggcttgagcttcggcctgctcgtcatcggcggcgagcttcgcgttcttcaactgcttggccaccatatcgacgtatgcttcacgaatcggcgcataatggtcttcacggtaatacgcctcatcgggcagtcccaagccagactgttcaatatggatgatgttggtttcgggagcgcccggatcgccatacacggcaatgccgatcaggtcagggccgccagccgggttcatcgcgcccaaagagcgggtgagttcagccttgtcggcagcgacgtcaatagccttcaactggtcttcaatggccgcgagtccggaagcgttgatggcgtcgacgtcaaggaaactcgcatacagggcgtgggacttctcggcagggcagtcgtcgtcttcgagaatctcacgaatctggttttcggcatcttcggcgagcttatcgaacgaaccataacgggaacggtcgtcaggaagacgatacatgtcgatccatggaccgttgacatagcggaacagatcttgcgcagggccggtcacggcggagaacgatgccggatcgatacccgaattcaaagtggtactcatggcttcacactatccatctttggtgacaaaacagtgtatctgaaacgaataatcatcattccgcaacggcatgcataaggtgagatttgcataatcgtaagaaaagccagggagagccaagcactgtagggcgtacgaagtagggttagaggcatgattgaactgaaaacaccgaaagagatcgaagagatgaagcctgccggccgttttgtcggcggcattctgcgcgatctcaaggaatttaccaaagttggtaccaatctgctggaaatcgatgaattcgtgcacaagcgcatcgtcgatcgcaagggtgccgaatcctgctatgtcgactatgctccggatttcggtaccggcccgttcgcacactatatttgcgtttccgtgaacgatgccgtactgcacggcgttccgttcgattacaacctgaaggacggcgatttggtcagcctcgatctggcgatcaacgtcgatggctgggttgccgattccgccatcagcttcgtggtcggcgagcataaggatcctgaggatctgcgcctgatcaagtgcaccgaagaggcgctcgcggccggtattgccgctgcgcagccgggcaaccgtttgggtgatgtttccgcggcagtcggcgatgtggcccgcgaatacggctatccgatcaatcttgaattcggcggccatggcgtcggacgtattatgcacggcgatccgcatgtgccgaacgatggccgcgcgcaccacggctacaagctgcgtccgggcctggtcatcgccatcgaaccgtggttcctcaagaccaccgacgaaatctaccaggatccgaaagatggttggacgctgaagagctccgacggttcccgtggcgcgcatagcgaacacaccatcgccatcaccgacaacggtccggtgatcctcaccgttcgcgacaagtgatcagacggtagcgtaaaacgcggcaaagctccaatacgacggagcgaagcgtacgaaaagaaggccgatgcccacgattattcgggcatcggccttttatatgcgtaatttcgcgcggaaatagtcgaattatttgccttgcaggaatgaagtatcggatgtcaatcgattgattttgagacgaaaccatgcttggaaacgcgcatgccatatagtgttcgatacttccgaacggttaaggagcgtgcaagtatggccacagccaatctgagtgtggaatccaaagacttcaccctgccggtggtcgaagccacggcgggtgcggacggcatcgtggtgtccacgctgcgcaacgacggctgggtcacactcgaccctggtttcctgacgactgcgcaatgcgaatcgaaaatcacgtacatcgacggcaagaactcgatcctgcgctaccgcggatacccgatcgagcagttgtgtgagcaatccgatttccttgaggtcgcctggttgctgcgtcatggcgaactgccgaatcaggagcagtacgaccggttcatttccgacatcaaccatcgcacgatggtgggtgaggatttccgtaccttcatgggttctttcccacgcaccgcgcatccgatgagcgtgatggcatccgcggtcaacgcgctcgccaccttctatccggacactactgatatcaatgattccgaccagcttgacgaggctgcgaccatcattatggcaaaggcacgaaccatcgtcagctacattttccgccgtcgccgcgatgagccgatgctgtatccggattattcgcgcggctatgtcgacgatttcctgcgcatgtgctttgcggtgccgtacgagccgttcgattccgacccgctgtacgtgcatgcgctcggacgcctgctgatcattcatgccgatcatgagcagaactgctccacttccgtggtacgtatcgccggttccgcccacgccaacctgtattccgcggttgcggcgggcatcaacgcgctgtcgggcccattgcatggtggtgcgaatgaagcggtgctccgtcagctcaaagccattcgcgattcaggcaaaaccgtcaaggaattcgtggaagacgccaaaaccagcggtcagcgtatttccggactcggccaccgcgtgtacaagtcgtacgatccgcgtgccgcgatcgccaagacgtatctgcagaagatcatggaacgcgcggacacgttgaaattgcctgccgacgagcgtgcgctgttcgacgtcgccacggaattggagaaaatcgcgctgaacgacgagtatttcgtgtcgcgtcacctgtatccgaatgtcgacttctacacaggattgatctatcgcgcaatcgggttcgatccgtccatgttcaccacattgtttgcattggggcgtattcccggttggatcgcgcagtatcgtgagatgcttgccgatccgaacaccaagatcggtcgtccgcgtcaggtgtacaccggttataccgaacgtgattacactccgatcgaccgtcgatagttgctttttcgctgtttcatggacttgtgatgctgttcgccaagccctgcggctaaagtattgcacggaaacatgcaagtaatgcaatcactgttgtgaaggagcgaagaatgaccgatcagcgcactgcgtggggttggggtctgtccagcgtggatgcggccggcaacactttggacgtatggtacccggaactgaagcttggcgaggctccggaggaggtggcacgcccgaaccataattttggcaatctcgcccatgagggcgtcgatgcgcgtggcgtgcgccgcattccggtgttcacggtgtcgaagcttgacgaaccgatcgaagacgcagccgacgcatacctgcgtctgcatctgctgagcatgcgtctcgccaagccgaacaccctgaatctggacggcattttcgcagccctcaacaatgtggtatggaccaattatggcccgttcgcggtcgaggatttcgcgctgcgcaagcttgacgtgatggccgcggctaaccagtgcgttccgggactgccgaaggttgacgtgaacgtgctgtcgatcgacaagttcccgcgcatggtcgactatgtggtgccgaccggcgtgcgtatcggcgacgccgaccgcgtgcgtttgggtgcccacctttccgaaggcaccaccgtcatgcatgccggcttcgtgaacttcaacgccggcacgctcggcgtttccatggtggaaggccgtgtttcccagggtgttgtggtcggcaacggttccgatatcggcggcggcgcatccatcatgggcaccctgtccggtggcggcaagcttaagaactccatcggcgagcactccctgcttggcgcgaacgcgggcatcggcatctccctcggcgacaactgcgtggttgaagccggtctgtatgtgaccgccggcaccaaggtgaccatctacgacaaggccaaggtcgcggcgggcgaaccgctcgaaaccgtcaagggcgccgatctttccggcaaagacaacatcctgttcatccgtaattccgtgtccggccgtatcgaagcgcgctatcgcaagaccggcatcgaattgaacgaaaaactgcacaagaactaaatatcaaatatgaaaatctccctcattaccgtcggcaaagtcaaggaacaatatctgcgcgacgccatcgccgaatattcgaaacgactcagccgatactgcaagcttgacatcgtcgaagtggccgacgagaaaacacccgagcatgccagtgagggagtggaacggcaaatcaaagccaaggaaggcgaacgcatcgccaagcatattcgcgacgatgcgttcgtcatcgcgcttgccatcgaaggccagcagctgaccagtgaagaacttgcgcagaaaatcgacggtcttggagtgcatggcaccagccatatccaactcatcatcggcggatcgctcggacttgacccaacgattgtgaaacgggccgactacctgctgagtttttccaaaatgacttttcctcatcaattaatgcgcgttattctgcttgaacagctgtatcgtgcatacaaaatcaatgccggcgaaccgtatcataaatgacgtgcaatcaatgtcgcgtaatgcgtacacaggtttcgcgaatatgatatggcaggattgcgatgcgacaaaatatggtgagatcgccgaaagataataagtagaaggccttgcctatactagtaccccgtgagtgactacagaagcgaacgcgagcagcgagaacgccgtcgccgcaccatggtgcgggcggtgtgcattgtcatcgctgcggcgatgctgctgagtctggttattcctgctatctacgcaggtctttgacgcctttggtccggtatgatcctccccggacctgcaatcccatacgtaacgagactggttcgcggctcggcaggatgggaacgagtatgtgggtacgtggaagaagctgaggattgtgcgaaagccgtatgaggctccatgacagaatataaagaacgcataaagaaatgtatggtgtaaacgatggcagaatttgatttttcccaggcaatcggcgaggcgcgcgccaaatacgagtcgatttccaaggcgcttgacgtcgaccgactgaccgcgcaggccaaagatcttgaagttcaggcggccgaaccgggattgtgggacaatcccgaaaacgcgcagaaagtgaccagcaaactgtcggcagtgcagtcccagctgaagcgtctcgcttccgcaagccagcgcatcgacgacgtcgaaacgttggtggaattgggtcaggaggaagaagacgccgacacgttggcggaagcgcagtccgaagtcgaaagcattcagaacgatctggccgacatggaaatccagaccctgctcgacggcgaatatgacgaacgttccgcagtggtgaccatccgctccggcgcgggcggtgtggatgccgccgacttcgctcagatgctgctgcgcatgtacctgcgttgggcggagcgcaatgggtataaggccaaggtcatggacacctcctacgccgaagaggcgggcatcaagtccgccaccttccaggtggatgccccttatgcgtatggtcgcatgagcgtggaaggcggcacccaccgtttggtgcgtatctccccgttcgacaaccaaggccgtcgccaaaccagcttcgcggcagtggaagtggtgccgctcgttgaggcgaccgatcacatcgacgtgcccgattccgaaatccgcgttgacacctactgctcctccggccctggcggtcagggcgtgaacaccacgtattccgcggtgcgtatcacccacattccgaccggcatcgtggtgaccatgcaggacgagcgctcgcagatccagaaccgtgccgctgccatggccgtgctgcagtcccgactgttggtgctgcgccacgaagaggaagccaagaagaagaaggagctcgccggcgatatcaaggccagctggggtgaccagatgcgttcctacgtgctgcatccgtaccagatggtcaaggatctgcgcaccggctatgagacttcgcagacccaggccgtgttcgacggcgatatcgacgcgttcattgaggccggcatccgttggcgtcatgagcagcgtcgcgcggcggccgaagaggcggacgcctaaaaaccacgattaccgtaatcagaacagcacatagtggaggggtacgacgatggcgctgatttcgcttgaacatgtgagcaaggtgtatccgaaaggcaccaggcctgccttggatgacatcaatctcgacattaatcgaggggatttcgtgttcctcgtgggcgcttcaggttccggcaaaaccacattgctgagcctgttgctgcgcgaggaggaggtcacggatggcgagattcgcgtcgcaggtaatgatttgaggcgcctgtcgtcaaggcaggtgccgcattaccgtcgttccatcggttttatcttccaggattacaaactcctcaacaacaaaacggtatgggagaatgtggcgttcgcgcttgaagtgattggcacaagccgttccaccgtcaaatcgttagtgccgaaagtgctgcagactgtcggtctcaccggtaaggaaaacaactatccgcacgagctttccggcggtgaggcacagcgtgtggccattgcgcgagcgtatgtgaaccatccgcagattctgctggccgacgagcctactggaaatctcgatccgaccacatcgctgggcatcatggaagtgctggacgccatcaaccgcactggcaccaccatcgtcatggcaacgcataacgaggaaatcgtcaactccatgcgcaagcgtgtggtcgaactgcataccggcaaaatcgtgcgtgacgagcagcagggatcctacgattccgcactgtacttcccggatgccgaagtcgaatccaaatcgcatcaggcgttgaacggcggcgacgtcgactcgaaatatcgtgcgccgggcgcgcttgaaatgtctgatttttccgatgaggcggtggacgtggaaggcgcgacgcgagccgaaaccgcggcgaacgcggttgatgccgtagctgcggccatccacagcggcaatggtgatgcgggcatcgcgcgtctcgccaattccgtgcattccggtcgcaccggtcgttatggcgaggcgttcgctccggtggagactacgctgacctggggcaagggactgaaacttgaggatcttgccgaacaggagcatgccgattcggctgcacgttcgcagaccgaagccaatgccgacgcgactggctcttcgcctgatacaggcatggaatcaagcaaagcggctgaaaacgagcaatccgcggagccaacggttcccgctcctccggcactgccgatgcctcccgctccgcccgcgcctccggctcctccggcagcgcccgccgcgactgccggtggcgaggcgaaatccgtcgaacaatccgatgaacagcatgaaacgtccgaaagcaaggagaacgactgatgcgtttgcgtttcattctttccgaaacctggagcagcctcaagcgcaacgtgcccatgttgctttcagtgatgctcgttacattcatctcgtttctgtttatcggcgcatcggtgctcactcaggcgcagatcaccaaagccaaaggcgattggtattccaaggttgaagtggtggtgtggatgtgtcccgatggcaccagccaatccgtgaactgcaccgcgggaaccgcggcaacgcagactcagatcaatgacttgcagaaaaccattcgcaacgagcttgccgatgatgtatcgcaaatcacttttgtaagcaaggaagatttctacaacgacactttcctcaaacaatatccgaacggtgaatatcaggggcgtacgctcactgccgacgatatgcaggattcattgtggctgaaactgaagaatcctgagaaatatcaagtcgtttccgaagtgctttctggcaaggagggcgtcgataccgtcagtgatcaacggcagatttttgagccggtgttcgcagtgctgaatcgtgcgaccattgcaaccgccgcattggccgcggtgatggtggtcgtcgccattatgctgaccggtaccacaattcgcatgtctgctgcgtcacgtcgaaccgaaacggagatcatgcgtttggtgggtgcttcgaattggaccattcggctgccattcattcttgaaggggcgatcgcatcaatggtcggctccttgctttcctgcgtcactttatcggcattggtgaaggtatttatcactgattggcttgcagcctccgtgaaatggattccatatgtgaatcagatgacggtattgtggatttcgccgattttggttgcgggagcggtgctgttgtcggtgattgcatccacagtgtcgttgcatagatatttgaaagcctgagaacattccgttttgtacggattggatacgtttatctgtgtcgcgttttaagcatgggatgctatggtatggaaccaatgatgggaggcaagtgaccgaatgacaagcaagaaagctctaaaaccggccgtcgcggtgtttgcaacgggggctttgtgcgccacgatggcgattgccccgttctcgtctgcggttccgcaggcgcaagccaatacatacagcaatctggtgaatgcccagaataagaaggctgccagctctcagcgtgaagcccagttgcgttcacagctttccggtgtgaagtctgatttggccgacaagatcgtcgagctggatgaattgacaaatacgaaaattcctgcagctcaagctgcagtcgatgaggcaaatgctactgccgcttcggcacagagtgaagctgatgctgcggcttcccgtttggaggccgcgcaaaaagataaggaaaacctcgaagcgcagatcgaacagaccggcaaggattatgatgacgcgcatgcggccgtggcacagatggctcgtgaagacctgcatggttccgatgcatccactgtgatgagcgtggtgacaggttccacgagcactcaggaattcattaattccatgcagtctcgtgatgcgttgagccgtaccgaagccaatgcggcaagtgatgcggcgaatacgttgaacacatcgatgaatcgtagcgagcgtctttctgcaatcgagaagcagatcgccaatctgaaaaccgcagctgacgaaaaagccgcttccgcacagcaggctgctgcttccgcacagacccagcgcgactcgcttgaccagttgcgtgcagaaggcgaaacccgccgtgccgaattggaaagccaacagtcgcagctgaacggcagcgtggccaaacaggcggcgcaaacggttatgttgcagtcacaggtcgattccttcaaccgccagtatgcagccgagcaggccgcagcagctaatcaaaacaatggtggcaatcaagggcagacccggccaggcaacaacaataccaatagtggcggcaacaatgtgacgcctgctcccacgcctacgcctactcctacgcctgctcccgcgccgagtaccaataacaattccggtcagggaacctccaatggcgattacggcaatggctacgtggccggccagtgcacgtggtgggcgtacgaacgtcgtagacagatgggtatcggaaccccctcgtacttgggtaacggtggccagtggtacgctaccgcaccgtcgtatggtcttcgcgtggatcatagcccgcaggtcggtgcggcaatctccttcctgcccggtcaggctggtgccgatggcttctacggtcatgtgggtgtggtggaagcggtgaatggcaacaccatcaccatttccgaaatgaacgcggctggtggcccatatgtggtgtcgtaccgcacactgtacaacgcgtcccagttctggtatgtgcactgattcatcaaggagtgtttgagtttttccttgagcattgtgtcacgggagcgcgccgcctgaatcgttgggcggcgcgctcccgtgatattgtcgattgttgcgttgcagaacacttcttcgaagaaccggaaaggaggtccgacatggccaaggaacaaggtgtgaagccgattgcgcagaacaagaaggcacgccatgattacgccatcgaagacaagtatgaagccggtctggtgttgaccggcactgaggtgaagtcgcttcgtgagggacgcgcatcgctggccgaatcgttcatcaccattgaccgtcgcggtgaaatgtggcttgagggagccaacattcctgaatatctcaatggtacgtggaacaatcatgcccctaagcgcaagcgtaagctgctgcttcatgcggcgcagatcgacaagctggcacgtcaaagccaagccaaaggtttcaccatcattccgctgagcctgtatttcaaggatggccgtgtcaaggcggaaattgcgttggctcgaggcaagaaggaattcgacaagcgtcaggcgttgcgcgaggaacaagacaagcgtgaggcgttgcgtgccatgcgctatgccaacaagcaagtgcgataagtcgaaaccggaaaatttccggtttcacatactgacataaagcggtggtcgtaatctttttgtagcttgccctctctagtgtatggttcagattcggtcgaatagatcgagcgagacataggagaaaaggatatggaagcgaagaaaagtctgaaggcggctgccgcgtgtgcgctgagcgttgcgatgctgtttgctggagcggcatgcggtaccagtgatggaagcgacgatgcggcttcgtccgatagcggttcgaaatcgagcgagctgacgggatatgacgtttcgtcggtgcagaaagacgatgacattgccaaactgttgcccgactatgtgacgaaggacggcaagctcaccatcggtatggacacgtcgtacgctcctgccgaattccttgcggaggacggcaagaccccggtcggcttcgatgtcgacatcgccaaggctttggcgcaggtgttcggccttgaagcggatccggaaaccgcgaatttcgattcgatcattccatcggtcggatccaagtacgatatcggcatttcgtcgttcaccgtgaccaaggaacgtttggaagcggttgatttcgtaagccatttcgatgccggatcggcatgggccgtgaagaagggcaattcgaacaagatcgacgtgtccgatctgtgtggcaagaaggtggccgtgcagactgcaaccatgcaggagaccgaagcgaacaagatggccaagcaatgcgaggccgacggcaaggataagcttgaagtgatctccagcaagctgcagaccgatgtgaccacgaacgttgtcaccggcaaggctgacgtgttctatgccgattcgccggttgcgggctatgccatcgcacagaccgatggacagctggaaatgctgggcaaggtcgaaggcgtcgctccggaaggcatcgtcatcaaaaaaggcgacagccagatggatgaggccgtgcagaaggccgtgcagaagctcatcgacgacggtacgtatctgaagatcctcaagtattggggtgtcgaggacggtgccatcgaaacgtcggaaatcaatacgccgggcgccgaatgattccatgattgaaccgtccgcggatcagacggttttaaggatcgcctagctggcaacgtgccgggaacaaagcgggttttgatcatattgtgatgtggcaaaacccgctttttcgtaaggaaaaacggcatatcgaatagagtttgcgtgctattaacgtggccgtagcaatcgttttctatggtgcccgcagaacttcggttcggccgtattcatgcggttgggaatgaagagaggattcgcgatggctttcaataatctgaggaaactcgccgtttttgcgctaagcgctgtcatgatcgtttcgttgggtgcgtgcggcacatcggaaaagtccgattccatggcttccggtgattctgagtcgtcgtcgaacaccaccggttatgacgtttccggcgtgacgaaggatgacgatatagccgcgatgctgccggaatcagtcaccaaagacggcaagctcaccgtcggcatggacacgtcgtacgctcccgccgaattccttgcggaggacggcaagaccccgatcggtttcgatgtcgatatcgcgaaggcgctcgccaacatgttcggtcttgaggccgtgccgcaaacgtcgaacttcgattcgatcattccgtcgatcggcaccaagtacgatatcggcatttcgtcgttcaccatcacgcccgagcgtatggaagccgtcgatttcgtgagcatgttcaaggccggttccacgtgggtggtgaagaagggcaatccgaacaaggtcgatacttccgacctgtgcggcttgaagatcgcggtgcagacgggcaccacgcaggaagaggaagtcaacgcggacgccaaacaatgcaaggccgacggcaagtccgaagtgcagattctgtcgaataagctgcagaccgatgtgaccacgaacgtggcgacgggcaaggccgacgtattctatgccgattcgccggttgcgggctatgccatcgcacaaaccgaagatacgctagaagccctcggcgaggatgtcggcgtgaccaaggaggccgtggcaattaagaaaggcgattccgataccgccaaggcggtgcaggccgcactgcagaagcttatggatgacggcacgtatatgaagatcctcaagcattggggcgtggagaacggagcgatcgacaaagccgaaatcaatccgaccgacctcggctgaacgatcaaacgtaaggcagacatcgcacacggcgatactgtgatgccgatatgacggaaggcatgcggaccaaatccgcgtgtcttccgtttttcgtatatggatcttccgtgattcgacggagctacattgcgcgattcttggctggtacgtaagttttgcgcaacgtaacgtacatgtagcattgcgctcttatcgtgcctatttgagatactgaggttctctgcaactgaatggcgttgagattttcggtatggcaatgaagagataagaagaaggatatgcgtatcatgtctttgaagatcaagtccgttgtggcgcttgcgctgagcgcggcgatgctgttttccactgccgcttgcggcacctccgatgcgtctaaatccggtgattcgtcggattcgtcgaacactatcaccggttacgatgtcagcaccattgaaaaggatgacgagctggccaagctggttccgtccggcgatctggtgaaggacggcgagctttccgccggtatggagctttcgtacgctccggctgaattctatgccgaagacggcaagactccggtcggctatgatatcgatatgaccaaggccatcgcaaagacgcttggtttgaagccgaacatcgtgtcttccatgttcgacaccatcattccttccattggctccaagtatgatctgggcattaccgccatgaccatcaccgaagagcgtatgcagtccgtggatttcgtgagctactaccgtgcaggttccacgtgggccgtgcagaagggcaatccgaagaagcttgacacttccgacatgtgtggcgcgaagatcgcggtgcagaccggcaccgtgcaggaagaggaagccaacaccatcgccaaaggatgcgaggccgataacaaggccgaggtgatgtcgtacaagcgtcaggccgaagcggccaccgcagtggctacgggcaaggccgatgcgttctatgccgattctccggtcgccggctatgccatctcccagactgacggacagcttgaagccttgggcgacgttgaaggcgtggccaagcagggcatcgctgttaagaagggcaacacccagcttgctgaagccgtgcagaaggccgtacagaagctgatggacgatggcacgtatatgaagatcctcaagcattggggcgtggaatctggcgctcttgacaaggctgagatcaacccgactgatctcgactgatctcatccccactatttacatcaacaacgaaggaactgaagcatcatggcgaagaaacagatcgacggcgatggcctcgatattccgaatcgcatcaaggcgctgccggttaagcgtacgggcccgattgtggcggcggtcatcgtcgctctgctcgccgccatgctgctgcagggcctgattaccaatccgcgtttcgaatggaatgtggtctggaagtacctgttcgacaagaatgtgcgcgaaggcatcaaatacacgttgctgctgacggtcatctccatggtcatcgccattattctggcagtgattctggccgtgatgcgcaagtccatcaatccggtgctgcgtggcgtgagctggttctacatttggttcttccgtggcacccctgtgtatacgcagctggtgttctggggtttgttcgccgtgttggtgcctcgcatcggcgtgggcattccgttcacttccattgaattctggagcattgactcgcagtccgtcattaccgcgttcaacgcggcatggctgggtctcgcactgaacgaagcggcatatctggctgaaatcgtgcgtgcgggtcttgaagccgtcgatccgggtcagaccgaagcggccaaggcgctgggtatgaagcgctccatgatcatgcgtcgcgtggtgcttcctcaggctatgcgcatcatcattccgccgaccggcaacgagttcatcggcatgttgaagaccacttcgctggtcaacgccgtgccgttcacgctggaactgcagttcgccaccaccgcaatcgcaacccgactgtacaagccgattccgctgctgatcgtggcctgcatctggtatttggtgatcacctccattctgatggtgctgcagtctcgcctggagaagcatttcggcaagggcttcgatgcgcgaccggccggcgcgcgcggcaagcagccgccgctgccgggcaaaaccggaggcgaaccgaaagacgatatcgccaagcagaacgaggcaacgttcgcgggcatgaccgcgtgaggggagtgagcaatgactgaaccaaccaccaacggtgttgttcccgcagtgaaggccacgcaggtgcataaggctttcggtagcctgcacgtgctcaagggtgtcgatatgacggttatgcccggctcggtgacggtgattctgggaccttccggttccggaaaatccacgttcctgcgcctgatcaaccagttggaaacgctgaccggcggcgaaatcgacgtcgacggtgaaatgatcggctacaagtatgtcgacaaggacggcaagcaggtgctgcagaccctgaacgacaaggaagtggccgagcagcgttccaaactgggcatggtgttccagaggttcaacctgttcccgcacatgacggctctcgaaaatgtgatggaagcaccgatccatgtcaagcacatggataaaaaggaagcccgcaagcttgccatcgaagagctgaaccgcgtgggcatgggcgatcgcctcgaccactatccggcacagctttccggaggccagcagcagcgtgtggccattgcccgtgcgctcgccatgaagccggaaatcatgctgttcgacgagccgacttcagcactcgatccggaattggtgggcgaagtgctgaacgtcatgctgtctttggcgaaagaaggcatgaccatggtggttgtcacccacgaaataggcttcgcgcgcgaagttgccgatcagatcgtattcatggacggcggtgttgttgtggaacagggcggtcctgaaatcatcgacaatccgcaggaaccacgattcaaggacttcctgcagcacgtgctgtaaatcgccgtaagcataatcgttaaggatcagacatctcttcgtcgcgagaattgcgattaagggaagagctgaagaaaatccccatgttgaaaactgtcggcatggggatttttgtgtccatatatcaaaggttcggtgcgatgggacggtttcgtttcgaaaatgacaccattacccgataagctgaggtgttatgtgtggaatcgtaggatatgcaggaaatgtggaaaccgtgtgcggcaagccgttggaagtgtgcctccaaggcctacagcgtttggaataccgcgggtatgattcggccggtgtggcgctgaccgcgcccggcatggaccatgtggaagtgcgcaagaaggcggggcgcctcgccaacctgattgaagacgtggaacgcaaaccgatgccgatggccaccgtgggcatcggccatacccgttgggccaccaacggcgtgccgaacgacatcaacgcgcatcctcatacctcgcaagacggcaaggtcgccatcattcataatggcatcatcgaaaacgcctctcagcttcgtcttgatctgcagacggaaggttaccgtttctcatcggaaaccgatacggaggtcgcggcgaaactactgggcaaaatcagtgagaaaatcgttgaggaaaccggcaagcccgacttgttcaaggccgtgcgacgcctggcacgcatgctagaaggcgcattcacgattctcgccaccgactgccgtcagccgggtatcgtggtcggcgcccgccatgattcgccgctggtggttggtcttggcgaaggtgagaattttctcggttccgatgtggccgcgttcgtggcctacacgaagcgtgccatggaaatcgatcaggatcaggccgtgatggtgtccgccgataaggtcgtggtgtctgatttcatgggcaacatcgtggccgatccgaagacctacaccgtggattgggatgcttctgcggccgaaaagggcggttgggactccttcatgaacaaggagatccacgaagggccggcggcggtgcagcgcacgctgttgggacgtctcggcaaggacggcaatctcaatcttgacgaggttcgcatcgacgagcatgatttcaaggcgatcgacaagattatcgttatcgcctgcggtaccgccgcctatgcgggcatggtggccaagtacgccatcgagcattgggtgcgtattccggtggaagtggagctcgcccacgaattccgctatcgtgatccgattctcaccccgcgcacgttggtggtggccatttcgcagtccggtgaaaccatggatacgctgatggcattgcgtcatgcgcgcgagcagggttcgaaggtgctggccatctgcaacacgcagggcgcgtccattccgcgtgaatccgacgcggtgctgtacacgcacgctggtccggaagtggcggtcgcctccaccaaggcgttcgtggcgcagattactgccgcctacgtgcttggcttgtatttggcgcaggtcaagggtgcaatgttccgcgacgaaatcgcgcagacgttggattccctcaaagacatgcctcgcaagatccagtggattctcgacacgcagaccgagaccgtgcatgatgctgccgcgcagatggtcgatgcgaagtccttcctgttcctggggcgtcatgtcggctacccggtcgcgatggaaggtgcgttgaaattgaaggaaatcgcctacaccttcaccgaaggtttcgcggccggcgaactcaagcacggtccgatcgcattggtggacgaaggcgaaccggtagtgttcatcgtgccgccggcacgtggccgcaatgtgctgcacgccaaggttatttccggtatcgaagaggtcaaggcccgtggcgcgtacattatcgccgtggccgaagagaacgatcccgatgttgaacgctacgcggacgtggtgttctggcgtccggcctgcccaacgctgatgagtccgctggtggacgtggtgccgctgcagctattcgccatggacatggccaagctgaagaattacgacgttgacaagcctcgtaatcttgccaagtccgtcaccgtggagtaaccgttcatacgatgcgtcaacagagtcagcagaagaggcatcgttacgttcttgaagaacctcgcattccgttcgaatgtgaggttctttacgagaacgatgcgattatcgtggttgacaaaccgcattttctcgccaccacaccgcgcggcatgtggtatcgtgaaaccgcgttgatccgacttcgggaacagtatggcgaacctgatattgttcccgcgcaccgtttggatcgacttaccgcaggtatcgtcgtatttgtgcgcaaaccggaattgcgtggcgcttaccaaatgctgttccagaatcgcaaaaccatcaaaacctatgaatgtttggcgccacttgcccccgaacagcatccgcaatacggaacaatcgtaagaatcgacaggcatcaaccatttccggcaatccgagcatcgcatatttgcaaggatcgcgggcgacttcaggcgtacgaaattccggaaatcgtcaatgcgcaaacgttgattgagcgggggaatacggtacgttgcatcgacggcaaagcatatgtgaattatgtgctgcacccgaaaaccggcaaaacgcatcagttgcgtgtgcatatgaattcgttgggattgccgattttgggcgatgatttctatccgaatattgtgcagcattcttacgatgatttctcgcaaccgttggaattagtggctcgtgaattacatttcgacgatccggtgacgggagagcctcgtacgttcgtttcgaaagtgccgcttggctgattaacagtctgatcagcaggcatggctcgatgaataaagatatataaactgttcatcgctgtactgatatttgatcgcatcgctatggcgtgttgaagttgcgcgtccctataattggacattttacatttcgtgttatcgagcgtgattaggatgtgctcttgttgtgctggctggcaaaggcaagccagctggaaagaacgagagagaatatgaaccatatttcgaaagcgcttcgtggcgttgccgacaaatataacggcgtatcactgattatccgcattatcgtcggtcttatcgcgggcaccgcactggcattggtcgtcccgcatatgacgtggatcggcgaattcggcaccctgttcgtaagcgcattgaaggccgtcgctccgattctggtgtttgtgctggtggcaagcgctttggctcaaggtaattccaagcttgacggccgttttggcacggtgcttttcctgtatctgttcaccacgttcctgtccgccgtcgtggcggtgctgacgtctcgcacgttcccgcagaccatatcgttgggcgatgccgctgacgccgatgtggtgccgcagggcttgagtgaggttgtgcagacgttgctgaccaatattgtggccaatccgattcaggcaatgatcgacggcaactacatctgcattctgatgtgggcttgtctgttcggtcttgccatgaagggtattgccaatgaaagctccaaggcgttcctcgctaatgtggccgatggcgtgtctcaggtgattcgttgggtcatcaatctcgccccgttcggcattatgggcttggtgttcaccagcgtttccgaaaacggcttggcggccttcaccgagtacggtagcctcctgctcctgctcgtcggcaccatgctgctgatggtgctcgtgttcggcccgctggtcattttcctgtacctgcaccgcaacccgtatccgctggtataccgctgcttcaaggaatccggactgaccgcattcttcacccgttcctccgcggcgaatattccggtcaacatgcagctgtgcgagaagcttggtcttgataaagacatgtattccgtgtccattccgctgggcgcaaccatcaacatgaacggtgctgccatcaccatcaccatcatggccatggctgctgccaatacgatgggcattcagatttcgctgccggccgccattctgctgtctgtggtgtcggcgctcggtgcatgtggcgcttccggcgtggccggcggttcgctgctgcttattccgatggcttgctcgctgttcggcatcagcaacgacatcgccatgcaggtggtgggtgtcggcttcatcattggtgttattcaggattctgtggagacctgcctgaattccgcttccgatgtggagtttgcggcgaccgccgaatatcatgcttggctcaagcagggccgtcagcttcctgcgttcatgtattccaagaaggaacgccagcagctcggcatcgaagcctgatttcgcccgattccggtttttcgttcaatctagaaggcgtctctcccacgcggttcacccacgctggagagacgcctttttcgtattggctgatttgattgattgcgttgattaaagtcgcgagatattgcgattagtcgagtttcgctacggatccgcggtcgatgaattcgggggtgataagtttcttgattccagaaggcacttttttgccattgcattgttgttcgatcatggaaaaagcctcttttcccacagttctgagcttgagacgtacggtggtcagttcaagacggggcacaacgccgcggagtgaatcgtccacaccgatgatgctgacatcttcgggaacgcgctttccggctgtcctcaggccaagcatggcaccgtatgccatttgatcgttgcctgcgaaaattgcggtgcaatccttttcgtgggccaaggccaatccggcttggtagccgctatctgcttcccagtcgccgtaatacatgggtggtgtgggaatgccgacttgcgctaatgcgtcgcgccaccctctgatgcggctctgtgctgcgcgtgaaacggtggggcctgcgatgtggtacacagttttatgtcccttcgacaggaaaaagtccacggctgcagtggcgcaaccatacgagtccgaatcgatggtagggcagtggtttgccggttcctcgcaaataagcactaccggtaggttgtcggatggcttgaactggttgaagtcggtgaaatcgcgttccataatcacgattgcaccatcgagggggaggccttccacaagtttcagtgcgccggcgagtgactgatcctgcaggttatccaaggggcgaatggtgatggaatagccgctattcgcggccgctgtagtgatgccttcgaggatacgtgagttcccgtaggccgacatatgcgaaagcagtacaccaacattgttgaaatgtccgcttttcaaagcacgtgccgcataattcggcctgtatccgagatgctccatggctgcctcgaccttaagtttcgtcgctgggcgtacggcatcgctcccattagccactcgggaaacggtctgcggtgaaacccctgcttccctagcgacgtcttgcagcgagactgagttgcgtgccatgtgtatctaccttccgaacgaaaatgcgtactgtgcttaactttacatgcttacttctgtattgttttcgtcaccatgcaatttgttcgatgcagtgaatatgtggtctagaatgtgcgaaaagtagacacttttggaatatagtgttattatgataacgcaaacatttggaaggagctgttttacgggggtgtaaattgccctgtgaaatggtattgcctcgaaggagaggaatgatgtcagcgacggaagttgttgccaatatgccactgcattcggcaaccgtgcgtgtcaataaacacaaggcggattggcgtggttggaagtttatgtggccgttcgcgttggtgttcgtgttcgtgttcgtgatcccgatcctgtacgcggtctacatcagcttcttccagaagcagatgatcggcggcacgaggttcgtgggagtcagcaattacattcgtctgttccatgatccgcagttctggggttcggtatggcgcgtggccctgttcaccatggtgcaggttcccatcatgctgttcctgtcggcggcgatggctttggccttggattccatgaagctgcacggcgcgaagttcttccgcatcaccacgttcctgccgtacgcggtgccggccgtggtatcgaccttggtgtggggcttcatgtacggcgcgaaatacggtctggtcggctccctgaacgactggctgggcacgaacctcgacgtgctgagcccaagcgtgctgctcgccgc
